United States Patent 11,098,302 (IDENTIFICATION OF POLYNUCLEOTIDES ASSOCIATED WITH A SAMPLE) - sequence listing, part 37

SEQ ID NO: 124733 - DNA, 212 bp, Homo sapiens
  misc_feature: GYAE6OF01DXXE6.8.23.C01.1.454.CMB.1.raw
  modified_base (208)..(212): a, c, t, g, unknown or other
  misc_feature (208)..(212): n is a, c, g, or t
tcagctcgcgtgtccacgaccggtgctcgatttagtacacgtgattagggattgggctgactattttgtcaggtgtgggacagcagcatttatgtcttcggacctgggaccaaggtcaccgtcctaggtcagcccaaggccaacccactgtcactctgttcccaccctcctcgacacgcgagctgagcgggctggcaaggcgcatagnnnnn

SEQ ID NO: 124734 - DNA, 603 bp, Homo sapiens
  misc_feature: GYAE6OF01DY4HK.8.23.C01.1.454.CMB.1.raw
  modified_base (369)..(369): a, c, t, g, unknown or other
  misc_feature (369)..(369): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacaggacggccaggattaccgtggtgggggttcaatattggaggtaacaatgtgcactggtaccagcaggaaggcgagggcacggccctgtactggtcatctagtgggggatccgagtccggcagggtcgggacccctggcgcgtattctctcgcctccatcgtcggggaacnccggccacctgaccatcagacaaacgcccaagccggtagagtgacggtctgtacttattttgcgtagggtgtacgggacaggcagtctatttagtcgttcgttcggaccgtgggaacctaacggtccaccggttccgtacggtccacgacccgaacggaccccaaaccccgacttacggtaccctaaccgttcccgttaccgttacccccgtcccctcccgtcccggtaacccg

SEQ ID NO: 124735 - DNA, 211 bp, Homo sapiens
  misc_feature: GYAE6OF01A75A5.8.23.C01.1.454.CMB.1.raw
  modified_base (209)..(211): a, c, t, g, unknown or other
  misc_feature (209)..(211): n is a, c, g, or t
tcagctcgcgtgtccacgaccggtgctcgatttagtacacgtgattagggattgggctgactattttgtcaggtgtgggacagcagcatttatgtcttcggacctgggaccaaggtcaccgtcctaggtcagcccaaggccaaccccactgtcactctgttcccaccctcctcgacacgcgagctgagcgggctggcaaggcgcatagnnn

SEQ ID NO: 124736 - DNA, 511 bp, Homo sapiens
  misc_feature: GYAE6OF01CZWYR.8.23.C01.1.454.CMB.1.raw
  modified_base (351)..(351): a, c, t, g, unknown or other
  misc_feature (351)..(351): n is a, c, g, or t
  modified_base (479)..(479): a, c, t, g, unknown or other
  misc_feature (479)..(479): n is a, c, g, or t
  modified_base (506)..(506): a, c, t, g, unknown or other
  misc_feature (506)..(506): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggccctgtactggtcatctatggggatccatccggcaggtggacccctgcgcgattctctgcctccatctcggggaacncggccacctgaccatcagcaaagcccaagccgtgatgaggctgactattttgcaggtgtgggacagcagctattatgtcttcggacctgggacaaggtcaccgtctagtcagcccaacggccaacccnctcgtcactctacgttcccgccctccncgacc

SEQ ID NO: 124737 - DNA, 526 bp, Homo sapiens
  misc_feature: GYAE6OF01AJD59.8.23.C01.1.454.CMB.1.raw
  modified_base (355)..(355): a, c, t, g, unknown or other
  misc_feature (355)..(355): n is a, c, g, or t
  modified_base (490)..(490): a, c, t, g, unknown or other
  misc_feature (490)..(490): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatggggatccatccggccaggtgggacccctgcgcgattctctgcctccatctcggggaacncggccacctgaccatcagcaagcccaagccggtgatgaggctgactattttgcaggtgtgggacagcagcatttatgtcttcggacctgggaccaaggtcaccgtcctaggtccagcccgaacggcccaaccccnctcgtccactcctcgttccccgccctccgtcgaccg

SEQ ID NO: 124738 - DNA, 559 bp, Homo sapiens
  misc_feature: GYAE6OF01CHTJP.8.23.C01.1.454.CMB.1.raw
  modified_base (448)..(448): a, c, t, g, unknown or other
  misc_feature (448)..(448): n is a, c, g, or t
  modified_base (520)..(520): a, c, t, g, unknown or other
  misc_feature (520)..(520): n is a, c, g, or t
  modified_base (543)..(543): a, c, t, g, unknown or other
  misc_feature (543)..(543): n is a, c, g, or t
tcagctcgcgtgtccacgaccggtgctcgatttagtacacgtgattagggattgggggcctgggcctcaggaagcagacatacgggggtgtccgctagcctattggcctggaccggctcgtccttcgtggaggcctaccttgctccaccttttacgaggttctcgtaggcctcctactggagctgactccacgcccactctcagtgtcagtggccccgggcagacggccaggattaacctggtgggggttcaatattggaggtaacaatgtgcactggtaccagcagaaggcagggcaggcccctgtactggtcatctatgggggatccatccggccaggtcgggacccctgcgcgattctctgcctcatctcggggaacgcggccaccctgaccatcagcaaacgcccaagccggtgatgaggctgactattttgcaggtgtggacngcagctattatgtcgtcgtaccgtgggaccaaggtccaccgtcctaggtccacgcccaacggcccaaccccnctcgtccactcctcgttaccccnccctccgtccgacccg

SEQ ID NO: 124739 - DNA, 212 bp, Homo sapiens
  misc_feature: GYAE6OF01EQ60F.8.23.C01.1.454.CMB.1.raw
  modified_base (209)..(212): a, c, t, g, unknown or other
  misc_feature (209)..(212): n is a, c, g, or t
tcagctcgcgtgtccacgaccggtgctcgatttagtacacgtgattagggattgggctgactattttgtcaggtgtgggacagcagcatttatgtcttcggacctgggaccaaggtcaccgtcctaggtcagcccaaggccaaccccactgtcactctgttcccaccctcctcgacacgcgagctgagcgggctggcaaggcgcatagnnnn

SEQ ID NO: 124740 - DNA, 558 bp, Homo sapiens
  misc_feature: GYAE6OF01A4S0N.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtgggggttcaatattggaggtaacaatgtgcactggtaccagcagaaggcagggcaggcccctgtactggtcatctagtggggatccagtccggccagggtcgggacccctggcgcgtattctctgcctccatcgtcggggaacgcggccacctgaccatcagcaaagcccaagccggtgactgaggctgtacttattttgcgtaggtgtgggacagcagtctatttagtgtcgttcggaccgttgggaaccaaggtccaccgtccgtaggtccacgacccgaacggcccaaccccgctccgtcaccttcctaccgttaccccacccctccgtccgaaccg

SEQ ID NO: 124741 - DNA, 209 bp, Homo sapiens
  misc_feature: GYAE6OF01DTV2O.8.23.C01.1.454.CMB.1.raw
  modified_base (208)..(209): a, c, t, g, unknown or other
  misc_feature (208)..(209): n is a, c, g, or t
tcagctcgcgtgtccacgaccggtgctcgatttagtacacgtgattagggattgggctgactattttgtcaggtgtgggacagcagcatttatgtcttcggacctgggaccaaggtcaccgtcctaggtcagcccaaggccaacccactgtcactctgttcccaccctcctcgacacgcgagctgagcgggctggcaaggcgcatagnn

SEQ ID NO: 124742 - DNA, 552 bp, Homo sapiens
  misc_feature: GYAE6OF01AET6L.8.23.C01.1.454.CMB.1.raw
  modified_base (406)..(406): a, c, t, g, unknown or other
  misc_feature (406)..(406): n is a, c, g, or t
  modified_base (519)..(519): a, c, t, g, unknown or other
  misc_feature (519)..(519): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattaccgtggtgggggttcaatagttggaggtaacaatgtgcactggtaccagcagaaggcagggcacggccctgtactggtcatctagtggggatccagtccggccgaggtcgggacccctggcgcgattctctcgcctcatccgtcggggaaccgcggccacctgaccatcagacaaacgcccaagccggtagagnggaggctagtacttagttttgcgtaggtggtgggacagcagtctatttacgtgtcgttacggtaccgtgggaccaaggtccaccgtcgaggtcacgcccgaacgcccaacccnctcgtccactctcgtccccnccctccncgaccg

SEQ ID NO: 124743 - DNA, 211 bp, Homo sapiens
  misc_feature: GYAE6OF01BWWXJ.8.23.C01.1.454.CMB.1.raw
  modified_base (209)..(211): a, c, t, g, unknown or other
  misc_feature (209)..(211): n is a, c, g, or t
tcagctcgcgtgtccacgaccggtgctcgatttagtacacgtgattagggattgggctgactatttttgtcaggtgtgggacagcagcatttatgtcttcggacctgggaccaaggtcaccgtcctaggtcagcccaaggccaacccactgtcactctgttcccgccctcctcgacacgcgagctgagcgggctggcaaggcgcatagnnn

SEQ ID NO: 124744 - DNA, 577 bp, Homo sapiens
  misc_feature: GYAE6OF01BD2JR.8.23.C01.1.454.CMB.1.raw
  modified_base (529)..(529): a, c, t, g, unknown or other
  misc_feature (529)..(529): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccgagtccggccaggtcgggacccctggcgcgattctctcgcctcatcgtcgggaacgcggccaccgtgaccatcagcaaagcccaagccggtgagtgaggctgacttattttgcgtaggtggtaggacagcgagtctaatttatggttccgttcggtaccgttgggaacctaacggtccgtaacccgtccgtacggtccacgtaccccgaacggccccaaaccccncgtaccgtaccaccttcctccgttaccccgcccctccgtccgaacccg

SEQ ID NO: 124745 - DNA, 577 bp, Homo sapiens
  misc_feature: GYAE6OF01DI1J4.8.23.C01.1.454.CMB.1.raw
  modified_base (367)..(367): a, c, t, g, unknown or other
  misc_feature (367)..(367): n is a, c, g, or t
  modified_base (455)..(455): a, c, t, g, unknown or other
  misc_feature (455)..(455): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtgggggttcaatattggaggtaacaatgtgcactggtaccagcagaaggcagggcaggcccctgtactggtcatcgtagtggggatccgagtccggccagggtcgggacccctgcgcgtacttctctcgcctccagtccgtcggggaacncggcccacccgtcgacccatccgacgacaaacgcccaaggcccggtgacgtgaggctgactttattttgtacgtagggttgtgggacnggacagctatttatgttcgttcggtactgggacctaggtccaccgtccgtaggtccacgacccaacggaccccaaccctctcgtccaccgttcctcgttacccccacccttccgtcgaaccg

SEQ ID NO: 124746 - DNA, 559 bp, Homo sapiens
  misc_feature: GYAE6OF01DJD7Q.8.23.C01.1.454.CMB.1.raw
  modified_base (361)..(361): a, c, t, g, unknown or other
  misc_feature (361)..(361): n is a, c, g, or t
  modified_base (519)..(519): a, c, t, g, unknown or other
  misc_feature (519)..(519): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattaccgtggtgggggttcaatattggaggtaacaatgtgcactggtaccagcagaaggcagggcaggcccctgtactggtcatctagtgggggatccgatccggccagggtcggacccctgcgcgtattctctgcctcatcgtcggggaacncggccaccctgaccatcaagacaaacgcccgaagccggtgatgaggctgtacttatttttgcgtaggtggtagggacagcagctatttagtgtacgttcggaccgtagggacctaaggtccaccgtcctaggtcacgcccgaacggccccaacccctntcgtccaccttctaccgttaccccaccctccgtcgaaccg

SEQ ID NO: 124747 - DNA, 534 bp, Homo sapiens
  misc_feature: GYAE6OF01D0QR0.8.23.C01.1.454.CMB.1.raw
  modified_base (197)..(197): a, c, t, g, unknown or other
  misc_feature (197)..(197): n is a, c, g, or t
  modified_base (356)..(356): a, c, t, g, unknown or other
  misc_feature (356)..(356): n is a, c, g, or t
  modified_base (496)..(496): a, c, t, g, unknown or other
  misc_feature (496)..(496): n is a, c, g, or t
  modified_base (520)..(520): a, c, t, g, unknown or other
  misc_feature (520)..(520): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccggganagacggccaggattacctgtgggggttcaatattggaggtaacaatgtgcactggtaccagcagaaggcagggcaggcccctgtactggtcatctagtgggggatccatccggccaggtcgggacccctgcgcgattctctgcctcatctcggggaacncggccaccctgaccatcagcaaacgcccaagccgtgatgaggctgacttattttgctaggtgtgggacagcagcagtttatgtctcggacctgggacccaaggtcaccgtcctaggtcacgacccaacggcccaaccccnctacgtcaccttctacgttccccncctccctcgacccg

SEQ ID NO: 124748 - DNA, 709 bp, Homo sapiens
  misc_feature: GYAE6OF01ANI6E.8.23.C01.1.454.CMB.1.raw
  modified_base (204)..(204): a, c, t, g, unknown or other
  misc_feature (204)..(204): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
tcagctcgcgtgtccacgaccggtgctcgatttagtacacgtgatttagggtagttgggctgggcctcaggaagcagcatcgggggtacgccgcagccatggcctggaccgctctccgttctgagcctccttgctcactttacaggttctgtggcctcctatgagcctgacctcagccactctcgagtgtcagtggccccgganaggacggccaggacttaccgtgtgggggttcaagtagttggaggtaacaatgtgcacgtggtaccagcagnggaaaaaaaaaaaacgnggacgacggcccgtgtacgtcggtcgactcgtagtagggacgtccgagtccggccgacggtcgggaccccgtcggccgaccgtacgttcgtcgtcgtccgtccgacgtcgtaccgggaccgccggcccgacccgtacgaccacgtacctacgaccgaacgacccgaacgacccggtacgacgtacggacggacgtacgtacgttacgtttttacgttacgtagggttaggtacgggtacgacggtacgacgtacgtacgtttacgttacggttaccgttaccgggtaccgttacgggtaaccgtaacggttaccgtaccggtaccgtacggtaccgaccgacccgtaaccggacccgaacccgtaccgtaccgtaccgaccgtccgtccgttacccctaccctcccgtccgtacccg

SEQ ID NO: 124749 - DNA, 651 bp, Homo sapiens
  misc_feature: GYAE6OF01EQ1GF.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattaccgtggtgggggttcaatagttggaggtaacaatggtgcactggtaccagcagaaggcagggcaggcccctagtacgtggtcatcgtagtgggggactccgagtccggccgacgggtcgggacccctggcgcgtacttcgtctcgcctccacgtcgtcggggaacgccggacccacccgtgaccactcaacgaccaaacggcccaacgggtcccggtagacgtggacggtctacggtactttagtttttcggacgtagggttcggtacgggacgaggctagactaagtttcgtgttccgttacgggtaccgtagggacccgtaacgggtccgtacccgttccgtacggtccgaacggaccccgtaacggaccccaaccccgtcgtaccgtaccgacccgttccgttaccgttcccccacccttcccgaccgtaacccg

SEQ ID NO: 124750 - DNA, 215 bp, Homo sapiens
  misc_feature: GYAE6OF01ESPMG.8.23.C01.1.454.CMB.1.raw
  modified_base (210)..(215): a, c, t, g, unknown or other
  misc_feature (210)..(215): n is a, c, g, or t
tcagctcgcgtgtccacgaccggtgctcgatttagtacacgtgattagggattgggctgactatttttgtcaggtgtgggacagcagcatttatgtcttcggacctgggaccaaggtcaccgtcctaggtcagcccaaggccaaccccactgtcactctgttcccgccctcctcgacacgtgagctgagcgggctggcaaggcgcatagnnnnnn

SEQ ID NO: 124751 - DNA, 725 bp, Homo sapiens
  misc_feature: GYAE6OF01BW24S.8.23.C01.1.454.CMB.1.raw
  modified_base (202)..(202): a, c, t, g, unknown or other
  misc_feature (202)..(202): n is a, c, g, or t
tcagctcgcgtgtccacgaccggtgctcgatttagtacacgtgattagggattgggggcgtgggcctcaggaagcagcatcgggggtgccgcagccatggcctggaccgctctccttctgagcctccttgctcactttacaggttctgtggccttcctatgagctgactcagccactctcagtgtcaggtcggccccggganaggacggccaggattaccgtggtgggggttcaatagttggaggtaacaatgtgcacgtggtaccagcaagaaggcagggcacggcccctgtacgtggtcatctaggtcggggactccgagtccggccgagggtcggaccctgcgtcgtacttcgctcgcctccgagtccgtaccggggaacgccggaccctacccgtgacccagtccgacgaccgaaacgccccgaacgcccgggtagacgtcggacggtactacgtaactttagtttttcggtacgtagggtttcggtacgggaccgaggtacgtacgtacttaagttttacgttacggttaccgtttaccggggacccgttacggggaaacccgtaacgggttaccctaacccggttcccggtaaacggtcccgaacccggtaccccgaaacccgggtaccccctaaacccccgtacggttaccgtacccttaacccgttcccgttacccgttaccccccggtaccccttaccccgtcccggaaaccccgg

SEQ ID NO: 124752 - DNA, 556 bp, Homo sapiens
  misc_feature: GYAE6OF01ATQCV.8.23.C01.1.454.CMB.1.raw
  modified_base (515)..(515): a, c, t, g, unknown or other
  misc_feature (515)..(515): n is a, c, g, or t
  modified_base (540)..(540): a, c, t, g, unknown or other
  misc_feature (540)..(540): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattacctggtgggggttcaatattggaggtaacaatgtgcactggtaccagcagaaggcagggcaggccctgtactggtcatctagtggggatccatccggccagggtcgggacccctggcgcgattctctcgcctccatcgtcggggaacgcggccaccctgaccatcagacaaacgcccaaggccggtagagtggaggctagtacttagttttgctagggtgtgggacagcagctatttatgttcgttcggacctgggaccaaggtccaccgtcgtaggtccacgacccgaacggcccaacccnctcgtaccaccttctccgtaccccncccttccgcgaacccg

SEQ ID NO: 124753 - DNA, 559 bp, Homo sapiens
  misc_feature: GYAE6OF01DPIWX.8.23.C01.1.454.CMB.1.raw
  modified_base (359)..(359): a, c, t, g, unknown or other
  misc_feature (359)..(359): n is a, c, g, or t
  modified_base (520)..(520): a, c, t, g, unknown or other
  misc_feature (520)..(520): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtgggggttcaatattggaggtaacaatgtgcactggtaccagcagaaggcagggcaggccctgtactggtcatctagtgggggatccgagtccggcagggtcgggacccctgcgcgattctctgcctcatcgtcggggaacncggccacctgaccactcacgacaaacgcccgaaagccggtgaactgaggctgaactttattttcggcgtagggtggtcgggacaggcagctatttactggttcttcggacctagggacctaaggtcaccggtctaggccacgcccgaaggaccccaacccnctcgtccacctcctacgttccccaccctccgtcgacccg

SEQ ID NO: 124754 - DNA, 549 bp, Homo sapiens
  misc_feature: GYAE6OF01B3KZY.8.23.C01.1.454.CMB.1.raw
  modified_base (447)..(447): a, c, t, g, unknown or other
  misc_feature (447)..(447): n is a, c, g, or t
  modified_base (510)..(510): a, c, t, g, unknown or other
  misc_feature (510)..(510): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctagtgggggatccatccggccaggtcgggacccctgcgcgattctctgcctccatcgtcgggaacgcggccaccctgaccatcacgacaaacgcccaagccggtagactggaggctgacttagttttgcgtagggtgtgggacagcagctatttntgtcgttcggaccgtgggaccaggtccaccgtccgtaggcacggcccgaacggcccaaccccnctcgtcaccttcctccttaccccaccctcccgccgaccg

SEQ ID NO: 124755 - DNA, 725 bp, Homo sapiens
  misc_feature: GYAE6OF01CRP84.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccgggacagacggccaggacttaccgtggtggggggttcaatagttggaggtaacaatgtgcactggtaccagacagaaggcgagggcacggccctgtacgtggtccagtcgtagtgggggactccgagtcccggaccgagggtcgggacccctggccgcggtacttctcgtcgccctccgacgttcggtaccgggggaaccgccgggaccccacccgtacgaccctaactaccgaacgaccgtaaacgccccgaacgggcccgggtagacgtacggacgggccttaggtactttagttttggtacggtagggttggtcggggaactaggtacgagtacttagttttaagttcggttccgttccggggtaaccgtacgggtaacctaaccggggttcctaacccgggttaccgtaacgggtccgaacccgtaccccggaaaccggaccccctaaaccccgaccgttaccgtaccctacccgtttccctaccccggtttacccccaacccccgttcccgtacccgtaaccccgg

SEQ ID NO: 124756 - DNA, 533 bp, Homo sapiens
  misc_feature: GYAE6OF01BN453.8.23.C01.1.454.CMB.1.raw
  modified_base (499)..(499): a, c, t, g, unknown or other
  misc_feature (499)..(499): n is a, c, g, or t
  modified_base (520)..(520): a, c, t, g, unknown or other
  misc_feature (520)..(520): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccatccggccagggtcggacccctgcgcgattctctgcctcatcgtcggggacgcggccaccctgaccatcagcaaacgcccaagccggtgatgagctgacttattttgcgtaggtgtggacagcagctatttgtcgttcgtcggtaccgtgggacctaggtccaccgtctacggtcacgacccgacgacccacccnctcgcacgtctccgtaccccnccctcctcgaccg

SEQ ID NO: 124757 - DNA, 644 bp, Homo sapiens
  misc_feature: GYAE6OF01C8UK0.8.23.C01.1.454.CMB.1.raw
  modified_base (379)..(379): a, c, t, g, unknown or other
  misc_feature (379)..(379): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccgggacagacggccaggattaccgtggtgggggttcaatagtggaggtaacaatgtgcacgtggtaccagcaggaaggcagggccacggcccctgtactggtcatcgtagtggggactccgacgtcccggccgagggtccggacccctgacgcgacttctctcgcctccagtcgtacggggaaccnccggcccacctcgaccatccagaccaacgcccgaacgtccggtagagttcggacggtctagtactttagttttcgacgtagggttgggtagggactaggcaggtacttagtttagttcgttacgttccgggtaccgttacgggaacccgttaacggtcctaacccggtccgtacggtccgaaccgacccgaaccgggaccccctaacccctacgtccgtaccaccttaccgttccgttccccccgtcccctccgtaccgtacccg

SEQ ID NO: 124758 - DNA, 586 bp, Homo sapiens
  misc_feature: GYAE6OF01C4193.8.23.C01.1.454.CMB.1.raw
  modified_base (197)..(197): a, c, t, g, unknown or other
  misc_feature (197)..(197): n is a, c, g, or t
  modified_base (349)..(349): a, c, t, g, unknown or other
  misc_feature (349)..(349): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccggganagacggccaggattaccgtggtggggggttcaatagttggaggtaacaatgtgcactggtaccagcagaaggcagggcaggcccctgtactggtcatcgtagtgggggactccagtccggccgagggtcgggacccctgcgcgattctctcnctccatcgcgggacgcggccaccctgaccatcacgacaaacgcccgaagccggtgatggaggctgtacgtttattttgcgtagggtggtcgggacagtcgagtacttagtttatcggttcgttccgggtaccgtacgggaacctaacggtcctaccggtccgtacggtccgacgcccgaacggccccaacccgactcgtcctacttccctaccgttccccaccctccgtccgacccg

SEQ ID NO: 124759 - DNA, 213 bp, Homo sapiens
  misc_feature: GYAE6OF01A6IZ0.8.23.C01.1.454.CMB.1.raw
  modified_base (209)..(213): a, c, t, g, unknown or other
  misc_feature (209)..(213): n is a, c, g, or t
tcagctcgcgtgtccacgaccggtgctcgatttagtacacgtgattagggattgggctgactatttttgtcaggtgtgggacagcagcatttatgtcttcggacctgggaccaaggtcaccgtcctaggtcagcccaaggccaacccactgtcactctgttcccaccctcctcgacacgcgagctgagcgggctggcaaggcgcatagnnnnn

SEQ ID NO: 124760 - DNA, 560 bp, Homo sapiens
  misc_feature: GYAE6OF01AKCY8.8.23.C01.1.454.CMB.1.raw
  modified_base (428)..(428): a, c, t, g, unknown or other
  misc_feature (428)..(428): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaaccggccctcgtgggactcccgtgagcgtattctctcggctaccgaagtcggggaaccacggacccaccctcgaccatccagacacgggccccaaccgttggatggaggtagacttatttcngtacaagtgtggacacactactgtcgtcgttcggacgtcgggaccgaggtccgaccgtcctaagtcacgcccgacgggacccaccccgactcgtctacctcgttccgttaccccgccctcctccgctaccgg

SEQ ID NO: 124761 - DNA, 769 bp, Homo sapiens
  misc_feature: GYAE6OF01B25LX.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagcccactctcagtgtcagtcggccccgggacagacggccaggattaccgtggtgggggttcaatattggaggtaacatgtgcacgtggtaccagcagaaggcagggcacggcccctgtactggtcagtctagtgggggatccgagtcccggccgagggtccgggacccctggccgtcgatttctcctcggccctccacgtccgtaccggggaaccgcccggacccacccgtacgaccacgtcaacgaccaaacggaccccgaacggcccggtagacgtagggacggtacgtagtaacgttttagtttttcggtaccgtaggggttcggtacggggtaacacggacgtacggtacttagttttacgttacgggtttacccgtttcccgggtaacccggttacggggtaacccgtaacggggttacccgtaccccggttacccggtaacgggttaccccgaaccgggtaccccccgtaaaacccgggaccccccaaaaccccccggttccgttacccgttaaccccgtacccgtttccccggtttacccccggtttacccccccggtaccccccgtttccccgttaccccgggaacccccggg

SEQ ID NO: 124762 - DNA, 547 bp, Homo sapiens
  misc_feature: GYAE6OF01C00LC.8.23.C01.1.454.CMB.1.raw
  modified_base (429)..(429): a, c, t, g, unknown or other
  misc_feature (429)..(429): n is a, c, g, or t
  modified_base (532)..(532): a, c, t, g, unknown or other
  misc_feature (532)..(532): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtgcccgggacagacggccaggattacctgtgggggttcaatattggaggtaacaatgtgcactggtaccagcagaaggcagggcaggcccctgtactggtcatcgtatgggggatccgatccggccaggtcgggacccctgcgcgattctctcgcctccatctcggggaacgcggccaccctcgaccatcagacaacgcccaagccggtgatgaggctgacttattttgcgaggtgtcgggacngcacgctatttatcgttcttcggaccgtgggacctaaggtcacccgttccgtagtccacgcccgaacggcccaaccccactcgtaccacttcctacgttcccnccctcctcgaacccg

SEQ ID NO: 124763 - DNA, 684 bp, Homo sapiens
  misc_feature: GYAE6OF01CNH3U.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccggacagacggccaggattacctggtgggggttcaatattggaggtaacaatgtgcactggtaccagcaggaaggcgagggcaggcccctgtactggtcatcgtagtgggggatccgatccggccgagggtcgggacccctgcgcgactctctcgcctcatcgcgggacgccgccacctgaccatcagaccaacgcccgaaggccggtgacgtaggacggtctacgtactttagttttacggtaccgtagggttggtacgggactacggacgacgtacgttaagtttttacgtcggtttcccgttaaccgggtaccggttacggggtaacccgtaacggggttaccccgtaacccgggttccgttaacggtacccgaaccgggtacccccggaaaccggtaccccccaaaacccccgtccgttaaccgtacccttacccgtccctttacccggttcccccgtacccccgttccccgtacccggtaaccccgg

SEQ ID NO: 124764 - DNA, 644 bp, Homo sapiens
  misc_feature: GYAE6OF01DVEZ8.8.23.C01.1.454.CMB.1.raw
  modified_base (463)..(463): a, c, t, g, unknown or other
  misc_feature (463)..(463): n is a, c, g, or t
  modified_base (583)..(583): a, c, t, g, unknown or other
  misc_feature (583)..(583): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattaccgtggtgggggttcaatattggaggtaacaatgtgcactggtaccagcaaggaaggcgagggcacggccccgtgtacgtggtcatctagtgggggtactccgacgtccggccgagggtcggacccctgcgcgacttctctgcctcagtcgtcgggaacgccgccacctcgaccatcagaccaaacgcccgaaggccggtgaagtggacggtctagtaactttagttttcggtcgtagggtgtcgggacnggcagtcttatttacgttcggtccgtttaccgggaccgttacggggaaccctaacgggttccgtaacccggttacccgtacgggttccgacggaccccgaaacccggccctaaacccccncgttccgtacccaccgttcccttacccgttacccccaccccgttcccgtcccggtaacccg

SEQ ID NO: 124765 - DNA, 719 bp, Homo sapiens
  misc_feature: GYAE6OF01AZCJC.8.23.C01.1.454.CMB.1.raw
  modified_base (695)..(695): a, c, t, g, unknown or other
  misc_feature (695)..(695): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattaccgtggtgggggttcaagtagttggaggtaacaatgtgcactggtaccagcaagaaggcgagggcacggccctgtactggtcatcgtagtgggggactccgagtcccggccgacgggtccgggaccccgtggccgcgtacttcgtctcgccctcacgtcgaccgggaacgccggcccacccgtcgacccagtaccgacgaccgaaacgcccgaacggtaccggtagacgtacggacggtcgttacgtaacgtttagtttttacggacgtaagggttcggtacgggaactacggacgtacggtacttaagtttaacgtcggttaccgttaccggggtaaccggttacggggtaaccgtaaccgggttacccgtaacccgggttaccgttaccgggtaaccgtaaccggaaccccggtaaccggaccccctaaaccccgtaccgttaccggtacccttaccgttcccgttacccggttcccccnccccgttcccgcccggtaaccccg

SEQ ID NO: 124766 - DNA, 737 bp, Homo sapiens
  misc_feature: GYAE6OF01EWYA4.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccgggacaggacggccaggattaccgtggtggggggttacaagttagttggaaggtaacaagttgtgctaacgtggtaccagcaaggaaggcgagggcacggccctgtacgtggtcagtctaggtggggactccgacgtcccggacgacgggtcggaccccgtggcgtcgtactttccgtctcgtccctccacgtcccggtaccggggaaccgcccggtaccccgaccctacggtaacccacgtaccgacggaaccgaaaccggaccccgaacgggcccgggttaggacgtcgggacggtacgttagtaacgttttacgtttttcggtacggtagggtcgggtagggacgtaagcgtaacgtcgttaagtttagttccggtaccgttcgggtaaccggtacgggtaaccgtaacgggtacccgtacccggtaccgtaccgggtaccaaccgaccccgaaccggtacccccaaaccccgtcgtacccggtacctaacccgtcccgttacccgttaccccctcccccgttaccgcccggtaacccgg

SEQ ID NO: 124767 - DNA, 564 bp, Homo sapiens
  misc_feature: GYAE6OF01DRIBW.8.23.C01.1.454.CMB.1.raw
  modified_base (433)..(433): a, c, t, g, unknown or other
  misc_feature (433)..(433): n is a, c, g, or t
  modified_base (514)..(514): a, c, t, g, unknown or other
  misc_feature (514)..(514): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccagtccggccaggtcggacccctgcgcgattctctcgcctccatcgtcggggaacgccggaccacccgtgaccatcagcaaacgcccaagccggtagagtgaggctgacttattttgcgaggtgtggacngcagctatttatcgtcgttcggaccgtgggacctaaggtccaccgtcctaggtacacgacccgtaacggccccaaccccgngtccgtaccaccgttccttccgttacccccgccccttcccgtcgaacccg

SEQ ID NO: 124768 - DNA, 708 bp, Homo sapiens
  misc_feature: GYAE6OF01BE234.8.23.C01.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccggganagacggccaggattacctggtgggggttcaatattggaggtaacaatgtgcatggtaccagcagaaggcgagggcacggcccgtgtactggtcagtctaggtgggggactccgagtccgggccgagggtcgggacccctggcgcgtattcctctcgccctcacgtccggtcggggaacgccggcccacccgtgaacccatccgaacgaccgaacgacccgaacggcccggtagacgtaggacggtactagttaactttagtttttcggcgtagggttggtacgggactacggacgacggtaccttatttacggttcgtttaccggtttacccgggtaccggttaccggggtaaccctaacgggttcccgtaacccggttcccggtacggtaccgaacccggtacccccgtaaaccgggaccccctaaacccccgtcgtacccgttaccctacccgttacccggtttccccggttaccccccgtccccctttcccgtacccggaacccggg

SEQ ID NO: 124769 - DNA, 852 bp, Homo sapiens
  misc_feature: GYAE6OF01B0Y35.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctctatgagctgactcagccactctcagtgtcagtcggcccggacagacggccaggattaccgtggtgggggtacaagtagttggaggtaacaatgtgcacgtggtaccagcgagaaggcgagggccacggccctggtactggtacagttcgtaggtcgggggtaactcccgacgtcccgggaccgtacggggtccgggaccccgttggccggtcgtactttccgtcgtccggtccctaccgtacgttcccgggtaccgggggaaccgccccgggaccctaacccgtacggaacccctagtacccgaacggacccgaaaaccggaccccgaaacgggtcccgggttagaacggttcgggaaccggttcttaacggttaacgttttaacgtttttacggtaccgggtagggtttagggtacggggtaactacggtacggtaacgtacgtttaacgttttacgtacggtttacccgggttaacccgggtaacccggtaacccggggtaacccgtaaaccggggttacccctaaccccgggtttaccggttaacgggtaccccgtaaccggaacccccggtaaaacccgggtaccccccgtaaaccccccgttacggttacccggttaccccttaaccccgttccccgtttaccccgtttaaccccccccgaaccccgttccccgttaacccggaaacccccggg

SEQ ID NO: 124770 - DNA, 894 bp, Homo sapiens
  misc_feature: GYAE6OF01EJA5W.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctctatgagctgactcacgccactctcgagtgtacgaggtccgggaccccgggacacggaccgggccgaaggtactttaaccggttggggttcggggggttactaaagttaggttagggtaacggtaaacgaagttggtacgacgtacgtacggtaaccaggacgaaacggaacggacgacggggaccgacggtccccgtaggtacgttcgggtactacgttacgtacgggtaggggtaccttacccgaacggttccccggacggtacgggttacccgggtaccccgtggacccggcgttaactttccgtcgtccgtaccctaccgaacggttcccggggtaccgggaaccggcccgtacccgacccgtacgaccgacgtacgaacgaaccgaaaccggacctaacgggtcccggtaagtcggtacggtaacgggtcttaccgggttaactttttcggttttggaaccgggttagggtcggtacggaaccgtacggcgtaacgtgtttaaagttttccgtacggttaccccgttaccggggaaacccggtttacgggaaacccgttaacccggtacccggttaacccggttacggttaaccgggtaacccgacccgggtttaaacccccgggaaacccgacccccgtaaacccccgttacgtaccccgggttacccttaacccggttacccctttcccccgggttaacccccctaccggttccccgtaaaccggaacccccggg

SEQ ID NO: 124771 - DNA, 809 bp, Homo sapiens
  misc_feature: GYAE6OF01ES1AB.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtgggggttacaatatggaggtaacaatgtgcactggtaccagcagaagcagggcacggccctgtactggtcatcgtagtgggggtactccgagtcccgggaccgagggtccgggacccccgtggccgcggtactttcctcgtcgcccgtaccactaccgtaccggggaaccgcccgggaccccacccgtacgaacccgataccaacgaaccaaaccggaccccgaaacggtcccgggtagaacgtacggaacgggtcccttaaggtaaccttttagttttttacggtaccgggtaagggttacgggttaggggaacctacggtacgaacgggttaccttaacgtttttaagttccgggtttacccggtttaccgggggtaaacccggttaaccgggggtaaaccccgttaaccggggttaccccgtaaccccgggtttacccgttaaaccgggttacccggaaacccgggtaccccgaaaacccgggtaacccccgttaaaaccccccgcttacccggttaaccccctaaccgtttcccggttccccgtttaccccccgccccccggtttccccaacccgggttaaacccgg

SEQ ID NO: 124772 - DNA, 653 bp, Homo sapiens
  misc_feature: GYAE6OF01A0N9F.8.23.C01.1.454.CMB.1.raw
  modified_base (633)..(633): a, c, t, g, unknown or other
  misc_feature (633)..(633): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattaccgtggtgggggttcaatagttggaggtaacaatgtgcactggacagcagaggcgaggcacggccctgtactggtcagtctagtggggactccgacgtccggccgtagggtccggacccctggcgcgtacttctctcgccctccacgtccgtacggggaacgcccggacccacccgtcgaccactcgaaccgacaaaccgacccgaacggccgggtagacgttggacggtacttacggtaactttaggtttttcgtaccgggtagggttcgggtacgggaacacggtactcgtacttatttacgttcggttaccgtttccgggaaccgttcgggaacccgtaaggtccctaccggttccgtaggttaccgacgacccgaaccggaccccaaccctcgtctcccacgtccttccgtccccncccttcccgtccgtaacccg

SEQ ID NO: 124773 - DNA, 887 bp, Homo sapiens
  misc_feature: GYAE6OF01BYO5F.8.23.C01.1.454.CMB.1.raw
  modified_base (443)..(443): a, c, t, g, unknown or other
  misc_feature (443)..(443): n is a, c, g, or t
tcagctcgcgtgtccacgaccggtgctcgatttagtacacgtgattagggattggggctgggcctcaggaagcagcagtcgggggtgccgcagccatggcctggaccgctctccttctgacgcctccttgctctactttacaggttctgtgcctctagtgagtctgactcacgcctactctcgtagtcgtacgaggtccgggaccccgggacacgggaccggccgtaagggtacctttaaccggtggggttacggggggttacaagtttaggttacgggtaacggtaaactaagttggtacgtacgtacgtacggtaaccaggaccaagggaaacggcggaagggaccgaaccggtccccgtaggttacgtcggtactacgttacggtacgggtacggggtacctaccgacggtccgggtccgtaacggggtccggtacccgnggccgtacgtacttcctacgcgtcctacgtaggtccgggacgggaacccgcggtacccctacccgtacgacctacgtaccgtaacgacgtaacccggtaccggaacggtaccgggtgttaacgggcggttaacgggtacttacggttaacgttttacgtttcgggtacgggtacggttacgggttacggaccggtagtacccgtagttaccgtttacgtttacggttccggtttaccggttaccccgggtaaggttaacccgggggttactaaaccggggttcccttaaacccgggttcccggtaaacgggttcccgaaccccgggtaacccggtaaaccccggtacccccggttaaacccgtccccggttagtaccccgtacccgtttaccccgttacccgttaaaccccccgtcccgttcccggtacccggtaaaccccggg

SEQ ID NO: 124774 - DNA, 703 bp, Homo sapiens
  misc_feature: GYAE6OF01E5QQQ.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccggggacaggacggccaggacttaccgtggtggggggttcaatagttggaggtaacaatgtgcactggtaccagcagaaggcagggcacggccctgtactggtcatcgtaggtggggactccgagtcccgggccgacgggtcgggacccctgccggcgtactttcctcgtccgccctccgacgttccggtaccgggggaaccgccggaccctacccgtcgacccgactaccgaacgaccgaaacgaccccgaacggccgggtagacgtacggacggcgttacgtacgtttagtttttcggacgttagggtcggtagggacctacggtacacgtacttacgttttacgtcggttaccgttaccgggaaccgttacgggaaccctaacgggtacccgttaccggtacgtaccggtaccgaccggtaccccgaaccggaccccaacccctaccgttaccgtcctaccgttcccgttcccggttcccccgcccccgttccgtccggtaacccgg

SEQ ID NO: 124775 - DNA, 711 bp, Homo sapiens
  misc_feature: GYAE6OF01EBMUE.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattacctggtgggggttcaagtattggaggtaacaatgtgcacgtggtaccagcaaggaacggcgagggccaggccctgtactggtcatctagtgggggatccagtcccggccgagggcggaccctgccgcgtattctctcgacctccagtcgtacggggaacgccggcccacctgaccatacgacgaccaaacgccccgaaggtcccggtagaagtcggacgggacttcgttaactttaggttttttcggccgttaaggggttcggtacggggtacacgggtactaacgttcgttaagttttacgttacggttcccgttaccggggtacccggttacggggtaaccttaaacgggttcccgtaaccccggttaccgttaacggaccgtaaccggtaccccgtaaaccgggtacccccaaaccccggtacttacccggtaaccctacccttcccggttacccggtttccccccgtaccccgttcccgtccccggtaaacccg

SEQ ID NO: 124776 - DNA, 690 bp, Homo sapiens
  misc_feature: GYAE6OF01EITPG.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccgggacacggacggccgaggtacttaccgtggttggggggttactaagttagttgggaaggtaaacaatggtgctacgtcggtaccagcgaaggaacggcgagggcacggcccgtgtacgtggtcatcgtaggtggggtactccgacgtccggccgtacgggtcggacccctggccgcgtacttcctccgtcgtccctccgacgtccggtaccggggaacgcccggaccctacccgtacgaccctacgtaccgaacgaccgaaccgacccgaagggcccggtagacgtacggacggtctagttacgtttagttttcgtcgtagggttggacggacagcagtcgttatttcgtcgttaccgttcggaccgtacgggaacctacggtaccaccggttacgtacggtccaaccggtacccgaaccgtacccctaacccgtcgtaccgtacccgtaccgttccgtttaccccggtcccccgtccctcccggcgtaacccgg

SEQ ID NO: 124777 - DNA, 812 bp, Homo sapiens
  misc_feature: GYAE6OF01C380J.8.23.C01.1.454.CMB.1.raw
  modified_base (201)..(201): a, c, t, g, unknown or other
  misc_feature (201)..(201): n is a, c, g, or t
  modified_base (566)..(566): a, c, t, g, unknown or other
  misc_feature (566)..(566): n is a, c, g, or t
tcagctcgcgtgtccacgaccggtgctcgatttagtacacgtgattagggattggggctgggcctcaggaagcagcagtcgggggtgccgcagccatggcctggaccgctctccttctgagcctccttgctcactttacaggttctgtcggcctcctatgagctgactcagccactctcagtgtcaggtcggccccggganacggacggccaggattaccgtggtgggggttacaagtgttaggaggtaacaatgtgcacgtggtaccagcaaggaaggcgagggccacggccctgtacgtggtacctatacgtaggtgggggactccgacggtccgggccgaagggttccggggaacccctggcggaccgtacttcgtcgtcggtaccctccgacgtccggtacgggggaaccgcccggaccccgacccgtacggaccctaacgtaccgaagaacccaaaccggtacccggaaacggccgggtaagtaaggttcggaacggggtacccttaggttaaacctttttaggtttttcggaccgggttaaggggttgggttaaccgggntaaccgggtacaaggttaccttaaggtttttaaccgttacggtttcccggttaaccgggtaccccggttacggggtaaaccccgttacggggttaccccgaaacccggtttacccggtaaccgggtacccgaaccgggaccccccgaaaaccgggtacccccgttaaaccccccgagtttacccggacccttaccgtttacccttacccccggttccccaacccccgttccggtacccgaacccgg

SEQ ID NO: 124778 - DNA, 696 bp, Homo sapiens
  misc_feature: GYAE6OF01D8QG8.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattacctggtgggggttcaatattggagtaacaatgtgcactggtaccagcagaaggcgaggcacggcccctgtactggtcatctaggtggggatccgagtccggcgagggtcgggacccctgcgcgtattcctctcgccctccacgtcgtacggggaaccgccggacccaccctcgaccatccgagaccgaaaccgcccgaacggccggtagagtcggacggtcttagtaactttagtttttacgtacgtagggttacggttacggggactacggacctaaggtaccttaagttttacgttcggtttaccgtttaccggggtaaccgttacggggaacccgtaacgggttccgtaaccccggttccgtaaccggtaccgaaccggaccccgtaaaccgggacccccaaacccccgtacgttacccgtacctaacccgttcccgttacccggttccccccgtcccccgttcccgtccggaaccccgg

SEQ ID NO: 124779 - DNA, 706 bp, Homo sapiens
  misc_feature: GYAE6OF01CZCO4.8.23.C01.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccggganagacggccaggtattaccgtgggtgggggttcaagtagttgggaaggtaacaagtgtgcacgtggtaccagacaaggaaggcgagggcacggcccctagtactggtcagtcgtaggtggggactccgacgtccggacggtacggccggaccgtcgcgctacttcgtctccgtcctcgacgtccggacgggaccgccgacccgtacctacgacactacgacgacgaaccgaccgaacggcgtagtagtacggacgtcgtagttactttgtttcgtcgtagggtgtacggacgacgacacgtactttagtttacgtcgttaccggtaccggtaccggtacgggaacccgtaaccggttaccggtacccgttaccggtaccggtacccgaccggtacccgaaacccggtaccccctaaacccggtccgttaccgttaacccttaccccgtttcccccggttacccggttacccccccgtacccccgttccccggtacccggtaaccccgg

SEQ ID NO: 124780 - DNA, 935 bp, Homo sapiens
  misc_feature: GYAE6OF01BI28N.8.23.C01.1.454.CMB.1.raw
  modified_base (207)..(207): a, c, t, g, unknown or other
  misc_feature (207)..(207): n is a, c, g, or t
  modified_base (435)..(435): a, c, t, g, unknown or other
  misc_feature (435)..(435): n is a, c, g, or t
tcagctcgcgtgtccacgaccggtgctcgatttagtacacgtgattagggattgggggctgggcctcaggaagcagcatcgggggtgccgcagccatggcctggaccgctctccttctgacgcctccttgctcactttacaggttctgtcggcctcctatgagctgacctcagccactcctcagtgtcgaggtccgggaccccgganacggaccggccaggtacttaccgtgggttcgggggttactaagtaggttagggaacggtaacaagttggtacgaccgtacgtacggtaaccaggtaccgaaagggaacggcggtaacggggccgtaccgggtcccctaggtacgtcggtactacgtcgtagggtcggggtactcccggacgtcccgggaccgtaggggtcccggtaccctggaccgtcgtacgttccnccgttccggtccctaccggtacggttacccggggtaccgggggtaaccgacccccggtaccctaacccgtccgtaaccccgtacgacccgaacggaacccgaaacccgggtacccggtaaccgggtccgggttacggacgggtaccggaaccggttcgttaaacggttaccgttttaagttttcgggaccggtttaggggtaccgggtacgggactacggtacgtaacgttacgtttaacggttttacgttaccggggttacccggtttaacccggggtaaccggttacccggggtaaaccccgttaaccgggttaccccggtaacccgggtttaacccggtaaccgggttaccccggtaaaccccgggtaaccccgaaaccccgggtaaccccccgttaaaaccccggtcccgtaacccgggttcccctaacccggtttcccgtttaacccccggtccccccccgtttacccctaacccggtccccgggtaaaccccgg

SEQ ID NO: 124781 - DNA, 789 bp, Homo sapiens
  misc_feature: GYAE6OF01AYJFW.8.23.C01.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtacacgtgattagggattggggctgggcctcaggaagcagcagtcgggggtgccgcagccatggcctggaccgctctccttctgagcctcttgctctactttacaggttctgtgcctctatgagctgactcagcctactctcagtgtcaggtccggccccgganacggaccggccaggtactttaccgtggggttcgggggttactaagttaggttagggtaacggtaacaagtgtacgacctacgtacggtaccaggacgaaggaacggcgacgggcgaccggtcccttaggtaccgttagggtcctacgttacggttacgggtacgggggtacctacccgacggtccccgggaccggtacggggtcccggaccccgtgggacccggtcgttacgtttccgtcctccggtaccctccgtacggttccgggaccggggaaccggccccggtacccgtaccctacgaacctactaccggaacgtaacccaaaccgggaccccgaacgggtacccggtagtacgtacgggaccggttcttaacgtttacgtttagttttccgggacggttagggggtttcgaacgggactacggtaccgtagttaacctttaggttttaaccgttcggttacccggttaccggggtacggtacgggtaacctacggtccctaccggtacgtacgtaccgacgaacccgacgacccctacccgtgtccgtctaccgttcctaccccgtccgccctccgcgtaacccg

SEQ ID NO: 124782 - DNA, 695 bp, Homo sapiens
  misc_feature: GYAE6OF01D9PF6.8.23.C01.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccggganagacggccaggattacctggtgggggttcaattagttggaaggtaacaatggtgcacgtggtacagacaggaaggcgagggcgacggccctgtacgtggtcactcgtaggtcgggggactccgacgtcgggcccccccgagggtccgggaccccgtggcgacgtacttcctctcgccctaccgacgtccggtaccggggaaccggtccggacccctacccgtacgacccacgtaccgacgaaccgaaaccgacccgaacggacccggtagacgtaggacggtacgtaggtaacgtttagttttacggtcgtagggtcggtagggacaggctagtcgttatttagtacgttaccggtttacgggtaccggttacgggtaaccgtaacgggtaccgtaccggttaccggtacggtaccgaccgacccgaacccggaccccaacccgctcgtaccgtaccgttccgttaccttacccctccttcccgttccgtaacccg

SEQ ID NO: 124783 - DNA, 794 bp, Homo sapiens
  misc_feature: GYAE6OF01EZHSR.8.23.C01.1.454.CMB.1.raw
  modified_base (197)..(197): a, c, t, g, unknown or other
  misc_feature (197)..(197): n is a, c, g, or t
  modified_base (333)..(333): a, c, t, g, unknown or other
  misc_feature (333)..(333): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtgcctctatgagctgactcacgccactctcagtgtcaggtcggccccgganaggaccggaccaggtacttaccgttgggttcgggggttacaagttagttagggaagtaaacagtggtcgacacgtggtacccagtcgaaggaaggcgacgggcaccggtcccgtgtaccgtggtacagtcgtaggnggggtactccgacgtcccggcgtacgggtccgggaccctggccgacgttacttcctaccgcgtccctacgacgtccggggtaccgggaccgccgtaccccgaccgtcaaccgtacgtacgaacgtaaccaaaccggtcccgaacggcccggtaggtacgtacggcggttactacgtttaactttggttttaaccggcggttacgggtcgggtaccgggtacgacggtaccgaaggttacgtttaactttacgttacccgggttacccggttacccggggtacggttaacccgggtaaaccggttaaccgggttacccgtacccgttaacgggttaccggtaacccgaacccgggaccccgtaaaccccgtaccccgaacccgttaaccggtacccgttaccccgttacgttccccggttccccccgttaccccgtcccgttccccgtaccggaaccccggg

SEQ ID NO: 124784 - DNA, 868 bp, Homo sapiens
  misc_feature: GYAE6OF01ERNPK.8.23.C01.1.454.CMB.1.raw
  modified_base (163)..(163): a, c, t, g, unknown or other
  misc_feature (163)..(163): n is a, c, g, or t
tcagctcgcgtgtccacgaccggtgctcgatttagtacacgtgattagggattggggctgggcctcaggaagcagcagtcgggggtgccgcagccatggcctggaccgctcttccttctgacgcctccttgctctactttacaggttctgtcgcctctatganctgactcacgccactctcgtagttgtcgaggtccgggaccccgggaacacgggaccgggacctaagggtacttttaccggttggggttacggggggtttaacaaagtttagttagggaaggtaaactaagttggtacgactacggtacggtaccaggacgaaggacggacgacgggaccgaccggtcccgtaggtacgtcggttactacgttacggttacgggtaccggggtactacccggacgttacccggggaccgtacggggtcccggtaccccgttgggaccgttaccgttacgtttccgttaccgtccggttaccccgtacgtaaccggtttcccgggggaccggggaacccgccccgggtaaacccctaacccgtacggtacccacggttacccggaaacgaaacccggtaaacccgacccgaacggtacccgggttacgaacggtacggtacgttcgttaacgtttacgtttagtttcggttacgggtacgggttacggtacggtaacgcgttacgtagttaccgtttagtttaacggtccgtttacggtttaccggaccggttacggaaccgttaacgggtaccgtaccggtacgtaccggtaccgtaccgacccggtacccgacccctaaccgtccgttaccgtacccttaccgttccccgttaccctaccccttacccgtaccgcccgtaaccgg

SEQ ID NO: 124785 - DNA, 694 bp, Homo sapiens
  misc_feature: GYAE6OF01BZT16.8.23.C01.1.454.CMB.1.raw
  modified_base (307)..(307): a, c, t, g, unknown or other
  misc_feature (307)..(307): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccgggacaggacggccaggattaccgtggtgggggttacaagtagttggaggtaacaagtgtgcacgtggtaccagcagaaggcgagggcacggccctgtactggtcatcgtagnggggactccgacgtcccggacgacgggtccgggacccctggccggcgtactttctcgtcgccctacgacgttccggaccgggggaaccgccgggaccccaaccgtcggaacccactaccgaacgaccgaaaccgcccgaacggcccgggtagaacgtcgggacggtcgtagttaactttaagtttttggacgtagggttggtacgggacaggaccgtagtaccttaagttttcgtcgttaccggttacgggtaccgtacgggtaaccgtaacgggttccgacccggtacgttacggacccacggtaccccgaaacggtccccaacccgtacttccggtaccctaccgttccgttacccggtcccctcccctacccgtcggaacccgg

SEQ ID NO: 124786 - DNA, 796 bp, Homo sapiens
  misc_feature: GYAE6OF01BT2MU.8.23.C01.1.454.CMB.1.raw
  modified_base (141)..(141): a, c, t, g, unknown or other
  misc_feature (141)..(141): n is a, c, g, or t
tcagctcgcgtgtccacgaccggtgctcgatttagtacacgtgattagggattgggggctgggcctcaggaagcagcatcgggggtgccgcagccatggcctggaccgctctccttctgagcctccttgctctactttacnggttctgtggcctctatgagctgactcacgccactctcagtgtcgaggtcggccccgggacaggaccggaccgaggtacttaccgtgggttcggggggttactaagttagttaggaaggtaactaagttggtgactacgtcggtaccagcgaaggaaggcgagggccacggcccgtgtacgtggtcatcgtaggtcggggtactccgacgtccggacgtacgggtccggtaccccgtggccgacgtacttccgtcgtcgtccctcgtacgtccgggtacgggaccgccgacccgtacccgtcgaccgtactacgacgaaccgaacggcccgaacggtccggtacgacgtcggacggttacgttacgttaacgttttacgttttacggtacgtggggttacgggtacgggtaacgacggtacgtaacggttaccgtttaagtttaccggttacggtttcccggttaccgggtacccggttaaccgggaaccgttaaccgggtacccgttaacccggttaccggttaccggttacccgaaacccggtaccccgtaaacccggtacccccgtaaaccccgttaccgttacccgtaccctacccggtttaccccttaccccggttaccccccttaccccggtcccgtaccgaaccccgg

SEQ ID NO: 124787 - DNA, 825 bp, Homo sapiens
  misc_feature: GYAE6OF01CFBX4.8.23.C01.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccggganacggtaccggccgaggactttaacccgtggttggggggttacaaggttagttaggaggttaacaagtgtgcactggtaccagcaggagcgaggtcaggccctgtacgtggtcatacgtagtgggggactccgacgtccggaccgtacgggtcgggtacccccgtggccggccgtacttccgtccgttccggtcccttccgtaccgttacccggtaccgggggaaacccgtcccgggtaccccgtaacccgttaccgggaccctaacgtacccgtaacggaacccgaaaaccggaccccgaaacgggttcccgggtaacggtagtacgggtaacgggtccgtttaacgggtaccgttttaaacgtttttcgggtacggttaaggggttcggttacggggtaaccgaggtaccgtaacggtaccgtttaacggtttacgtttacggttccggtttacccgggtaccggttacgggaaccggttaacgggttacccggtaaccgtaccggttaccggtaccgtacgggaacccccgtaaccgggtaaccccaccccggtacgttaccgtacccgttacccgttccgttacccggttccccctaacccgttcccgtacccgtaaccccggg

SEQ ID NO: 124788 - DNA, 756 bp, Homo sapiens
  misc_feature: GYAE6OF01EGAP8.8.23.C01.1.454.CMB.1.raw
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (426)..(426): a, c, t, g, unknown or other
  misc_feature (426)..(426): n is a, c, g, or t
tcagctcgcgtgtccacgaccggtgctcgatttagtacacgtgattagggattggggctgggcctcaggaagcagcatcgggggtgccgcagccatcggcctggaccgctctccttctgacgcctcctgctctactttacaggttctgtcgccttcctatgagctgactcacgccactctcagtgtcaggtccggcccgganacggacgccgaggtacttaccgtgggtggggttcaattgtaggacgtaanatgtgcacgtcgacngcaggaggcgaggcgacggccctgtcgtcgtctagtcgtaggtcgggtactcgtacggtccggcgtcgggtaccgggacccgtggacgtccgtacttccgtcgtccgtccctacgtccgtacccgggtacccggggaccgcccggtacccacccgtacnccacgtaaccgacgaaccgtaacccgaccgacccggtacggtacggacgtaggtacggtcgttacgtaacgttttagtttacggtacgggttgggtacggtacgggtcgacgtgtacgttagtttagtttaccgttaccggttaccggttaccggggtaccggttaacggggtaacccgtacccggttaccggtacccgtttccggtaacggttacccgaacccggtaaccccggaacccgtacccgtaacccccggttacgttcctacccgttaccccggtttctacccccgtttaccccctaccccgtcccgttaaccgaaccccggg

SEQ ID NO: 124789 - DNA, 825 bp, Homo sapiens
  misc_feature: GYAE6OF01ET0XO.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctcttgctcactttacaggttctgtggcctcctatgacgctcgactcagccactcctcgagtgtcgaggtccgggccccgggacacggtaccgggcccgtaagggtacgtttaacccggtgggttacggggggggttaccaaacgtttaggtttaggggaacggttaaaccgtaagttcggtacgcctaacgttcgggtaaccaggccaagggaaacggcgacggggcgaaccggcccgttggtaaccgttcggtcgaacgttccgtaggtacggggggtaacttcccgagttccccgggcgaccggggtcggacccctaggccgtccgtagtttccgtctcgtaccctccgtacgtccgggtacccggggaacgccccggtacccgacccgttcggaacccacgtacgacggaaccaaacggacccgtaacggtaccggttacgtacgtagggtaccggtcgtttacgttacgtttacgtttttggacgggtacgggttcggtagggacccgtaacggcgttacgtactttaacggtttcgttacggttacccggttacgggttaacccgtacgggtacctacgggtaccctccggttaccgttacgcccgaacgtaccccggacgttaccccgaaccgtcccggttactccccttacgttaccccggttccctccccgtacccgttacccggtcgaacccgg

SEQ ID NO: 124790 - DNA, 1126 bp, Homo sapiens
  misc_feature: GYAE6OF01AU744.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctctactttacaggttctgtggcctctatgagctgactcacgccactctcagtgtcaggtcggccccgggacgaggaccggccgaggtactttaccgtggggttacgggggggtttactaacgttaggtttaggggaaacggttaaacgaaagttggttacggaccgtaacggttcgggttaacccaaggaccgaagggaaacgggaccggaacgggggaccgaaccggggtcccccgttaggttaaccgttacgggttacctaacggttaccggtttaaggggtcgggggggtaaccttaaccccggtaaccggttcccccgggggtaaccggtaaccggggggttaccccggggtaacccccccgttaggggtcccggtacccggttaccttttacccgttccggttccgtacccccgttacccgttaaccgggttacccggggttaaccccgggggggaacccggtacccccggggtaacccctaaccccggttaccggaaaccccgtaacgttaaccccggaaccggaaaaccccggaaaacccgggtacccccggtaaccgggggtacccggttacgggtaaccggttacggggaacccgggtttacgtttaaccggtttaaccgttttttaacgggttttttcgggtaaccgggttacgggggtttaacggggtaacgggtaaccggtaacgggtaacccggtaacggttaccggttttaacgtttttaaccggttcgggttttaaaccccgggtttacccggggtaaacccgggttcccggggttaaacccgggtaacccggtttacccgggtaaccccggttttacccggggttaaaccgggaccccgtaaaccgggtacccccggaaaacccgggttacccccaaaccccggtttaccggttacccgtttaccccgtacccgtttaccccggtttaacccccgttaccccccgtaaccccgtttaccccggaacccggttaaccccggg

SEQ ID NO: 124791 - DNA, 733 bp, Homo sapiens
  misc_feature: GYAE6OF01BNVSD.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcgagtcggccccggacacgaccggccaggtacttaccgtgggttcgggggttcaattagttaggaaggtaaacaatgtgcactcggaccagcaaggaaggcgaggcacggccctagtactggtacagtcgtaggtcggggactccgacgtcccggcgtacggtccggccctggcgtcgtacttcgtctcgccctcacgttcggaccgggacgcccggacccacccgtacgacctacgtaccgaacgaaccgtaaccggacccgaacggtccgtagacgtcgggaacgtcgttaacgtacttttagttttacggaccggtagggtacgggtacggacgagtacgtacgttacgttagttttcggttacggttacccggttacccgggtaccggttaaccggggaacccgttaaccgggtacccgtaccggtaccgttaaccggacccgtaacccgtaccccggaaccccgtaccccaaccccgttagttccccgtaacttcccggttcccttacccccgtaccccctaaccccgtcccgtacgtaacccccg

SEQ ID NO: 124792 - DNA, 704 bp, Homo sapiens
  misc_feature: GYAE6OF01BKYBU.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagaccggccaggacttacctggtgggggttcaattagttggaaggtaacaatgtgcactggtaccagcagaaggcagggcgacggccctgtactggtcagtctagtggggactccgacgtccggacgaggtccgggaccctggccgtcgacttcgtctcgcctccgacgtccggtaccggggaacgccggaccctacccgtcgaccctagtaccacgaccaaacggcccgaacggcccgtagacgtgacggtcgtagtactttacgttttacgtcgtagggtgtacgggtacacggacgtacgtacgttagttttcgtacggttacccgttcgggtacccgttacgggtaacccgaacggttccccgaaacccggttccgtaacggttaccgaaccggaccccgtaaacggacccccctaaaccccggtccgttaacgggtcccctaacccgtttcccgttacccggtttaacccccctaccccgttcccgtacccgtaaccccgg

SEQ ID NO: 124793 - DNA, 746 bp, Homo sapiens
  misc_feature: GYAE6OF01BFMS2.8.23.C01.1.454.CMB.1.raw
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
tcagctcgcgtgtccacgaccggtgctcgatttagtacacgtgattagggagttggggctgggcctcaggaagcagcatcggaggtgccccagccatggcatggatccctctcttcctcggcgtccttgcttactgcacgaggactccgtggcctcctatgagctgactcacgccaccctcgagtgtccgtcgtccccgaggacagacacgccgagactccacctgctcgtggagaagttaaagtaggggaataatntgtctgcgtggtatcagcgacggacgccgacgccncgtccccgtgtacgtcggtcactctactacgaagtaacgtaaaccgacgggtcccggacccgttacggaacgggtaccttacccgtggaacggtccgttaccgttccggttaccgtccggtaccgtcctaaaccgtccgtaacgggaaaccctaccgacgaccctaccttaccgtaacgaccccctagaaccccggtacgggacccccgggaaccggtacgggtaccgttaacgggagtcgggtaacggccttaacggttaacttccgttacgtagggtaccggtaacgggtccgggtacgggaactacggaaccgtaccgcgttaccgggtagtttccgggttcgggttacccgggacggggtaacccgggtacgtaccgtcggttacccggtacccggttttcgacgggtaaccccgacgtacccgtaccggcccgttcccccgtaccccgg

SEQ ID NO: 124794 - DNA, 1048 bp, Homo sapiens
  misc_feature: GYAE6OF01B1ZCR.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcgggccccgggacacggaccggccgaaggtacgttacccgtgggttcgggggggttacaaagttagttagggaagggtaaactaaagttggtacggtaccgaaccgttacgggtaacccgaaggaccgaaagggaaacgggccggaacggggtcccgaaccgggtacccccgtttaggttaacccggttcgggttaccgtaaggttccgtttaagggtacggggggggtaacctttaccccgaacgggttaccccggggaccccgggtaacgggggtaccccgggggtaaccccccgttcggggacccgtaccgggttaactttcccggttacccgtaccggtcccccttacccggtaaacggttttcccggggaacccgggggggtaaacccgtccccggggtaccccccgttaacccccggttaccggtaaaccccgttaacccggttaacccgtaaaacccgggaaacccggtaaaacccgggtacccccggaaaaccggggttccccggggtaacggttaacgggttacgggtaacgggttaacccgttacggtttaacgttttacggttttttacggacccgggttaaggggttaccggggtacgggtaaaccggcggtaaccgttaggttaaccgttttaacgtttcccgggtttagttaccccgggttacccgggttaaccgggttacggggaaaacccgttacccggtaccggttacccggtacccggttaagggaccccaaccgggttacccccggaacccgtaacccccgtaaaccccgttcgtaccccgttaccgacccgtttaccgttaccccgttacccccaccccgtttcccgacccggtaacccgg

SEQ ID NO: 124795 - DNA, 710 bp, Homo sapiens
  misc_feature: GYAE6OF01DDA1O.8.23.C01.1.454.CMB.1.raw
  modified_base (149)..(149): a, c, t, g, unknown or other
  misc_feature (149)..(149): n is a, c, g, or t
  modified_base (178)..(178): a, c, t, g, unknown or other
  misc_feature (178)..(178): n is a, c, g, or t
  modified_base (218)..(218): a, c, t, g, unknown or other
  misc_feature (218)..(218): n is a, c, g, or t
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (564)..(564): a, c, t, g, unknown or other
  misc_feature (564)..(564): n is a, c, g, or t
tcagctcgcgtgtccacgaccggtgctcgatttagtacacgtgattagggattggggctgggcctcaggaagcagcagtcggggggtgccgacacgccagtcggcctcggaccgctctccttctgacgcctccttgctactactttacnggttctgtcgccttcctatgagtctgacncacgccactctcagtgtacgacggtccgggaccccggganacggccggaccagggtactttaccgtggggttcggggttactagttaggtaggtaaggtaactagtcgtgcctacggtcggtaaccgngacgaacgaacggcgagggccacggtccctaggtcgtggctagtcgtaggcgggtaccnccaggtccggacgtggggtacccggcctgccgtacgttaccttccgtcgtccgtcctacgtacggtaccggtacgggaccgtccgacccctacgacctacgactacgacggaccaacccggcgacgccggtagacgtgacggtcttacgttagtttagttcgtaacgggtggtacggtaccggaatcggtactacggtnttacgtttgtcctacgggtaccgacgtacggaacccgtcggtacctaccggtaccgtacgacgacccgaccgaaacgtacccctaccgtttaggccacccggtttaacgttccgtaccccggttcgacccgtagtccgtccccggg

SEQ ID NO: 124796 - DNA, 764 bp, Homo sapiens
  misc_feature: GYAE6OF01AJQWJ.8.23.C01.1.454.CMB.1.raw
tcagctcgcgtgtccacgaccggtgctcgatttagtacacgtgattagggattgggggctgggcctcaggaagcagcatcgggggtgccgcagccatggcctggaccgctctccttctgagcctccttgctcactttacaggttctgtggcctcctatgagctgactcacgccactctcgagtgtcaggtcgggccccgggacacgaccggccaggtacttaccgtgggtgggggttcaagtagtggaaggtaacaatgtcgcactcggtaccagcaaggaaggcgagggcacggccctagtactggtaccatcgtaggtcggggatcccgagtcccgggaccgacgggtaccgggacccccgtggccgtcggtactttccgtccgtccgtccctcctacgtccggtacccgggggtaaccgcccggacccctacccgtcgaacccacgtaccgacggacctaaaccggaccccgaacgggtccggtagtacgtacgggcgtaccgtacgttactttagtttttcggacggttaggggttacggtacgggacgtacggtacgtacgtactttacgtttacgttcggttaccggttcccgggtaccggtaccggggtaacctaccgggtacctacccggtaccgtacgggttacccgaaccggaccccggtaaacccgggacccccaaaccccgtcgttacccggtaccctaccccgttacccgttccccgttacccccctacccgtcccgtaccccgaacccgg

SEQ ID NO: 124797 - DNA, 911 bp, Homo sapiens
  misc_feature: GYAE6OF01BAJ2G.8.23.C01.1.454.CMB.1.raw
  modified_base (122)..(122): a, c, t, g, unknown or other
  misc_feature (122)..(122): n is a, c, g, or t
  modified_base (423)..(423): a, c, t, g, unknown or other
  misc_feature (423)..(423): n is a, c, g, or t
tcagctcgcgtgtccacgaccggtgctcgatttagtacacgtgattagggattggggctgggcctcaggaagcagcagtcgggggtgccgcagccatggcctcggaccgctcttccttctgngccttcctgctctactttacaggttctggtcgcctctagtcgagtctcgactcgacgcctactcctcgtaggttcgtacggacgggttcccgggaccccggggaacaacgggaccgggaccgtaagggttaaccgttttacccggttgggggtttaccgggggggttacttaaaagtttaaggggtttagggtaaacgttaaaacgtaagttacggttcggaccgtaacgtacgggttaaccaggaccgtaagggaacggcggacgggtaccgaccggtcccgtacggtacggttcggtancgttacgtacggggtggggtacctcgtacggtccgggacggtacgggtcccggtaccgtcggacggtacttacgttccgtccgtccggtaccctacgaccggttccggggtaaccggggaccgtccgacccgtaccgtacgaccctgtacccgaacgaacgaaaccggtcccgaacggtccgggtagtacggtacgggtacgttacggttaacgttacgttttacggttttacgcgggttacgggtagggtacggacgtcggtaacgttacgtaacgttttgtacgtttacccgggtcggtaacccggggtacccgttaacggggtaacccttaacggcccgggtttaacccgacgttaacccggtacccgggaaaccttaaccccgggaaaccctaacccccggttaacccgggtttaccccggttaccttacccgggtttacccttccccgttacccgttaaacccgttcccgtaaccggtacccg

SEQ ID NO: 124798 - DNA, 1106 bp, Homo sapiens
  misc_feature: GYAE6OF01B6QV8.8.23.C01.1.454.CMB.1.raw
tcagctcgcgtgtccacgaccggtgctcgatttagtacacgtgattagggagttggggctgggcctcaggaagcacgcactcgggggtgccgtcaggcctatggtccgtggaccgctctccttctgagcctccttgctcctactttacgaggtttcgtgtcggaccttccgtattgacgtcgtcgtacttacgacgcccaacttctcgaggttgtcaggtcgggccccggggtagaggaccgggccggaagggtactttaccggtagggttacgggggggttacctaaggttacgtttaggggaacggttaaacctaagttcggttaggaccgtaacgttacggggttaacccctaacggtccggaaagggtaaaccggggtacccggttaaacggggggaaccgtaaccggggtacccccccgtttaggttaaacccggtttcggggttaaccctaacgggttttacccgttaacgggttacgggggggggtaaccttacccccggtaaacgggttaccccggggggacccggttaacggggggttaccgggggtaacccccccggttggtacccggtaccgggtaaccttttaccgttccgttaccgggtccccgttacccgtaacggttcccggggttacccgggggggtaaaccgggtccccggggtaccccgtaaccccgtttacggaaccccgtaaacgtacccggttaaaccggaaaccggaaaacccgggaccccccggttaaacgggaccccggggttaacggttaaccggtaacggggtaaccggggtacccgtttaaacggtttaaacccgttttaaggtttttttaccggtacccggttaaggggtttacgggttacggggtaacccgtaaggttaaccgtaacggtaccgttaacgttttacgttaggttaccggtttaccggggtacccggttaacgggtaacccgtaacggggttccctaaccggttccgttaacggtaccgaaccgggtaaccccgaaacgggtaccccaaaccccgtcggttaccggttaccgtacccgttccgtttaccccgtttacccccaccccgttccgtcccggtaaaccccgg

SEQ ID NO: 124799 - DNA, 804 bp, Homo sapiens
  misc_feature: GYAE6OF01AQX46.8.23.C01.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccggganaggacggccaggacttaccgtgggtcggggggttacaagttacgttgggaaggtaacaagtggtgacacgtcggtaccaggacaggaaggcgacgggcacggcccttgtacgtcggtcacgtcgtaggtcggggactccgacgtccggaccggtagggtccgggaccccgtggccggcgtacgttccgtccgtcggtccctccgtacgtccgggtaccggggaccggcccggaccccacccgtacgaacccgagtaccgaacggaccgaaaccggacccgtaagggccggtagtacgtcggacggtacgttacggttaaccttttaggtttttcggacggttaggggttcggtaacgggacctacggacgtaacgtaccgtttaagtttacgttaccggtttcccggttaaccgggtaccgggttaaccgggtaacccggttaacgggtaccccgttaaccccgggttaccgtacggggtacccctaaccggacccccggtaacccgggaaccccctaacccccggtagtttaccccggacccttacccgtttccccggtacccccgttaccccccgtaccccgttcccgtcccgggaaaccccgg

SEQ ID NO: 124800 - DNA, 831 bp, Homo sapiens
  misc_feature: GYAE6OF01DSD98.8.23.C01.1.454.CMB.1.raw
  modified_base (140)..(140): a, c, t, g, unknown or other
  misc_feature (140)..(140): n is a, c, g, or t
tcagctcgcgtgtccacgaccggtgctcgatttagtacacgtgattagggattggggctgggcctcaggaagcagcagtcgggggtgccgcagccatggcctggaccgctctccttctgagcctccttgctcactttacnggttctggtggcctctatgagctgacctcgacgccctacttctctaggtgtcgacggtccgggaccccgggacgacggaccggccgaggtaacttaccggtggggttggggggttactaaagttaggttacgggtaaacggtaaactaagttggtacggacgtaacggttacgggtaaccaacggacgaacgggaacggacgggacggggaccgtaccggtccccgttacggttacggtcgggtacctacggttacggttacggggtcggggggtacccttacccggtaccgggtcccgggaccggtaacgggggtccccgggtaaccccggtcggcccggttaccggtactttcccgtccgtccgtcccgtaccggtaccgtccggggtacccggggaccgcccggacccgtacccgtacgacctacgtacgaacgaaccgaaccgtaccggacggtaccgtaggacggtacgacgtacgttacgttacgttttgttacggtcgggttagggtcgtaacgggctacgtcgtagttacttagtttcgtccggttaccggtccggaccgggttaacgcgttacccggtaccgtaccggttcgaccgtaccgaccggtacccgaacccggcccctaaccgtccgtacctactacccgttccggttcccctacccgtccctaccgtcgacccgg

SEQ ID NO: 124801 - DNA, 827 bp, Homo sapiens
  misc_feature: GYAE6OF01BBA1Q.8.23.C01.1.454.CMB.1.raw
  modified_base (143)..(143): a, c, t, g, unknown or other
  misc_feature (143)..(143): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
  modified_base (621)..(621): a, c, t, g, unknown or other
  misc_feature (621)..(621): n is a, c, g, or t
tcagctcgcgtgtccacgaccggtgctcgatttagtacacgtgattagggagttggggctgggcctcgaggaagcagcagtcgggggtgccgcagccatggcctggaccgctctccttctgacgcctcttcgctctacttacnggttctgtcgcctcctatggagcgtacgactcacgccaccgtctcgtagttcgtcgcgggtccgggacccgggacgtacggaccggaccgtaaggttaccgtttaccggttcgggggttacggggggtttaactaaaggtttagtttaggggaaacggttaaacgtaagttgggtacgacgtaccgttacgggaaaccgaggtaacggaaacggaacgggcggaacggggtacccgaccggggtccccgttaggttacccggttggtacctaggttaccggttaggggtacggggaaccttccggaaccggtcccggggaccggaccggggcccggtacccgtcggccggtacgttcttcgccgtcgtccctacgtcggtcccggaccgggtccgacccgacccgtacncgtactanaccgacgacgaaccgccggacgtcggtagagacggacgtacgtcgttactttagttacggnggtaggtacgggacgtacgagtcctaggtaacctttagttcgttccggttaggttaccgggtaccgggtaaccgtaaccgtaccggtacccggtacgtacccgtacgtaccgcccggtaaacccggtaccccgacccaacccgttacgttcccacgtttacccgtacccgtttccccgttaccccaacccgttcgtccgtaacccg

SEQ ID NO: 124802 - DNA, 1010 bp, Homo sapiens
  misc_feature: GYAE6OF01DFISA.8.23.C01.1.454.CMB.1.raw
  modified_base (139)..(139): a, c, t, g, unknown or other
  misc_feature (139)..(139): n is a, c, g, or t
tcagctcgcgtgtccacgaccggtgctcgatttagtacacgtgattagggatggggctgggcctcaggaagcagcagtcgggggtgccgcagccatggcctggaccgctctcctctgacgtcctctgctctactttacnggttctgtcgtcctctagtgagtctgacctcgacgcccactctcgagttcgtccgtacgggtcccgggacccgggacgacggtaccgggaccgaacggttaacgtttaccgggttaggggtttcggggggttaacctaaagggtttacgggttaacgggggtaaaccttagtggttcgaccgacggttacggtaccagtacggaacggaacggtccggacgggcccgtaccggtccctagtacgtcgtacgtacgtcggtacgggtacgggtacctaccgtaccggcccggaccgggtacggggtaccggtccccgtcggtccgacgttccgttaccgtccgtacccgtcctaccggaccggttacccggggtaacggggaccccgacccggtaccccgtacccggtacgtaaccctacggtaacccgaacggtaaacccggtacccgaacccggtaccggggacggttaacggacggttaggtaccggttaaccgttacgggttttaaccgttttagggttttaccgggtacgggttaacggggttacggtaccgggtaacgtaccggtaaccggttaacgtttaccgtttaacggtttcgggttacccgtttacccggggtttacccgggtaaccccggggttaaccgggttaacccggttaacccgggttaccccgttaccccgggtaacgggtttaccccggtaaacccggtaccccggtaacccccggaaaacccccgggttaacccccggtaacccttaaccggttaccccggttaaccccgttaccggtttaacccccccttcccccggttacccccctttaccccgggtaacccccgccggtttaaccccgggaacccccggg

SEQ ID NO: 124803 - DNA, 939 bp, Homo sapiens
  misc_feature: GYAE6OF01EPTYZ.8.23.C01.1.454.CMB.1.raw
  modified_base (306)..(306): a, c, t, g, unknown or other
  misc_feature (306)..(306): n is a, c, g, or t
tcagctcgcgtgtccacgaccggtgctcgatttagtacacgtgattagggattgggggctgggcctcaggaagcagcagtcggggggtgccgcagccagtggcctcggaccgctctccttctgacgtcctccttgactctactttacgaggttctggtcggcctctatgagctgactcacgaccacgtctcgtagtcgtacgcggccgggacccggacgacggaccggacgtaaggtacgttaccggtggggttacggggttacagttaggtagggtaagtaactagtgtacgactacgtacgacngacgaaggacgcggacggcgtaccggtccgtaacgttgtacggtacttacgtaggtaggggtacgggacttacccggacgggtacccggtccggggtaacggggttcccgggtccgtacggccggtacgtttaccttccggtacgttccgcccgttacgttaccgggtccgggggtaaccgggaccggacccccgtacccgttaaccgaaccggtactacggtaaccgaacgtaaaccgaacccgggtacggtaacgggtcggtaggtacggtcgggtaggtacgttacgtttaagttttaggtttccggtagggtacgggttagggtaccggacggtaaccggtagttaaccgttaacgtttacgtttacgggttacccggggtttaacggttcccggggtaaacccggggttacggggttaaacccggttaacccggggttaccgtttaacccgggttaccgggtaaacccggtaacccggtaccccgggtaaaaccccggttaaccccgggtaaacccgtttaacccccggttacggttacccctttaaccccgggttcccttaccccgggttaccccggttttaacccccccggccccgtttaaaccccgggtaccggtaacccccggg

SEQ ID NO: 124804 - DNA, 209 bp, Homo sapiens
  misc_feature: GYAE6OF02IV5EP.8.23.C01.1.454.CMB.1.raw
  modified_base (208)..(209): a, c, t, g, unknown or other
  misc_feature (208)..(209): n is a, c, g, or t
tcagctcgcgtgtccacgaccggtgctcgatttagtacacgtgattagggattgggctgactattttgtcaggtgtgggacagcagcatttatgtcttcggacctgggaccaaggtcaccgtcctaggtcagcccaaggccaacccactgtcactctgttcccgccctcctcgacacgcgagctgagcgggctggcaaggcgcatagnn

SEQ ID NO: 124805 - DNA, 531 bp, Homo sapiens
  misc_feature: GYAE6OF02GG072.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctcatctcggggaacgcggccacctgaccatcagcaaagcccaagccggtgatgaggctgacttattttgtctagggttgtgggacagcagctatttatgttcttcggacctgggaccaaggtccaccgtctaggtcacgcccgaaggcccaaccccactcgtccactctcgttccccacccttccgcgaccg

SEQ ID NO: 124806 - DNA, 212 bp, Homo sapiens
  misc_feature: GYAE6OF02I4OU2.8.23.C01.1.454.CMB.1.raw
  modified_base (210)..(212): a, c, t, g, unknown or other
  misc_feature (210)..(212): n is a, c, g, or t
tcagctcgcgtgtccacgaccggtgctcgatttagtacacgtgattagggattgggctgactatttttgtcaggtgtgggacagcagcatttatgtcttcggacctgggaccaaggtcaccgtcctaggtcagcccaaggccaaccccactgtcactctgttcccaccctcctcgacacgcgagctgagcgggctggcaaggcgcatagnnn

SEQ ID NO: 124807 - DNA, 533 bp, Homo sapiens
  misc_feature: GYAE6OF02I6OA6.8.23.C01.1.454.CMB.1.raw
  modified_base (356)..(356): a, c, t, g, unknown or other
  misc_feature (356)..(356): n is a, c, g, or t
  modified_base (526)..(526): a, c, t, g, unknown or other
  misc_feature (526)..(526): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccatccggcaggtcgggacccctgcgcgattctctgcctccatctcggggaacncggccacctgaccatcagcaaacgcccaagccggtgatggaggctgacttattttgctaggttgtgggacagcaggcatttagtgttctcggacctgggaccaaggtccaccgtctaggtcacgcccgaaggcccaaccccatcgtacactcctccgttcccaccctccnccgaccg

SEQ ID NO: 124808 - DNA, 547 bp, Homo sapiens
  misc_feature: GYAE6OF02JYZ9L.8.23.C01.1.454.CMB.1.raw
  modified_base (359)..(359): a, c, t, g, unknown or other
  misc_feature (359)..(359): n is a, c, g, or t
  modified_base (433)..(433): a, c, t, g, unknown or other
  misc_feature (433)..(433): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagcagactcagccactctcagtgtcagtggccccgggacagacggccaggattacctgtggggggttcaatattggaggtaacaatgtgcactggtaccagcagaaggcagggcaggcccctgtactggtcatctagtggggatccagtccggcaggtcgggacccctgccgcgattctctcgcctcatcgtcggggaacncggccaccgtgaccatcagacaaacgcccaagccggtgagtgacgctgacttagttttgcgaggttgtgggacngcagctattatgtcttcggactgggaccaggtccaccgtctacggtcacgcccgaacggcccaacccgcctcgtacctacttccgtccgttccccgcccttaccgtccgtaccg

SEQ ID NO: 124809 - DNA, 533 bp, Homo sapiens
  misc_feature: GYAE6OF02IULLO.8.23.C01.1.454.CMB.1.raw
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggactccctgagcgattctctggctccaagtcgggaacacggccaccctgaccatcagcagggcccaacctggatgaggtgactattcngtcaagtgtggacaccaacncttgtgtcgttcgggactgggaccgaggtcaccgtctaagtccagcccagggcccaaacccctactcgtccacttcctcggttcccccgcccctcgaccaccgccgg

SEQ ID NO: 124810 - DNA, 520 bp, Homo sapiens
  misc_feature: GYAE6OF02IJU25.8.23.C01.1.454.CMB.1.raw
  modified_base (354)..(354): a, c, t, g, unknown or other
  misc_feature (354)..(354): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgatctctgcctcatctcggggaacncggccacctgaccatcagcaaagcccaagcccggtgatgaggctgactattttgtcaggtgtgggacagcagcatttatgtcttcggacctgggaccaaggtcaccgtctaggtcagcccgaaggcccaacccactcgtacactctcgttcccaccctcctcgacc

SEQ ID NO: 124811 - DNA, 213 bp, Homo sapiens
  misc_feature: GYAE6OF02GHDKT.8.23.C01.1.454.CMB.1.raw
  modified_base (210)..(213): a, c, t, g, unknown or other
  misc_feature (210)..(213): n is a, c, g, or t
tcagctcgcgtgtccacgaccggtgctcgatttagtacacgtgattagggattgggctgactatttttgtcaggtgtgggacagcagcatttatgtcttcggacctgggaccaaggtcaccgtcctaggtcagcccaaggccaaccccactgtcactctgttcccgccctcctcgacacgcgagctgagcgggctggcaaggcgcatagnnnn

SEQ ID NO: 124812 - DNA, 211 bp, Homo sapiens
  misc_feature: GYAE6OF02FKOG5.8.23.C01.1.454.CMB.1.raw
  modified_base (210)..(211): a, c, t, g, unknown or other
  misc_feature (210)..(211): n is a, c, g, or t
tcagctcgcgtgtccacgaccggtgctcgatttagtacacgtgattagggattgggctgactatttttgtcaggtgtgggacagcagcatttatgtcttcggacctgggaccaaggtcaccgtcctaggtcagcccaaggccaaccccactgtcactctgttcccaccctcctcgacacgcgagctgagcgggctggcaaggcgcatagnn

SEQ ID NO: 124813 - DNA, 512 bp, Homo sapiens
  misc_feature: GYAE6OF02FWCA9.8.23.C01.1.454.CMB.1.raw
  modified_base (431)..(431): a, c, t, g, unknown or other
  misc_feature (431)..(431): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctcatctcgggaacgcggcaccctgaccatcagcaaagcccaagccggtgatgaggctgactattttgcaggtgtgggacagcagcatttangtctcggactgggaccaaggtcacgtctagtcagcccaaggccaacccactcgtcactctcgttcccaccctcctcgaccg

SEQ ID NO: 124814 - DNA, 515 bp, Homo sapiens
  misc_feature: GYAE6OF02FPVZ8.8.23.C01.1.454.CMB.1.raw
  modified_base (335)..(335): a, c, t, g, unknown or other
  misc_feature (335)..(335): n is a, c, g, or t
  modified_base (486)..(486): a, c, t, g, unknown or other
  misc_feature (486)..(486): n is a, c, g, or t
  modified_base (510)..(510): a, c, t, g, unknown or other
  misc_feature (510)..(510): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattcnctgcctcatctcggggaacgcggccaccctgaccatcagcaaagcccaagccgtgatgagctgactattttgctaggtgtgggacagcagcatttatgtcttcggacctgggaccaaggtcaccgtcaggtcagcccgaaggcccaacccnctgtcactctcgttcccgcctccncgacc

SEQ ID NO: 124815 - DNA, 549 bp, Homo sapiens
  misc_feature: GYAE6OF02JFDPQ.8.23.C01.1.454.CMB.1.raw
  modified_base (435)..(435): a, c, t, g, unknown or other
  misc_feature (435)..(435): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccagtccggccagggtcgggacccctggccgcgattctctgcctccatcgtcggggaacgcggccaccctgaccatcagacaaacgcccaagccggtagagtgaggctgacttattttgcaggttgtgggacngcagctatttatgttcgttcggacctgggaccaaggtccaccgtctaggtcacgcccgaacggcccaacccgtctcgtaccacttcctccgttccccacccgttcctccgaccg

SEQ ID NO: 124816 - DNA, 512 bp, Homo sapiens
  misc_feature: GYAE6OF02HANOA.8.23.C01.1.454.CMB.1.raw
  modified_base (355)..(355): a, c, t, g, unknown or other
  misc_feature (355)..(355): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggcaggtgggacccctgcgcgattctctgcctccatctcggggaacncggccacctgaccatcagcaaagcccaagccggtgatgaggctgacttattttgtcaggttgtgggacagcagcactatgtggtttcggcggagggaccaagctgaccgtcgtgtcagccaggctcgcccctgtcacgtctcgtcccacctcctccg

SEQ ID NO: 124817 - DNA, 579 bp, Homo sapiens
  misc_feature: GYAE6OF02HQ240.8.23.C01.1.454.CMB.1.raw
  modified_base (443)..(443): a, c, t, g, unknown or other
  misc_feature (443)..(443): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccagtccggccagggtcgggacccctggcgcgattctctgcctcatcgtcggggacgcggccaccctgacccatcacgacaagcccaagcccggtgagtgaggctgacttattttgcgaggtgtgggacagcagcatttangttcgttccggaccgtgggacccaagggtccaccggttcctacggtccaacgtaccccgaagggaccccaacccccgtacttaccgtacctaccttccgttccggtttcccccgcccctcccgtacccgtaacccg

SEQ ID NO: 124818 - DNA, 828 bp, Homo sapiens
  misc_feature: GYAE6OF02JZ8GL.8.23.C01.1.454.CMB.1.raw
tcagctcgcgtgtccacgaccggtgctcgatttagtacacgtgattagggaggttggggctgggccctcaggaagcagcatcggggtgccgcagccgactggcctggaccgctcgtccttctgagcctccttgctcacctttacgaggttctagtggcctcctatcgagctgacctcagccactctcagtgtcagtggcccgggacagacggccaggacttaccgtgtgggggttcaacgtattggacgtaacaattggtacgcgtacgtcggtaccagtcgaggaacggacaacggggacgaacgggcccccttaggtaaccgtcgggttaccacgttaccgtaaggttacggggggtaacttaccccgtaacgttacccgggaccgtacgggggttacccgggggtaaccccccgttagggtcccggtaccgggttaacgtttacccgtaccggttccggacccgttacccgtaacgtttcccgggttaaccggggggaaaacccggtcccgggtaccccgttaaccccgtacggtaacccctaacgttacccgaaacggtaaccgaaaaccggtaccccgaaacggtccccgggtacggtaacggttaccgggaacgggtaccgttaacgtttacgttttacggttacgtaacggttggttacgggtacgacgtacgacgtactagtttacgttggttacgttacgggtaccgtacgggaaccgtaacgtacgtaccggtaacgtacgtacgacgtaccgacggcccgaaccgtcctacgtacctcgtaccgttcgtacccgtcctacccgttccgacctaccgg

SEQ ID NO: 124819 - DNA, 606 bp, Homo sapiens
  misc_feature: GYAE6OF02HVPX4.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtgggggttcaatattggaggtaacaatgtgcactggtaccagcagaaggcagggcaggcccctgtactggtcatctagtgggggatccgagtccggcaggtcgggacccctggcgcgattctctgcctccatcgtcggggaacgccggccaccctgaccatcgacgacaaacgcccaaaggcccggtagatggacggctaggtacttagtttttcggtctagggttggtacgggacaggccgaaggtctaagttttagttcggttccgttacggtacccgttgggaaccctaacgggtcctaccggttcctagggtccacgacccgaacggaccccaacccgactcgtaccacttccgtccgttccccgccccttcccgtacgaacccg

SEQ ID NO: 124820 - DNA, 548 bp, Homo sapiens
  misc_feature: GYAE6OF02H9BNV.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctagtgggggatccatccggccagggtcgggacccctgccgcgattctctgcctccatcgtcggggaacgcggccaccctgaccatcagcaacgcccaagcccggtgatgaggctgacttattttgtctaggttgtgggacagcagctatttatgttcttcggacctgggacctaaggtcaccgtccgtaggtcacgtcccgaacggcccaacccgactcgtaccactctccgttccccgcccttcccgtcgacccg

SEQ ID NO: 124821 - DNA, 600 bp, Homo sapiens
  misc_feature: GYAE6OF02I5UMC.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctagtggggatccagtccggccaggtcgggacccctgcgcgattctctgcctcatcgtcggggaacgcggccacccgtgaccatcgagccaaacgcccaaggcccggtgaagtcgaggctgacttattttggctagggttggtcgggacagcagcgtaattttatacggttcttaccggtacgtacgggaaccctaacgggtcctaacccgttaccgtacggtaccgacggacccgaaaccggacccaaccccgtaacgttcgtacctacctaccttccggttcccccgcccttccccgacgtaacccg

SEQ ID NO: 124822 - DNA, 554 bp, Homo sapiens
  misc_feature: GYAE6OF02FL3C9.8.23.C01.1.454.CMB.1.raw
  modified_base (197)..(197): a, c, t, g, unknown or other
  misc_feature (197)..(197): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccggganagacggccaggattacctgtgggggttcaatattggaggtaacaatgtgcactggtaccagcagaaggcagggcaggcccctgtactggtcatctatggggatccatccggcaggtcgggaccctgcgcgattctctgcctcatcgtcgggaacgcggccacctgaccatcagcaaagcccaagccggtgatgaggctgacttattttgctaggtgtgggacagcagctatttatgttcttacggaccgtgggaacccaaggtcaccggttcctaggtccacggcccgtaacgggaccctaaacccccacttcgtacctacctcgttccgttaccccgcccttcccgtcgtaacccg

SEQ ID NO: 124823 - DNA, 528 bp, Homo sapiens
  misc_feature: GYAE6OF02JI5ER.8.23.C01.1.454.CMB.1.raw
  modified_base (361)..(361): a, c, t, g, unknown or other
  misc_feature (361)..(361): n is a, c, g, or t
  modified_base (403)..(403): a, c, t, g, unknown or other
  misc_feature (403)..(403): n is a, c, g, or t
  modified_base (522)..(522): a, c, t, g, unknown or other
  misc_feature (522)..(522): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctagtgggggatccagtccggccagggtcgggaccccgtgcgcgattctctgcctcatcgtcggggaacncggccaccgtgaccatccagcaaacgcccaagccggtgatgnggctgacttattttgctaggtgtggaacagcagctattagtgtctcggactggacctaggtccaccgtctacggtcacgccaacggccaacccgctgtccactcctcgtcccacctccncgaccg

SEQ ID NO: 124824 - DNA, 510 bp, Homo sapiens
  misc_feature: GYAE6OF02IROQL.8.23.C01.1.454.CMB.1.raw
  modified_base (354)..(354): a, c, t, g, unknown or other
  misc_feature (354)..(354): n is a, c, g, or t
  modified_base (483)..(483): a, c, t, g, unknown or other
  misc_feature (483)..(483): n is a, c, g, or t
  modified_base (506)..(506): a, c, t, g, unknown or other
  misc_feature (506)..(506): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtggacccctgcgcgattctctgcctcatctcggggaacncggcacctgacatcagcaaagcccaagccggtgatgaggctgactatttgcaggtgtgggacagcagcattatgtcttcggacctgggaccaaggtcaccgtcctagggtcagcccaaggcccaacccnctgtcactctcgtcccacctccngacc

SEQ ID NO: 124825 - DNA, 558 bp, Homo sapiens
  misc_feature: GYAE6OF02IECE2.8.23.C01.1.454.CMB.1.raw
  modified_base (363)..(363): a, c, t, g, unknown or other
  misc_feature (363)..(363): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccgatccgggccagggtcgggacccctgcgcgattctctcgcctccatccgtcggggaacncggccaccctgaccatcagcaaagcccaagccggtgatgagctagacttattttgtcgaggttgtagggacagcagcatttatgttctcggacctagggaccaaggtcacccgttctaggtaccacgacccgaacggcccaaccccgactccgtacaccttccgtccgttcccccacccttccccacgaaccccg

SEQ ID NO: 124826 - DNA, 656 bp, Homo sapiens
  misc_feature: GYAE6OF02IIENR.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggcccgggacagacggccaggacttacctggtggggggttacaatattgggaggtaacaatgtgcacgtggtaccagcaggaaggcagggcacggccctgtactggtcatcgtagtggggatccagtccggccgagggtcgggacccctggcgacgtattctctcgccctcatccggtacggggaacgcgacccgacctcggaaccatcaacggaccaaacgccccgaagtccggtgacgttggaacggctagtactttacgttttgacgtaagggttcggtacgggacagccgaggtaccttaagtttacgttcgttccgtttacggaaccgttacggggaacctaacgggtaccaacccggttcgtaacgggtcaaccggtaccccgtaaaccggaccctaaccccgaacgttaccgtcctaaccgttccgttaccggttcccccgacccttcccgtacgaacccgg

SEQ ID NO: 124827 - DNA, 212 bp, Homo sapiens; identical to SEQ ID NO: 124806
  misc_feature: GYAE6OF02IR6MY.8.23.C01.1.454.CMB.1.raw
  modified_base (210)..(212): a, c, t, g, unknown or other
  misc_feature (210)..(212): n is a, c, g, or t

SEQ ID NO: 124828 - DNA, 517 bp, Homo sapiens
  misc_feature: GYAE6OF02ISAKN.8.23.C01.1.454.CMB.1.raw
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
tcagctcgcgtgtccacgaccggtgctcgatttagtacacgtgattagggattggggctgggcctcaggaagcagcatcgggggtgccgcagccattgcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatggggggatccatccggccaggtgggacccctgcgcgattctctgcctccatctcggggaacgcggccacctgaccatcagcaaagcccaagccggtgatgaggctgacttattttgtctaggtgtgggacagcagctattatgtcttcggactggacctaggtcacgtctagcacgcccaagcccaacccnctcgtacnctctcgttcccgccctccgcaccg

SEQ ID NO: 124829 - DNA, 216 bp, Homo sapiens
  misc_feature: GYAE6OF02FH7X8.8.23.C01.1.454.CMB.1.raw
  modified_base (210)..(216): a, c, t, g, unknown or other
  misc_feature (210)..(216): n is a, c, g, or t
tcagctcgcgtgtccacgaccggtgctcgatttagtacacgtgattagggattgggctgactatttttgtcaggtgtgggacagcagcatttatgtcttcggacctgggaccaaggtcaccgtcctaggtcagcccaaggccaaccccactgtcactctgttcccaccctcctcgacacgcgagctgagcgggctggcaaggcgcatagnnnnnnn

SEQ ID NO: 124830 - DNA, 551 bp, Homo sapiens
  misc_feature: GYAE6OF02H97BZ.8.23.C01.1.454.CMB.1.raw
  modified_base (517)..(517): a, c, t, g, unknown or other
  misc_feature (517)..(517): n is a, c, g, or t
  modified_base (545)..(545): a, c, t, g, unknown or other
  misc_feature (545)..(545): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctagtgggggatccgatccggccagggtcgggacccctggccgcgattctctcgcctccatccgtcggggaacgcggccacccgtgaccatccagaccaaacgcccaaggccggtagatggaggctagacttagttttgtctaggtgtggacagcagctatttagtgttcttcggaccgtcgggacctaaggtcaccgtctaggtcacgcccgaaggcccaacccnctcgccactctccgttccccacctcccncgaccg

SEQ ID NO: 124831 - DNA, 704 bp, Homo sapiens
  misc_feature: GYAE6OF02F7QHZ.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattaccgtggtgggggttcaatagttggaggtaacaatgtgcactggtaccagcagaggcgagggcacggcccctgtactggtcatcgtaggtgggggactccgagtccggccgagggtcgggacccctggccgcgtacttctctcgcctccacgtcgtccggggaacgcccggacccacccgtcgacccatccgacgaccaaacgccccgaacggtcccggtagtacgtcggacgggtccttagtacgtttacgtttttcggcgtaggggttacggtacggggaacgaggtaccgtagtaccgttattttacgttcggttaccgtttaccgggtaacccggttacgggtaaccgttaacgggtttacccgttaccgttacgggtacccgaccggaccccgaaaccgggtccccctaaaccccgacgttaccgtaccctaccgttacccgttcccgttaccccctaccccgttacccgtaccgacccgtacccgg

SEQ ID NO: 124832 - DNA, 625 bp, Homo sapiens
  misc_feature: GYAE6OF02G8J0T.8.23.C01.1.454.CMB.1.raw
  modified_base (232)..(232): a, c, t, g, unknown or other
  misc_feature (232)..(232): n is a, c, g, or t
  modified_base (484)..(484): a, c, t, g, unknown or other
  misc_feature (484)..(484): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacaggacggccaggattacctggtgggggttcaatnttggaggtaacaatgtgcactggtacagcagaaggcgagggcacggcccctgtacgtggtacatcgtagtgggggatccgagtccggccgagggtcgggaccccgtggccgcgtattctctcgccctccactcgtacggggaaccgccggacccaccgtacgacctactccagaccgaaacgacccaacggccggtagacgtggacgctagtactttagttttggtcgtagggttggtcgggacagcgacgnttatttagtcgttccgttacggaccggttacgggaacccgtaacggtccgtaccgtacgtacggtaccgacgacccgaacggaccctacccgactcgtacctacgttccctaccgttaccccacccttccgaccgtacccg

SEQ ID NO: 124833 - DNA, 739 bp, Homo sapiens
  misc_feature: GYAE6OF02HF88H.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccgagtccggccagggtcgggacccctggccgcgattctctcgtccttcactcgtacggggaacgccggccacccgtgaccatcacgacaaacgcccaacggccggtagagtcggaggctagtacttagtttttcgtacgtagggttcggtagggacgtacgacgtagaccgtaagttttacgtcggtttaccgtttaccggggtaacccgttacggggggtaacccgttaaaacggggttcccgtaaaccccgggtttacccgttaaccggggttacccgtaaccgggtaaccccccggtaaaaccgggtaccccccgtaaaaccccccgttaacccgttacccggttaaccccgttaaccccgtttccccgtttaccccggttttaccccccccgtaacccccgtttacccccggttacccggtaaacccccggg

SEQ ID NO: 124834 - DNA, 534 bp, Homo sapiens
  misc_feature: GYAE6OF02I9G5M.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccagtccggcaggtcgggacccctgcgcgattctctgcctccatcgtcggggaacgcggccacctgaccatcagcaaagcccaagccggtgatgagctgacttattttgcaggtgtgggacaggcagctatttatcgttcttacggacctgggaacctaaggtccaccgtcgtaggtcaggcccaaggcccaacccatcgtacactctccgttcccgcccttcctccgaccg

SEQ ID NO: 124835 - DNA, 571 bp, Homo sapiens
  misc_feature: GYAE6OF02H1SCJ.8.23.C01.1.454.CMB.1.raw
  modified_base (368)..(368): a, c, t, g, unknown or other
  misc_feature (368)..(368): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtggggggttcaatattggaggtaacaatgtgcactggtaccagcagaaggcagggcaggcccctgtactggtcatctatgggggatccagtccggccacgggtcggggacccctggcgcgattcctctcgcctccattccgtcggggaacncggccaccctgacccatcagccaaacgcccaagccggtgagtgaggctgacttattttgtcgtaggtgtgggacagcagctatttatcgtcgttacggaccgtcgggacctaaggtccacccgtcgtaggtccacgacccgaacggaccccaaccccgacttcgtccacctcttaccgttccccaccctccctccgaacccgg

SEQ ID NO: 124836 - DNA, 582 bp, Homo sapiens
  misc_feature: GYAE6OF02GQWW3.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctagtgggggatccgatccgggccagggtcgggacccctgccgcgacttctctgcctccatcgtcgggacgcggccacctgaccatcagacaaacgcccaaggccgtgatggaggctgtacttattttgtcgtagggttgtagggacaggcagtctatttagtgttcgttacggaccgtgggaaccctaaggtccgtacccgtcgtacggtccgacgacccgaacggacccaaccccacgttacgtaccaccttccgttccgttccccgtccccttcccgtacgtaacccg

SEQ ID NO: 124837 - DNA, 685 bp, Homo sapiens
  misc_feature: GYAE6OF02H5YKW.8.23.C01.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccggganagacggccaggacttacctggtgggggttcaatagttagggaggtaacaagtgtgcacgtcggtaccagacaggaaggcgagggcgacggccccttgtactggtcagtcgtaggtggggactccgacgtccggccgtagggtccgggaccctggcgcgtacttcgtcgtcgcccgtcctatcgggacggggaaccgcccggaccctaacccgtcgaacccatccgaacgaccgaaaccgtcccgaaagggtcccggtagacgtgggtacggtacgttagtaaccgtttacgtttttaggcgttagggttcggtagggacgagtcgagtacgttatttacggtcgttcgttaccggtaccggtacgggtaaccgtacggtaccgtaccgtacgttaacgtccgaccgtaacccgacggtaacccacccgtacgtacgtacccgtacttcccgtaccgttacccccacccgttccccgaccgtaacccg

SEQ ID NO: 124838 - DNA, 719 bp, Homo sapiens
  misc_feature: GYAE6OF02ITDKA.8.23.C01.1.454.CMB.1.raw
tcagctcgcgtgtccacgaccggtgctcgatttagtacacgtgattagggattggggcgtgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattaccgtggtggggggttcaaatagttggaggtaacaatggtgcactggtaccagcagaagggcagggcacgggcccctagtacgtcggtcagttctaaggtggggaactccagttcccggaccgtaggggtaccggggacccctcggccggtacgtacgtttccgtccgttcggccctcccgtaacgttccggtaccgggggaaacccggtccgggacccctacccgttacggaaccctacgtaccggaacgaaccgaaaccgtaccccgaaggtccccgggtagacgtacgggacggtcttagtaccgttttagtttcgtacgtaagggttggtacgggactacgcgtagacgttagtttagtccgttaccgttacgggtaccgtacgggaaccgtaacgtacccgaccgttacgtacgggtccaacggtaccccgaaggaccccctaaccgtacgtcgtaccttaccgtcccgtaccgttccccgtacccttccgacccgtaccg

SEQ ID NO: 124839 - DNA, 700 bp, Homo sapiens
  misc_feature: GYAE6OF02HGRM9.8.23.C01.1.454.CMB.1.raw
  modified_base (262)..(262): a, c, t, g, unknown or other
  misc_feature (262)..(262): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattacctggtgggggttcaatattggaggtaacaatgtgctactggtaccagnagaaggcagggcacggcccctgtactggtcatcgtagtgggggactccgagtcccggaccgagggtcggacccctggccgcggtattcctctcgccctccagttccggtaccggggaaccgccggcccctaacccgtgaacccacgtccaacgaccaaacggccccgaaacggccggtaggaacgtaggacggtctaggtaacctttagtttttcggacgttaggggttcggtgggtaaccaggcaaggacttagtttagttcggttaccgttcggaacccggtttcgggaaccgtaacgggttaccgtacccgttccgttacgggtcccgaccggtaaccccggaacggaccccctaaaccccgtacgttccgttaccctacccgttcccgttacccgtttaccccccaaccccgttacccggaccccgtacccggg

SEQ ID NO: 124840 - DNA, 540 bp, Homo sapiens
  misc_feature: GYAE6OF02GVC1U.8.23.C01.1.454.CMB.1.raw
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
  modified_base (510)..(510): a, c, t, g, unknown or other
  misc_feature (510)..(510): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtggggggttcaatattggaggtaacaatgtgcactgtaccagcagaaggcaggcaggcccctgtactggtcatctagtggggatccgatccggcaggtcgggacccctgcgcgtatctctcgcctccatcgtcgggaacgcggcccaccgtgaccatcgagacaacgcccaagccggtgacgtgaggctcgtacttattttgctaggtgtgggacngcagtctagtttntcgttcgtcggacgtcggaaccgaggtccgaccgtcgtacggtcacgcccgaacgcccaacccnctcgctactctccgtcccgcctccgcaccg

SEQ ID NO: 124841 - DNA, 605 bp, Homo sapiens
  misc_feature: GYAE6OF02F2NCT.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccgatccggccaggtcgggacccctgcgcgattctctcgcctccatcgcggggaactcggccaccgcgaccatccagaccaaacgcccaacgccggtagagtcggaggctagacttagttttgcgtagggttggtgggacaggcaggtctaatttagtgttccgtcggtaccgtacgggaaccgtaagggtccaaccgtccgttacggtaccacggaccccgaaacgggacccctaaaccccgtaccgtcgtacctaccgttccgttccgttacccccgccccgttccctaccggtaaccccgg

SEQ ID NO: 124842 - DNA, 622 bp, Homo sapiens
  misc_feature: GYAE6OF02G28F0.8.23.C01.1.454.CMB.1.raw
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (601)..(601): a, c, t, g, unknown or other
  misc_feature (601)..(601): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactcctcagtgtcagtggccccgggacacgacggccaggacttacctggtggggggttcaatattggaggtaacaatgtgacagtggtaccagcagaagcgaggcaggcccctgtacgtggtacatcgtagtgggggatccgagtcccggcacgggtcgggaccctggcgcggtacttctctacgcctacgactcgacgggacgccggccacccgtnaccgtanccgagaccaaacgccaacggccgtagtacgtcgacggctagactttatttggtcgtaaggtcgtggactaggcagactagtttagtacgttccgttacggaccggtacggacctaacgggtctacccgtacgtacggtcgaaccgaccgtaaccggtacccaacccgtacgtaccgtacctaaccgttccgacccggtttaccccncccgtaccgttaccgaacccg

SEQ ID NO: 124843 - DNA, 571 bp, Homo sapiens
  misc_feature: GYAE6OF02GA1SJ.8.23.C01.1.454.CMB.1.raw
  modified_base (197)..(197): a, c, t, g, unknown or other
  misc_feature (197)..(197): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccggganagacggccaggattacctgtgggggttcaatattggaggtaacaatgtgcactggtaccagcagaaggcagggcaggcccctgtactggtcatctagtgggggatccgatccggcaggtcgggacccctgccgcgattctctgcctccatcgtcggggaacgccggccaccgtcgaccatcagccaaacgcccaagccggtagagtggaggctagacttagttttgcgtaggtgtgggacagcagtctatttagcgttcgttcggacctcgggaaccgtacggtaccaccgttacgtacggttccgacgacccgaaggaccccaaccccgactcgtacctacctcgtccgttccccaccctcctccgtaacccg

SEQ ID NO: 124844 - DNA, 763 bp, Homo sapiens
  misc_feature: GYAE6OF02I07RT.8.23.C01.1.454.CMB.1.raw
  modified_base (259)..(259): a, c, t, g, unknown or other
  misc_feature (259)..(259): n is a, c, g, or t
  modified_base (465)..(465): a, c, t, g, unknown or other
  misc_feature (465)..(465): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacaggacggccaggattaccgtggtgggggttcaatattggagtaacaatgtgcactggtaccngcagaaggcagggcacggcccctgtactggtcatctaggtggggtatccgagtccggccgagggtccgggaccccgtgccgtcgattccgtctcggccctcgacgttccggaccgggggaaccgcccgggacccctaccccgtacgaacccgtacgtacccgtaacggaacccgtaaaccgccccggtaaacgggcccggggttanaacggttaggaccgggtccgttacggtaaccgttttaggttttttcggtaccggtaaggggtttcgggtacggggaaccggtagtaccgtacggtaactttaacgttttacgttccggtttccgttaacccgggttaaccggtcgggtaaacccgttaacgggtacccgtacccggtttaccgtacgggtacccgtaccggaaccccggtaaccggacccccgtaacccgtccgttaccgtaccgttaccgttcccgtaccccggttccccggacccccttaccgtccgtaaccccgg

SEQ ID NO: 124845 - DNA, 883 bp, Homo sapiens
  misc_feature: GYAE6OF02JL90G.8.23.C01.1.454.CMB.1.raw
  modified_base (201)..(201): a, c, t, g, unknown or other
  misc_feature (201)..(201): n is a, c, g, or t
tcagctcgcgtgtccacgaccggtgctcgatttagtacacgtgattagggattggggcgtgggccgtcaggaagcagcatcgggggtgccggcagccatggcctggaccgctctccttctgagcctccttgctcactttacaggttctgtggcctcctatgagctgactcagccactcgtcagtgtcagtggccccggganagacggccaggacttacctgggttcggggggttcaagtagtttacgggaggtaacgtaagtgtagctacgtggtaccgagacgaaggaaggcagggaccgacggtcccccgttaggtaccggttaggttccgaattcccgtaaggttcgggggggtaacctacccgtaacggttccccgggcccggtaaacggggttccggggtaacccccgtgggacccggtacgggttaacttccggtccgtcggtcccctacccggtaatttcccgggtaccggggggaaacccgtcggggtaccccctacccggttacgaaccccgtaacgttcccgaaacggacccgaaaacggtacccccggaaacgggtcccggggttaacgaacggttaacggaaccgggtacttacggtacggtttttaagttttaccggtaacgttcgggtttaggtaaccgggggtactaacggtccgtaaacggtccgtttaagttttaacgttccggttttacccggttacggggttacccttaagggggaacccttaaccggggtacctaaacccggtcccggttacggtaccgtaacccggcccgtaaaccggggtacccctaaccccggtacgttacctaaccgcgttttaacccgtcccgttccccccgtaacccgttcccgtaccccgaaccgg

SEQ ID NO: 124846 - DNA, 636 bp, Homo sapiens
  misc_feature: GYAE6OF02I7KII.8.23.C01.1.454.CMB.1.raw
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (375)..(375): a, c, t, g, unknown or other
  misc_feature (375)..(375): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacaggaccggccgaggacttaccgtggtgggggggttcaagttagttgggaggtaacaatgtgcactggtaccagcagagcagggcacggcccctgtactggtcatntagtggggatccgagtccggcgacgggtcggacccctggcgcgtacttctcncgcctcacgtcgacgggacncggaccaccgtacaccctatacagaccgaaacgcccgaacgtacccggtagacgtggaacggtcttagtactttagttttggtacgtagggttcggtagggacgtagccgagtccttagtttatacgtttcgtaccggtccggtacggaacccgtaggtccgtaccgtacctacggcgtacgaacccgtaaccggacccaacccgtacctctaccgtacccgttctttcccgttacccctacccttacccgacgtaccccg

SEQ ID NO: 124847 - DNA, 641 bp, Homo sapiens
  misc_feature: GYAE6OF02G2UVD.8.23.C01.1.454.CMB.1.raw
  modified_base (624)..(624): a, c, t, g, unknown or other
  misc_feature (624)..(624): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacaggacggccaggattaccgtggttggggggttacaatagttggaggtaacaatgtgcactggtaccagcagaaggcagggcacggcccctgtactggtcactctagtggggatccgacgtcccggccgacgggtccgggacccctggccgcgtacttcctcgtcgcctccactcggtaccggggaaccgcccggacccgacccgtcgacctactcaacgaccgaaaccgcccgaacggccggtagagtcggacggtcctaggtactttagtttttcggcgtagggttgggtcggacgtcgactaggcttaacgtttagtcgttcgttccggtaccggtcgggaaccgtacgggtcctaccgtccgtaggaccacgaccccgacggacccaacccgtctacgtacctaccttccgtaccggtccccncccttccgccgtacccg

SEQ ID NO: 124848 - DNA, 681 bp, Homo sapiens
  misc_feature: GYAE6OF02HNMO7.8.23.C01.1.454.CMB.1.raw
  modified_base (199)..(199): a, c, t, g, unknown or other
  misc_feature (199)..(199): n is a, c, g, or t
  modified_base (397)..(397): a, c, t, g, unknown or other
  misc_feature (397)..(397): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagcccactctcagtgtcagtcggccccggganaggacggccaggattaccgtggtggggggttacaaagttattggaaggtaacaagtgtagctacgtggtaccagacaggaaggacgaagggccaacggtcccctagtacgtggtacagtactagttaggggactccaagtcccggacgacggtcgggaccctggccgcgatttcctctcgcctcagtcgacggggacnccggcccaccgtcgaccagtcaagaccaagacccaaggccgtagagtgacggtnacgtattacgttttnaccgagggttggtacggaactacggacaacgttcgtaactttacgtcgtttacgttaccgaccggttaaggaacccgtaacggtcctaaacccggttagttaccgggtcgaaccggtaaccccggtaaacgggtaccccaaacccgttccgtaccggtaccctacccgttccggtaaccccgtttaccccccaccgttaccgtacccgtaaccgg

SEQ ID NO: 124849 - DNA, 833 bp, Homo sapiens
  misc_feature: GYAE6OF02FGGC3.8.23.C01.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccggganacggaccggtccaagggtacttacccgtggtcggggggttcaattagttggaggtaacaatggtgcacgtggtaccagcaggtaaggcagggccacggcccctgtacctggtcagtcgtagtggggactcgacgtccggccgtagggtcgggaccccttgccgacgtacttcgtcctcgccctccacgtccgggtaccgggggaacccgcccggtaccccgtacccgcgtaacccgtaagtcccgaacgaacccgaaaccgaccccgaaaggtcccgggtaggtacgtacgggacggttacctacggttaaccgtttacgttttaccggtacggtaaggggtttcggaccgggtaacgtacggtacctacggtacgtttaaacttttacgtacggtttacccggttaccggttaacccggtaacggggttaaacccgttaaacggttaccccggtaaccccgtttaccggtaacgggttaccccgaacgggacccccggttaaaaccccggaacccccgtaaacccccgttaaaccgttcccgggtaaacccttccccgggtttaccccgtttaccccgggtttaccccccccggtaccccctttttacccgggaaccccggttaacccccggg

SEQ ID NO: 124850 - DNA, 700 bp, Homo sapiens
  misc_feature: GYAE6OF02JZ4DL.8.23.C01.1.454.CMB.1.raw
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (525)..(525): a, c, t, g, unknown or other
  misc_feature (525)..(525): n is a, c, g, or t
tcagctcgcgtgtccacgaccggtgctcgatttagtacacgtgattagggagttggggctgggcctcaggaagcagcatcgggggtgccgcagccactggcctggaccgctctccttctgagcctccttgctcactttacaggttctgtggcctcctatgagcctgactcagccactctcagtgtcaggtcggtccccggacgaggacggccgaggtataccgtggtgggggttacaagttagttggagtaacagtgtgcacgtgtacngcagagnaggcngccctgtactggacnctacgtagtcggggatccacgtcggccgagggtcgggtaccctcgcgccgtaattctccgtcgccctaccgtacgtccggtacgggggaaccgcccgggaccctacccgtacggaacctaacggtaccgaagaaccgtaaaccgaccccgtaacgggtcccgggtacgaacgttcggaggtactacgttaacgtttcgtttacggtcgtagggttcgtagggtaaccgnggaccgattacgttaagtttacgtcggtaccgttcgaccggttacgggaacccgtaaggtacccgttaacggtccgtacggtccgaccgacccggaaccgtacccaacccgtaacgttcccggaacgttccttacccggacctttacccccgtacccttaccgtccgtaacccgg

SEQ ID NO: 124851 - DNA, 735 bp, Homo sapiens
  misc_feature: GYAE6OF02HYBBA.8.23.C01.1.454.CMB.1.raw
  modified_base (198)..(198): a, c, t, g, unknown or other
  misc_feature (198)..(198): n is a, c, g, or t
  modified_base (487)..(487): a, c, t, g, unknown or other
  misc_feature (487)..(487): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctctactttacaggttctgtggcctcctatgagctgactcagccactctcagtgtcagtcggccccgganaggacggccaggtacttaccgtgggtgggggttacaatagttgggaagtaacaatgtgacacgtggtaccagcgaagaaggcgagggacacggccccttagtacgtggtacgattcgtaaggtggggtactaccgacgtcccggaccgtacgggtacccgggacccgtcggccgtacggtacgttcctcgtcgtaccctccgttacgtacccggtaccggggaaccggcccggacccgtacccgtcgacccgtataccgacgaccgaaacgccccgaagtcccgggtanagtacggagtcgtacgttactttacgttttggtacgtaaggggttcgtagggactacgacgtagacctttaagtttacgttcgttaccggtttaccgtaccgggtaccgggtaaaccggttaccggtaaccgtaacccgggttactacgggtacccgtacgaccccggtaacccggaccccctaacccggtaccgtaccgtacgtaccgttcccgtccgttaccccctaccgtcccgaccgtacccgg

SEQ ID NO: 124852 - DNA, 649 bp, Homo sapiens
  misc_feature: GYAE6OF02G1GR9.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccgggacacggacggccagggtacttacccgttggttcgggggggttcaattacgttgggaggtaacaatgtgcacgtcggtaccagcagaacggcgaggcacggcccctgtactggtcatcgtagtgggggatccgacgtccggccgagggtccggacccctggccgcgtacttctctcgcctccagtccgtacggggaacgccggcccaccgtcgaccataccacgaaccaaaccggaccccgtaacggcccgggtagacgttacgggagtccgtacgtaactttacgttttcggtacgtagggttggtacgggaaccagcgacggtactatttagtcgttcgtaccggcgtacgggacctacggtcctaaccgtcgtaggccacggtacccaacggacccaacccgacttccgtactacttccgtacccgttccctacccgtcctccgtaaccg

SEQ ID NO: 124853 - DNA, 691 bp, Homo sapiens
  misc_feature: GYAE6OF02IYZ4J.8.23.C01.1.454.CMB.1.raw
  modified_base (331)..(331): a, c, t, g, unknown or other
  misc_feature (331)..(331): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
tcagctcgcgtgtccacgaccggtgctcgatttagtacacgtgattagggagttggggctgggcctcaggaagcagcatcggggtgccgcagccatggcctggaccgctctccttctgagcctccttgctcactttacaggttctgtggcctcctatgagctgactcagcctactcctcagtcgtcgaggtccgggccccgggacacggaccggccgaacggtacttaccgtgggttgggggttactaagttagttagggaacgtaactaagtcggtacgcgtacgtacggtaccagacgacggtaaggcgaggccgacggccctgtacgngtactactcgtagtcgggactaccacgtccgacgtacgggccggtaccgtcgacgtcgtcgttccgtcgtcgtccctcgtacgttcgggtaccggggaacccgtccggacctaccgttacgaaccgtaacgtccgaaccgaacgaaaccgtcccgacgggtacccggaagtacggtacgcggtaccttagtacttttacgttcgtacgtagggttcgtacgggacacgtnaacggtnttacgtttgtaccgttgtaccgtccgagggtaacgtcgtcgaacccgtttgaaccgttcgaacgcccgacgtaaccgccacgtctccggacttcccgtaccttcccgacccgtcgtaccgccg

SEQ ID NO: 124854 - DNA, 716 bp, Homo sapiens
  misc_feature: GYAE6OF02HYY3B.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccgggacaggaccggccgaggacttaccgtgggttgggggttcaagtagttgggaaggtaacaagtgtgacacgtcggtaccagcaaggaaggcgagggcacggcccctgtacgtggtcatcgtaggtcgggggtactccgacgtcccggaccgacggggtccgggaccccgtggccgtaccgtactttccgtcgtccgccctccgtacgttccggtaccgggggaacccgcccggacccaacccgtacgaaccctacgtaccgacgaaccgaaaccggcccgaacggtccggtagtacgtggacggtctacggttacttaggtttttcgacggtaggttcggtggacgagcgtagtacgttaagtttagtcggttaccgttaccgggaccggtacgggaaccgtacggtaccaccggttaccgtacggtaccgaccggacccgaaccggacccccgaacccgtcgtaccgtaccgtaccttcccggttcccggtaccccctcccgttacccgtccgtacccgg

SEQ ID NO: 124855 - DNA, 851 bp, Homo sapiens
  misc_feature: GYAE6OF02H156Q.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcacgccactctcagtcgtcgagtccgggaccccgggacaggaccggccgaacggtacttaccgtgggttcggggggttacaagttagttagggaacggtaaacgtaagtggtagactacgtacggtaccagtcgaaggaaggtacgacgggaccgacggtacccctaggtacgtcggttactaagtccgtaaggtcggggtaactacccgtacgtcccggccggtaacgggtaccggggacccctgggaccggtaccgtacgttccgtacgttccggaccctaccgttacgtaccgggtaccggggaaccgtcccgggaccccacccgggttaccgaaccgtacgtccgtaaacgacccgtaaaccggtcccggaaacggtccgggtaacggtaacgtacgggaccggttacgtacggtttaactttaacggttttggaacgtgggttacggtaccgggacgacggacgtacgtaacgtttacgtttatccggtttaccgtttaccggggacccgtttaacggggtaaaccgtaaccggttaccgaccccggtttacgtaccgggtacccgtaccggaaccccggtaaccggtaaccccgtaaccccgtagtttaccccggaccttaccccggttccgttacccccggttaacccccggtcccttacccggtaccgaaccccggg

SEQ ID NO: 124856 - DNA, 754 bp, Homo sapiens
  misc_feature: GYAE6OF02HQHGE.8.23.C01.1.454.CMB.1.raw
tcagctcgcgtgtccacgaccggtgctcgatttagtacacgtgattagggattgggctgggcctcaggaagcagcatcggggtgcgcagccatggcctggaccgctctccttctgagcctccttgctcactttacaggttctgtggcctcctatgagctgactcagccactctcagtgtcagtggccccggacagacggccaggattacctgtgggggttcaatagtggaggtaacaatgtgcactggtaccagcagaggcgaggcacggccctgtactggtcatcgtagtggggtatccgagtccggccgacgggtcggacccctgccgtccgtacttctactgccctaccacgttccgtacggggacgccggcccacccgtcgaacctactcacgacgaaaccggaccctaacggccgggtacgtacgtagggaacggtcgttacgtaaccgtttacgttttttggaaccgttaggggttaggttagggaaccgtacgccgtaacggtacttaacgttttacgttacggttttacccggttaccgggtaacccgttacggggtaaccccgtaaggggtttaccccgtaacccggtttacccggttaacgggtaccccgtaacccgggaacccccggaaaccggtacccccgtaaacccccgtaccgtttcccggttaacccttaaccccggtttcccgtttacccgttttaacccccccgtacccccgtttacccgtacccggtaaccccgg

SEQ ID NO: 124857 - DNA, 704 bp, Homo sapiens
  misc_feature: GYAE6OF02FIPPO.8.23.C01.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtacacgtgattagggattggggctgggcctcaggaagcagcagtcgggggtgccgcagccatggcctggaccgctctccttctgagcctccttgctcactttacaggttctgtggcctcctatgagctgactcagccactctcagtgtcagtcggccccggganacggacggccaggacttaccgtggtcgggggttcaagttataggaggtaacaatgtgcacgtggtaccagcagaaggcgagggcacggcccctaggtactggtcagtcgtagtggggactccgagtccggcgagggtcggaccctggcgcgtattccgtcgtcgtaccctccgtacgtccggtaccggggaaacctccggacccgtacccgtacgaacccgtactaaccgacgaaccgaaaacgcccgtaaacggtccggtacgtagtcgggaacggtcctaggttaaccgtttaagtttttcggaccgttaggggttacgaggggtacagggacctaaggtacttattttacgtcgtttaccgttccgggtaaccgttcggggtaaaccgtaacggttaccctaccggtaccgttacgggttccaaccggtacccgtaacgggacccaacccgtactccgtacgtacccgtccgttccgtaccccgtccctccgagtaacccgg

SEQ ID NO: 124858 - DNA, 853 bp, Homo sapiens
  misc_feature: GYAE6OF02GZJVK.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggacttaccgtgggtgggggttcaagttagtggaggtaacagtagtgcactggtaccagcgaggaagggaggcacggtccccgtgtacgtggtacatctaggtgggggtactccgacgtcccgggaccgtacgggtccgggtaccccgtggaccggtacgtacgtttcctccgtcgtcccctccgacgttcccgggtaccgggggaaccggcccgggtaccccgtaaccccgtacgaccccgtagttaccgacggtaacccgaaaccgtacccccgtaacgggtacccggtaggtaacgtacgggaccggtacgtacgttaaacgttttacgtttttacgggtaccggtagggggttcggttaacggggtaccctaaacgggtccgtaacgggttaccttaacgtttttacgttccgggtttacccggtttacccgggtaacccgggttaccgggtaacccggtaacgggttacccggtaacccggttccgtaaccgggtaaccgtaacccgaccccgggttaaacccggacccccctaaacccccgtacggttcccggttaccccgtaaccgtttaccccggtttcccccggtttaccccccgttcccccgtttacccccggtacccgtaacccgtaaccccgggg

SEQ ID NO: 124859 - DNA, 700 bp, Homo sapiens
  misc_feature: GYAE6OF02JBKG0.8.23.C01.1.454.CMB.1.raw
  modified_base (634)..(634): a, c, t, g, unknown or other
  misc_feature (634)..(634): n is a, c, g, or t
  modified_base (640)..(640): a, c, t, g, unknown or other
  misc_feature (640)..(640): n is a, c, g, or t
  modified_base (650)..(650): a, c, t, g, unknown or other
  misc_feature (650)..(650): n is a, c, g, or t
  modified_base (691)..(691): a, c, t, g, unknown or other
  misc_feature (691)..(691): n is a, c, g, or t
tcagctcgcgtgtccacgaccggtgctcgatttagtacacgtgattagggattggggctgggcctcaggaagcagcatcgggggtgccgcagtcatggcctggaccgctctccttctgacgcctccttgctcatttacaggttctggtcggcctcctatgagcgtgactcattccacttctcagtgtcacggtcggaccccgggacaggaccggccaaggtacttaccgtgggtacgggggttactaagttagttagggaaggtaacaagtggtagcgaacgttgggtaccagaccgaggaacggacggtaaggggaccgacggtaccccgtagttaccgtcgtcgagtacggtaaggcgggggtactccgacggtacccggcgacgggtcggaccccgtggaccgtacggtacttccgttccgaccgtcctacccgtacgtccggggacgggtaacccgtccggaccccgtaccgacggtaccgtaactccggaacgtaaccgaacccggtaaccgaccggtaccggacgtacgtacggtcgtacgtacgttacgtttacgtttcggacgtcgggtagtacggacgagacgtgtactagttctgtcgtcgacgtcgtacgacggcctacggtntaccgnccgaaccgtnacccacgtatccggctacgtccgtcccgtccgaccccgtanccgtaaccg

SEQ ID NO: 124860 - DNA, 651 bp, Homo sapiens
  misc_feature: GYAE6OF02FYI4I.8.23.C01.1.454.CMB.1.raw
  modified_base (475)..(475): a, c, t, g, unknown or other
  misc_feature (475)..(475): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccgggacagacggccaggattaccgtggtgggggttcaatagttggaggtaaacatgtgcactggtaccagcagaagcgaggcacggcccctgtactgcatctagtggggactccgagtccggacgaggtccgggaccctggcgtcgattcctctcgcctacatccggtacggggacgcccggaccacccgtcgaaccagtaccgagacaaaccgcccaacggccggtactagtacggacggtcgtagtactttacgtttgtagttacggtaggtcggggaacnggactagtacttaatttacgtacgttaccggttaccggtaccgtaccgggtaaccgtaacggttcccgaaccgttaccgttaacggtaccaccgacccgtaaccgaccccgtaaccccacgttaccgaccttaccttccctaccggttcccccctaccccgttccgcgtaacccgg

SEQ ID NO: 124861 - DNA, 736 bp, Homo sapiens
  misc_feature: GYAE6OF02JF23A.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggatacctggtgggggttcaatagttggaggtaacaatgtgcactggtacagcgagaaggcgagggcacggcccctgtactggtcatcgtagtggggatccgacgtccggcgaggtcggacccctgcgcgtattctctcgcctccaatccggtaccgggggaaccgccggacccacccgttcgaaccctacgtaccgacgacgtaaaccgacccgaacggcccggtagagtacggacggtcgtacggtatttaggtttttacgtaccgtaggggttacggtacgggtaacgacggtacgtaacgtaccttaagtttttactacgggtttaccctttaccgggggtaacccgtacggggtaacccggtaaacgggttaccccgtaaccccgggttaccgttaccgggtacccgaccggtaaccccggtaacccggtacccccgtaaacccccgtccgttacgttaccccgtacccgtttaccgttacccggttacccccctaccccgtttaccccgtaccggtaaccccgg

SEQ ID NO: 124862 - DNA, 745 bp, Homo sapiens
  misc_feature: GYAE6OF02IAILK.8.23.C01.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (381)..(381): a, c, t, g, unknown or other
  misc_feature (381)..(381): n is a, c, g, or t
  modified_base (733)..(733): a, c, t, g, unknown or other
  misc_feature (733)..(733): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccggganaggaccggccaggacttaccgtgggtcggggggttacaagttagttagggaaggtaactaagttggtgaccgtaacgtcggtaaccaganaacggaaggcgacgggtacacgggaccctaggtacgtggtacatacgtaggtacggggtactccgacgtccgcgtaagggtcccgggtaccnggtccgacgtacttctccgtcggacctcctaggccgtacggggtaccgcccggtacccgaccgtggaaccctacgtacgacgaacgaaccgacccgaggtccggtagacgtaggacgtcgtacgttacgtttacgttttggacgttagggttcgggtacggagtacgtacccgtaggtaccgtttaagtttaaggttcgttacccggttacgggtacccgtcggggtaaactaccgggtacctaccggttacgaaccgggtacaaccgggacccgtacccggaaccctaccccggtagttacccgaccgtttacctaccgggttaccccgttccccgtcccggttaaccccnggtaaccccggg

SEQ ID NO: 124863 - DNA, 606 bp, Homo sapiens
  misc_feature: GYAE6OF02FSEYP.8.23.C01.1.454.CMB.1.raw
  modified_base (198)..(198): a, c, t, g, unknown or other
  misc_feature (198)..(198): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
tcagctcgcgtgtccacgaccggtgctcgatttagtacacgtgattagggattgggggctgggcctcaggaagcagcatcgggggtgccgcagccatggcctggaccgctctccttctgagcctccttgctcactttacaggttctgtggcctcctatgagctgactcagccactctcagtgtcagtcggccccgganagacggccaggattaccgtggtgggggttacaatattggaggtaacaagtgtgcacgtggtaccagcagaaggcagggcacggccccttgtactggtcatcgtagtgggggactccgaacgtcccggccgagggtccgggaccccgtgccgcgtacttctctcgccctcactcggtcgggaccnccggccnccagaccatcacgacaacgcccaggtaccgtgagtcgaggctagtctttactttgcgtaggttggtggactgcgtagtacttatttacgttcgttcgttaccggtaccgtggaaccgtaacgcgtaccgtccgtacgtacgaccgacccgaacggaccccaaccccgacgttccgactaccgttcctcgttacccccgtacctacccgccgaacccg

SEQ ID NO: 124864 - DNA, 846 bp, Homo sapiens
  misc_feature: GYAE6OF02HKH6T.8.23.C01.1.454.CMB.1.raw
  modified_base (201)..(201): a, c, t, g, unknown or other
  misc_feature (201)..(201): n is a, c, g, or t
tcagctcgcgtgtccacgaccggtgctcgatttagtacacgtgattagggagttggggctgggcctcaggaagtcagcatcggggtgccgcagccatggcctggaccgctctccttctgagcctctgctctactttacaggttctgtggcctctatcgagctgactcagtccactctctagtgtcaggtcggaccccgganacgacggtccaggacgttaccgtggtcggggggttacaaagttagttagggtaacggtaaacctaaagtacggttcgtacgacgttacggttacccgaagtacggaacggaaaggcgtaacgggaccaacggcccctggtaacgtcggttactaacgttcgtaaggtcgggggtactaccgtaacgcccggaccgtacggggtcccgggtacccctggacccgtcggtaactttccgtcgtcgccctccgtacgtcggtaccggggaaccgtaccgggtccctaacccgtggtaacccctagtaccctacggaacctaaaccggaccccgtaagggtacccgggtacgtaacggtacggtaacgggacttacggtaacgtttaggttttaccggaacgttacgggtcggttaaccgggaccgtaggtaccaggttaccttaacgtttagttccggttacgtacccgggtaccggttacgggaaacccgttacggttacccgaacccgttaccggttacggtacccgtaaccggaccccgtaaaccgggtaacccctaaacccggttccgtacccggttaaccgttaccccgttaacgttccccgtttaacccccgtaccccgttaccccgtttacccggaacccg

SEQ ID NO: 124865 - DNA, 727 bp, Homo sapiens
  misc_feature: GYAE6OF02J0FI7.8.23.C01.1.454.CMB.1.raw
tcagctcgcgtgtccacgaccggtgctcgatttagtacacgtgattaggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagaccggaccagggacttaaccctggtcggggggttccaattagttgggaaggttaacaaagttcgtagcacgtggtaccagcagaacggcaagggcaacggcccctggtacctggtctagtctaacggtggggacttcccaagtcccggaccgagggtaccgggccccgtggccgtccgattccgtcttcggaccctccgaacgtccgttaccgggggaacgtccggacccctaccgtacgaccctaacgccgtaagacccaaacgggcccaaacggtcccgggtagaacgttacggaacggtccgtacggtaacctttacgtttttacggaaccggttacgggttacggttggggaaccgtacggtacgtaacgtcccggttaagtttacgtacgggttccgttaccgggtaccggtaacggaaccgtaacggtccaacggttaccgtacggtccgacgacccgtaacggacccacccgtacgtcgtcctacgtaccgttccgtaccccgtccctaccgtcctaaccgg

SEQ ID NO: 124866 - DNA, 760 bp, Homo sapiens
  misc_feature: GYAE6OF02IGE56.8.23.C01.1.454.CMB.1.raw
  modified_base (200)..(200): a, c, t, g, unknown or other
  misc_feature (200)..(200): n is a, c, g, or t
  modified_base (330)..(330): a, c, t, g, unknown or other
  misc_feature (330)..(330): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctcttgctcactttacaggttctgtggcctcctatgagctgactcacgccactctacagtgtcaggtcggaccccgganacggacgccgaggactttaccgtgggttcggggggttacaagttagttggggaagtaaacaagttgtgaccacgtacggtaccagtcaaggaaggcgagggctaaccggccctgtactggtcatcgtagnggggtactacgacgccggacgtggccggtaccngcgtctacttcgtcgtacgtcctacncgtccgggacggggactcccggaccctacctacgacctactaccgacgaaacgaaccgaccgaacggtcggtaagccgtaggacgtcgtaacgttactttacggttttcgaggtacgggtttacgggacggaactaacgggtcaacgggttacctttaagttttaaccgggtcgttaaccggttaaccggtaccggtaacgggtaacccgtaaccgggttacccggttaccgttaccgggtaaccggttacccgaaacccggacccggtaaacccggaaccccgtaacccgttacggtaaccctccgttaacccgttccgtttacccccgtaaccccctttaccccgttacccggaacccgtaacccgggg

SEQ ID NO: 124867 - DNA, 712 bp, Homo sapiens
  misc_feature: GYAE6OF02I807E.8.23.C01.1.454.CMB.1.raw
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
tcagctcgcgtgtccacgaccggtgctcgatttagtacacgtgattagggattggggctgggcctaaggaagcagcatcgggggtgccgcagccatggcctggaccgctctccttctgagccctccttgctcactttacaggtttctgtggcctcctatgagctgactcagccactctcagtgtcgagtcgggccccggacgaggaccggccaggtacttaccgtgggttcggggggttactaagttagttagggaacggtaaacaagttgtagactacgtacggtaccaggcgaaggaacggcgacgggcacggccccgtgtacctggtactatcggtaggtggggactccgacgtcccggacgacggggtcggcccctggcgcgtnttcctcgtcgcctacncgtcggtacggggaccgccggacccaccgtcgacctacgtacgaacgaaccaacgacccgaacggcggtagacggtcggacgtcgttgttaacgtttgtttacggtcggtagggtcggtacggacgtgacctacgtactagtttagttcgttacgtccggtaccgtaccgggtaacgtaccggtccgtacccgttacgtacggaccgtaccggacccgtaacccggcccctaaccccgtacgtccggttaccgtacctttacccggtcccgttacccccacccgttaccggtacggaccgtacccggg

SEQ ID NO: 124868 - DNA, 649 bp, Homo sapiens
  misc_feature: GYAE6OF02HWXF5.8.23.C01.1.454.CMB.1.raw
  modified_base (305)..(305): a, c, t, g, unknown or other
  misc_feature (305)..(305): n is a, c, g, or t
  modified_base (392)..(392): a, c, t, g, unknown or other
  misc_feature (392)..(392): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggccccggaacagacggccaggattaccgtggtgggggttacaatagttggaaggtaacaatgtgcactgtaccagcgaagaaggcgaggcgacggcccctgtacgtgtcatcgtagngggggtactccgacgtccggcgacgggtcgggaccccgtggcgcgacttctctcgcctccatccgtacggggaccgccggccacccngaccatcgacgaccaaacgccgtaagtcggtagagtgaggtctagttaactttagttttacggtcgtaggttggttacgggacgtagacgtacgacgttatttacgtcgttaccggttaccggtacgtacgggtaaccgtaacgggttaccgacccgttaccgtacggtaccgtaccggtacccgtaaaccggccccaaacccgtcgttaccgtacctaccgtcgtaccgttcccccgtacctcccgtaccgtaccg

SEQ ID NO: 124869 - DNA, 675 bp, Homo sapiens
  misc_feature: GYAE6OF02GTF5Y.8.23.C01.1.454.CMB.1.raw
  modified_base (398)..(398): a, c, t, g, unknown or other
  misc_feature (398)..(398): n is a, c, g, or t
  modified_base (534)..(534): a, c, t, g, unknown or other
  misc_feature (534)..(534): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagcccactcctcagtgtcaggtcggccccgggacacggaccggccaggtacttaccgtgggttggggggttcaagtacgttagggaggtaacaagtggtcgacacgtggtaccagacaggaaggcgacgggcgacggccccgtgtacgtggtacactcgtaggtcgggggtctaccgacgtcccggacgtacgggtccgggtaccccgtggccgcgtacgttctccgtccnccctccgagtccggtccggggaacggtcccggccctacccgtacgacccactccgaagaccgaaacgccccgaaggccggtagagtggacggcgtagtacgtttacttttcggacggttagggttggtcgggacgngacgactacttagtttacgtcggtttaccgtcggtaccggtcggaaccgacgtccgtaccgtcgtacgccgtaccgacccgtaacgacccacccgtcgttcgaccctccgtcgtacccgtcccctacctccgaccgtaccg

SEQ ID NO: 124870 - DNA, 672 bp, Homo sapiens
  misc_feature: GYAE6OF02HWLH0.8.23.C01.1.454.CMB.1.raw
  modified_base (470)..(470): a, c, t, g, unknown or other
  misc_feature (470)..(470): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggcccggacagacggccaggtattaccgtggtggggggttcaagtagttggaggtaacatgtgctactggtaccagcgaagaaggcgagggcgacggcccctgttacgtggtcatcgtaggcgggggtactccgagtccggcgaccgggtcgggaccccgtggccgacgtacgttcctcgtcgtcccgtacacgtcggccggggaccgcccgcctacccgacgacctacgtacacgaccgaaacgacccgaacggccggtagacgtggaggtctgttacgttntttttacggagtagggttacggtcgggacgcgtacgtacgtacttagtttacgttcgttccgttaccggacgttaccgggaaccgttaacggtcctacccggttacgacggtacccgaccggacccggaacccgacccaaaccccgtcgttacccgacgttaccttccggttcccgttccccgcccttcccgaccgtacccg

SEQ ID NO: 124871 - DNA, 886 bp, Homo sapiens
  misc_feature: GYAE6OF02HV9BM.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctcctgctcactttacaggttctgtcggcctcctatgagctgactcacgccactctcagtgtcgagtcggccccgggacgaggaccggccgaggtacttaccgtggttcggggggttcaaattagttagggtaacggttaaacaagttagtgacctaccgtacggtaccagcgaaggtaacggacggacgggaccgacgggccccttacggtaccgtggtacctacgttcgtaaggtcgggggtactacccgaggtccccgggaccgtacgggtccgggaccccgtcgccgtccggtatttccgtcgttccgtccgtccgtaagtttcccggtaccggggaaccgccccgggaccctaccccgtacgaacccgtacgtaccgaaacggacccaaaacccggaccctaaacgggacccggtaggtacgtaggggacggtacgtttacgttaactttaggttttttacggacggttaaagggttcggggtaccggggtaaccgtacgggtaccgtaaggtaccgttttaaagttttaccgggttacggttttaccccggtttaccgggtaaccggggtttaccggaaacccggttaccgggttaccccggtaacccgtttcccggttaacgggttacccgaacccgtaaccccgggaacccgtaacccccggtaaaccccttaccgttaacccggttacccgtttacccttcccggtttacccccgtttaccccccgaacccccgttcccgtacccggtaaccccgg

SEQ ID NO: 124872 - DNA, 724 bp, Homo sapiens
  misc_feature: GYAE6OF02JY9Q9.8.23.C01.1.454.CMB.1.raw
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcaggtcggccccggacaggaccggccaggtacttaccgtgggttcggggggtttacaaagttagttagggaacggttaaacaagtgtgacctacgtggtaccagcaggaacggcgacgggcacgggtcccctgtacgtggtcattcgtaggtggggactccgaacgttcccggaccgtaacggggtccgggaaccccgttggaccggtccggttacgtttcccttcgtcggcccttccgtacgttccggtaccgggggaaccgccggccctaacccgtcggaacctactccgacgaaccaaacggcccgtaacggtccggtagactgggacgcgttacgtactttacggttttcgacggtaggttcggtacgggtactacgacgtcgtacgttagtttacgtcgttcgttaccggtaccggtcgggaaccctaggtcccgtacgttaccgtggttaccgaccgtaccgtaacccggtaccccaaccgtccgtacgtacctaccgttaccgttccgtacccctacccgttccgtaccgacccg

SEQ ID NO: 124873 - DNA, 710 bp, Homo sapiens
  misc_feature: GYAE6OF02F30HE.8.23.C01.1.454.CMB.1.raw
  modified_base (199)..(199): a, c, t, g, unknown or other
  misc_feature (199)..(199): n is a, c, g, or t
  modified_base (475)..(475): a, c, t, g, unknown or other
  misc_feature (475)..(475): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtcggcccccggganacggaccggccaggattaccctggtggggggttcaatattggaggtaacatgtgcactggtaccagacagaggcagggcaggcccctgtactggtcatctagtagggggactccgatcccgggacgtacgggtcgggaacccccgtggcggtccgtacgtttcctccgtaccgccctacccgtacgtccggtccgggggtaaccgacccgggtcccaaccccgttggaaccctaactcgaaaccggaaccaaaccgcccgaacggtacccgggtanacgtcgggaacggccttacggtacgtttaagttttcggtacgaacggggtttggtacggggtaccgtaaggctaggtccttaagttttacgttgttccgttaccgggtaaccgtgggaacccgtaaggtccggtaacccgtcggtaccgcgtaccaccccggtaaggacccccaaccccgtacgttaccgcctacgttccttcccgtaccccctaccccgttcccaccgtacccg

SEQ ID NO: 124874 - DNA, 763 bp, Homo sapiens
  misc_feature: GYAE6OF02HO0V3.8.23.C01.1.454.CMB.1.raw
  modified_base (142)..(142): a, c, t, g, unknown or other
  misc_feature (142)..(142): n is a, c, g, or t
  modified_base (337)..(337): a, c, t, g, unknown or other
  misc_feature (337)..(337): n is a, c, g, or t
tcagctcgcgtgtccacgaccggtgctcgatttagtacacgtgattagggattggggctgggcctcaggaagcagcagtcgggggtcgccgcagccatggcctggaccgctctccttctgagcctcttcgctctactttacnggttctgtcggtcctcctatcgagtctgtactcacgtcctacctctctacgttcgtctacggtccgggtacccgggaacgaacggaccggtaccgaacggtacttaccggtgggtacggggggttactaagttagtagggacgtaaacgtagtgtacgcgtacgtcgtaacgacgcgtaaggacgagacggtacncggacccgtgtacgtggtactagtcgtaggcggtaacgtccgtaccgtaccgtccggtacggtaccgggtaccggtaccgtcggtccgtacgttacgtccgtcgtaccgtccgtaccgtcggtaccgggtaccggaccgtaccgacccgtacgtaaccacgtacgaccgtaacgaaccgtaacccgtacggtaccgggttaacgaggttaccgaggttacgtacgtttacgttagtttaaccggttcgtaacgggtgggtaccgtacggtactacgtacgttaacgttagttacgtccgttaccggtacgtacgtaacggtccgtaacgtcccgtacgtacgtccgtagtcccgaacggtaacccgacgaccctacgtaccgttcgtaccgttaccgtccgttaccccgtcgtaccgtccgtaccg

SEQ ID NO: 124875 - DNA, 817 bp, Homo sapiens
  misc_feature: GYAE6OF02FX5E2.8.23.C01.1.454.CMB.1.raw
  modified_base (183)..(183): a, c, t, g, unknown or other
  misc_feature (183)..(183): n is a, c, g, or t
  modified_base (206)..(206): a, c, t, g, unknown or other
  misc_feature (206)..(206): n is a, c, g, or t
  modified_base (495)..(495): a, c, t, g, unknown or other
  misc_feature (495)..(495): n is a, c, g, or t
tcagctcgcgtgtccacgaccggtgctcgatttagtacacgtgattagggattgggggctgggcctcaggaagcagcagtcggggggtgccgcagccatggcctggaccgctctccttctgagcctccttgctcactttacaggttctgtcggcctctagtgagctagactcacgccactctntagtgtcaggtcgggccccgganacggacggcaggtacttaccgtgggttcgggggttacaagttacgttaggtaaggtaacgtaagtggtcgtacacggtacggtaaccaggacgtaacggtaacggcggacgggactaccggtccccgttaggtacgtggtacctacgttacgttagggttacgggggtaacctccgtaacggtacccggggtacggtaacggggcccggtaaccccgttggaccggttaccggttacttccgttacgtaccggtacccttacgacggtttaccgggaccgggggaaccncccggtacccgtacccgtaaccggaccctacgaaccgtacggaaacccgaacggtacccgtaacggtacccggtagtaggacggttaaccggcgttacggttaaccttttacgttttacgacgggttacgggtcgggtacgtaacgtcgactacgggttacttaagttccgtacgggtttccaccgggttacgtacggttacgaaccggttccaccgggtttacaacggtcccgaacgaaccccggtaacgtaccctaaacccggcttacgttacccgtacgttacccttcccggttaccccgacccggttcaaccggtccg

SEQ ID NO: 124876 - DNA, 816 bp, Homo sapiens
  misc_feature: GYAE6OF02GQA6U.8.23.C01.1.454.CMB.1.raw
  modified_base (184)..(184): a, c, t, g, unknown or other
  misc_feature (184)..(184): n is a, c, g, or t
  modified_base (567)..(567): a, c, t, g, unknown or other
  misc_feature (567)..(567): n is a, c, g, or t
tcagctcgcgtgtccacgaccggtgctcgatttagtacacgtgattagggattggggctgggcctcaggaagcagcatcggggggtgccgcagccatggcctggaccgctctccttctgagcctccttgctcactttacaggttctgtggcctcctatgagctgactcagccactctcagtgtnagtggccccgggacacgacggccaggtacttacccgtggtcggggggttccaaagttacgttgggaaggtaaacctaagtgttgctacgtcggtaccagcagaaggcgagggcacggccccgtgtactcggtacctagtctagtggggtactccgacgtccggaccacgggtccgggacccgtgccgcgtacttcgtcctacgcctccgatccggtacgggaaccgccggccctacccgtacgaccgtactacgaacgaccgtaaaccgacccgaacggtccggagtacgtaacgggtacgggtccttacggtacttttaacgtttttccggacgggttaacgggttcgggtaccgggggtaactccgggaccgttaacggtntttaacgttttataccgggtttcgtttacccggggaaccgtttaccggggtaaacccgttaaccgggttaccctaacccggggttaacccgttccgggtacccgttaacccgggacccccggttaaaacccgggaaccccccgttaaaacccccgttccggttaaccgtttacccgaaccccgttttaccgtttcccccccgttaacccccgttaacccccgggttacccgttacccggaacccccggg

SEQ ID NO: 124877 - DNA, 876 bp, Homo sapiens
  misc_feature: GYAE6OF02HMVU7.8.23.C01.1.454.CMB.1.raw
  modified_base (274)..(274): a, c, t, g, unknown or other
  misc_feature (274)..(274): n is a, c, g, or t
tcagctcgcgtgtccacgaccggtgctcgatttagtacacgtgattagggattggggctcgggcctcaggaagcagcatcgggggtgccgcagccatggcctggaccgctctccttctgagcctccttgctcactttacaggttctgtggcctcctatgagctgactcagccactctcagtgtcgaggtcgggccccggacacggacggaccgaggtacttaccgtgggtacggggggttacaattagttagggtaacggtaactaagttggtnacctacgtcggtaaccagacgaaggaacggtcgacggggccgtaccggtaccccgtaggttaccgtacggtacgtagttaccgtaggtggggtactaccgtaccggtcccgggaccggtacgggtccggtacccgtggaccgtacgtactaccgtcgttaccgtcccgttaccgtaacggttcccgggtaaccggggaacccggtcccggtaaccccgtacccgtaccggtaaacccgtaaccgttaccggaaacccggtaaacccgaaacccggtaccccccgggaaaagggtccccgggtaacggtaccggtaacgggtaccgggttaccgtttaacggtttaaccgttttaggttttccgggtaaccggttagggggttaacggtacggggtaacgtaacggtccgtaacggtccgtttaaacgtttcgttaccggtttaccgggttaaccggtaaccggttacgggaaacccgttaacggtacccggttaaccgggtacgttaccgggtaccgtaacccgtacccgaaaccggaccccgtaccgtaccgttccggtaccgtcgttcccgttacccgtccggtccctaccgcgtaaccg

SEQ ID NO: 124878 - DNA, 831 bp, Homo sapiens
  misc_feature: GYAE6OF02JKYZH.8.23.C01.1.454.CMB.1.raw
  modified_base (176)..(176): a, c, t, g, unknown or other
  misc_feature (176)..(176): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtgcctcctatcgagctgactcagccactcncagtcgtcaggtccggaccccgggacacggaccggccgtaaggtactttaccgtgggggttagggggtttaccaaagttagttagggaacggttaaaccaagtggtacgactacgttagaaccgagacgaaggaaggtcggacgggtacgacgggtaccccttggtaccgtcggtctacgtacggtagggtcggggactccgacggtccggaccggtacggggtaccggtacccgcggtaccgacgttacgttcctcggtacctcccgtcctaccgttacgggtacccgggaaccggtccccgacccgtaacccgtcgtaacccgtgtaaccgacccgaaaccggaacccggaccccggtaacggttaccgggtaacgacgggttaacggaccggttcgttacgtttaacggtttacggttttcggtacgggtaacggttccgggtagggtaaccggacgtaccgtaactaacggtttaagttttccggtacgtttaaccgggttccgggtaacgggtaccggtaccggttaaaccggtccgttaacccgggttacgaccgggttaccgtaccggaccggaacccgtaaccctaccgtacgtaccggtcctacccgttccgtaccccgttaccccgtccttaccgccgtacccgg

SEQ ID NO: 124879 - DNA, 595 bp, Homo sapiens
  misc_feature: GYAE6OF02G5K6R.8.23.C01.1.454.CMB.1.raw
  modified_base (439)..(439): a, c, t, g, unknown or other
  misc_feature (439)..(439): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctagtgggggatccgaagtccggccaggtcgggacccctgcgcgattctctcgcctcactcgtcgggacgcggccaccctgaccatcagcaaacgcccaagccggtagagtgaggctgacttacgtttttgtcgagggttgtgggacnggcgagtctatttagtcgttcgttcggaccgtcgggaccgtaacggtccgtaccgtaccgttaggtaccacggaccccgaacggcccaaaccccgtaaccgtacgttaccgacttccgttccggttaccccccgcccgttccccgtcggtaacccg

SEQ ID NO: 124880 - DNA, 809 bp, Homo sapiens
  misc_feature: GYAE6OF02GHQJS.8.23.C01.1.454.CMB.1.raw
  modified_base (426)..(426): a, c, t, g, unknown or other
  misc_feature (426)..(426): n is a, c, g, or t
tcagctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcacgccactctcagtgtcaggtcggccccgggacgacgaccggccaggtacttaccgtgggttaggggggttactaaagttagttagggaaggtaaactaagtggtacgtactacgtacggtaccagacgaaggaacggcggacgggcgaccggtcccgtaggtacgtcggtacagtcgtagggtcgggggtactaccgtacggtcccgggaccggtacgggtccgggtaccccgtggaccgtcgtacttcctccgtccncctccacgtaccgggaccgggtaccggcccgacccgtaccgacgaaccgtactacgaacgaaccgaaccggtacccgaacgggtccgggtacgtacggtaacggtacgggtccttaacgtttacgtttaacggttttcgggtcggtaacgggttgggacgggttaacgcggtaacgtacgttacgtttacgtttacggttaccgttacccggttacgggtaccgtacgggttaaaccgtaccgttcccggtaacccgttacgggtacggtaccgtaacccggaacccgaacccggtaccccaaacccggtcggttacccgttacccttaccggttcccgtttacccccgggtccctaccccggttacccgacccggtacccgg

SEQ ID NO: 124881 - DNA, 505 bp, Homo sapiens
  misc_feature: GYAE6OF01BUA1K.9.39.D06.1.454.CMB.1.raw
  modified_base (203)..(203): a, c, t, g, unknown or other
  misc_feature (203)..(203): n is a, c, g, or t
  modified_base (322)..(322): a, c, t, g, unknown or other
  misc_feature (322)..(322): n is a, c, g, or t
tcagtgatacgtctcacgaccggtgctcgatttagtgacatctcgcagttctttggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtntcccagccaggttcagtgggagtggtctgggacagagttcactctcaccatcagcagtctgcagtcgaagattttgcagtttacattgtcagcagtatagtaacgggccgctcactttcggcggagggaccaagggtcggagagtcgaaacgactggtacggctggcaccatctgtcttctac

SEQ ID NO: 124882 - DNA, 501 bp, Homo sapiens
  misc_feature: GYAE6OF01B6OB9.9.39.D06.1.454.CMB.1.raw
  modified_base (204)..(204): a, c, t, g, unknown or other
  misc_feature (204)..(204): n is a, c, g, or t
  modified_base (498)..(498): a, c, t, g, unknown or other
  misc_feature (498)..(498): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtcgtccagccaggttcagtgggagtgggtctgggacagagttcactctcaccatcagcagtctgcagtcggaagtattttgctagtttactattgtcagcagtataggtaacggccgctcacgtttcggcggagggaccaggtggagatacgaaagactggtgctgcacatctgtctntac

SEQ ID NO: 124883 - DNA, 504 bp, Homo sapiens
  misc_feature: GYAE6OF01EFTWG.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (502)..(502): a, c, t, g, unknown or other
  misc_feature (502)..(502): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttagcctggcaccagcaaaaacctggccagcctcccaggctcctcatctatgatgcatccaccaggaccactggtgtccccagcccaggttcagtgggagtgggtctgggacagagttcactctcaccatcagcagtctgcagtcggaagtattttgctagtttactattgtcagtcagtatagtaacgggccgctcacgtttcggcggagggaccaagggtggagatcgaaagactgtggctgcacatctgtctnac

SEQ ID NO: 124884 - DNA, 499 bp, Homo sapiens
  misc_feature: GYAE6OF01EMW7A.9.39.D06.1.454.CMB.1.raw
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (393)..(393): a, c, t, g, unknown or other
  misc_feature (393)..(393): n is a, c, g, or t
  modified_base (432)..(432): a, c, t, g, unknown or other
  misc_feature (432)..(432): n is a, c, g, or t
  modified_base (495)..(495): a, c, t, g, unknown or other
  misc_feature (495)..(495): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagagtaggttancctggcaccagcaaaaacctggccagcctcccaggctcctcatctatgatgcatccaccaggaccactggtgtcccagccaggttcagtggagtggtctgggacagagttcactctcaccatcagcagtctgcagtcggaagtnttttgctagtttactattgtcagcagtatagtaacggcnctctagttcggcggaggaccagggtgagagtacgaaacgtatgtggctgctacatctgtcttntacg

SEQ ID NO: 124885 - DNA, 507 bp, Homo sapiens
  misc_feature: GYAE6OF01B95N4.9.39.D06.1.454.CMB.1.raw
  modified_base (203)..(203): a, c, t, g, unknown or other
  misc_feature (203)..(203): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaangccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagtattttgctagtttactattgtcagcagtatagtaacgggccgctcactttcggcggagggaccaagggtggagatacgaaacgactggtggctgctaccatctgtcttcgtac

SEQ ID NO: 124886 - DNA, 504 bp, Homo sapiens
  misc_feature: GYAE6OF01D8ACE.9.39.D06.1.454.CMB.1.raw
  modified_base (204)..(204): a, c, t, g, unknown or other
  misc_feature (204)..(204): n is a, c, g, or t
  modified_base (359)..(359): a, c, t, g, unknown or other
  misc_feature (359)..(359): n is a, c, g, or t
  modified_base (396)..(396): a, c, t, g, unknown or other
  misc_feature (396)..(396): n is a, c, g, or t
  modified_base (500)..(500): a, c, t, g, unknown or other
  misc_feature (500)..(500): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtcgtcccagccaggttcagtgggagtggtctgggacagngttcactctcaccatcagcagtctgcagtcggaagtnttttgctagtttactattgtcagcagtatagtaacgggccgcttcacgtttcggcggaggaccaagggtgagatacgaaacgatgtggctgacacatctgtctntacg

SEQ ID NO: 124887 - DNA, 510 bp, Homo sapiens
  misc_feature: GYAE6OF01DYF9N.9.39.D06.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
  modified_base (436)..(436): a, c, t, g, unknown or other
  misc_feature (436)..(436): n is a, c, g, or t
  modified_base (482)..(482): a, c, t, g, unknown or other
  misc_feature (482)..(482): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagtnttttgctagtttactattgtcagcagtatagtaacgggcnctcactttcggcggaggaccgaaggtggacgagtacgaaacgtacnggtcggctgaccacatctgtcttgtacc

SEQ ID NO: 124888 - DNA, 499 bp, Homo sapiens
  misc_feature: GYAE6OF01A6QVM.9.39.D06.1.454.CMB.1.raw
  modified_base (205)..(205): a, c, t, g, unknown or other
  misc_feature (205)..(205): n is a, c, g, or t
  modified_base (496)..(496): a, c, t, g, unknown or other
  misc_feature (496)..(496): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagngccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcacatcagcagtctgcagtcggaagtattttgctagtttactattgtcagcagtatagtaacggcgctcactttcggcgagggaccaagggtgagatacgaaacgatggtggctgcacatctgtctntac

SEQ ID NO: 124889 - DNA, 516 bp, Homo sapiens
  misc_feature: GYAE6OF01DDB1T.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctntcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacaggagttcactctcaccatcagcagtctgcagtcggaagtattttgctagtttactattgtcagctagtatagtaacgggccgtctcgtactttcgggcggtagggaccaagggtggagatacgaaacgaatggtgcgtgactaccattctgtcttcac

SEQ ID NO: 124890 - DNA, 504 bp, Homo sapiens
  misc_feature: GYAE6OF01A5X61.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (501)..(501): a, c, t, g, unknown or other
  misc_feature (501)..(501): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttagcctggcaccagcaaaaacctggccagcctcccaggctcctcatctatgatgcatccaccaggaccactggtcgtcccagccaggttcaggtgggagtgggtctgggacagagttcactctcaccatcagcagtctgcagtcggaagtatttgctagtttactattgtcagcagtatagtaacgggccgctctacgttcggcggaggaccaaggtgagatacgaaacgatggtcggctgcacatctgtcttntac

SEQ ID NO: 124891 - DNA, 503 bp, Homo sapiens
  misc_feature: GYAE6OF01BGKUY.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttagcctggcaccagcaaaaacctggccagcctcccaggctcctcatcaatgatgcatccaccaggaccactggtgtcccagccaggttcagtgggagtgggtctgggacagagttcactctcaccatcagcagtctgcagtcggaagtattttgctagtttactattgtcagcagtatagtaacgggccgctcactttcggcggagggaccaaggtggagatcgaaacgatgtggctgcacatctgtcttctaccg

SEQ ID NO: 124892 - DNA, 521 bp, Homo sapiens
  misc_feature: GYAE6OF01AVNYP.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (380)..(380): a, c, t, g, unknown or other
  misc_feature (380)..(380): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttagccttggcaccagcaaaaacctggccagcctcccaggctcctcatctatgatgcatccaccaggaccactggtgtcccagccaggttcagtgggagtgggtctgggacagagttcactctcaccatcggcngtctgcagtcggaagatttgctagtttactattgtcagctagtatagtacggcgctcgtactttcggcggagggaccaagggtggagacgtacgaaacgtacgtggtaggctcgacacctatcgtagtccttgcgttcccg

SEQ ID NO: 124893 - DNA, 609 bp, Homo sapiens
  misc_feature: GYAE6OF01DX2FO.9.39.D06.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (557)..(557): a, c, t, g, unknown or other
  misc_feature (557)..(557): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgccaccctntcctgcgagggccagtcagagtgttagtagtaggttagccgtggcaccagacaaaactggccagcctccagcctcctnatctangatgcactcccaccgacgacctacgtcggtacgtcccgagtacctacgggttacgaggtcggggtaggtcgggtcgtacgggaactaggtacggttccaccgttctaccaaccgtacgtacacgacgtacgtcgtcgacgtaggtacggtaagttacgttttggacttagttttaacgtatttcgtacgaggtactaggttaagtacggtaaccggccgtacttaccggtacgttcgggacgggtacggacgtaaggnggagactaacgaacgtatggtagcgtacgactacgtatcgtctctcgtaccg

SEQ ID NO: 124894 - DNA, 1034 bp, Homo sapiens
  misc_feature: GYAE6OF01BUPLR.9.39.D06.1.454.CMB.1.raw
tcagtgatacgtctcacgaccggtgctcgatttagtgacatctcgcagttctttgggggaggaactgctcagttaggacccagacggaaccatggaagccccagcgcagcttctcttcctcctgctacctcgtcggtccagactaccacgtggaagaaataggtagatcggacgcagtcctaccgacgccccacccgtggcttggttcgtcctaccggaagggggaaaagccgaccccctaccccttccttcccgtgacggacggggccctagtacgaggtaggtttggtttaaggtagggttagggttacgccgttggaccaaccgacgaaacctaaaaacccgtcggacccgacggtccctacccgacggtcccttccctacctacttaccttagtacgtactcggacctactaccccgaaccggaacggaacccctacggttcgggttaccgtaccccgacggtacccgttacggtttaccgtaggggtacggggtaggggttcggggttcggtacgggggaaccgtaagggttaccggtttacccgtaccgtttacccgtaccccgaacccttaaccgttaccggaaccgtacccggttacggtttacccgtacggaccggttaacggggttaaccggggtaaagttttaacggttttttaccggaaccgttttaacggttttttaaccgtttacggttttacggtaccgtaacggttacgttaaacggttttaacgggttaaaccgggggttaaaccccggggggttccccgtacccgtttacccggtttaaccccggggttttttacccggggggaacccggggggttaaacccgggggtaaaccccgggttaaagggggggttaccggggtaaacgggttaaacccgttaaaacccgggtaaaaaacccgggtttaaccgggtttacggggttacccggggtaccgttaccgggaaccccgttaaacccggttacgttttaccccggtttacccgggtttttacccttcccggtttaaaccccccgg

SEQ ID NO: 124895 - DNA, 522 bp, Homo sapiens
  misc_feature: GYAE6OF01DZHTB.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (401)..(401): a, c, t, g, unknown or other
  misc_feature (401)..(401): n is a, c, g, or t
  modified_base (476)..(476): a, c, t, g, unknown or other
  misc_feature (476)..(476): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangcccaccctntcctgcagggccagtcagagtgttagtagtaggttagcctggcaccagcaaaaacctggccagcctccaggctcctcatctatgatgcatccaccaggaccactggtcgtcccagccaggttcaggtgggagtgggtctgggacaggagttcactcgtcaccatcagcagtctgccagtcggaagtntttgctagtttatatttgcagctagtatagtaacgggcctctcgtacgtttcggcggaggaccgtaaggtggganagtacgaaacggaacgtggtggctgcgacagttctgtcttcgtacg

SEQ ID NO: 124896 - DNA, 541 bp, Homo sapiens
  misc_feature: GYAE6OF01DBQ72.9.39.D06.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccacctggctgtgtctccgaggggaaangcccaccctntcctgcagggccagtcagagtgttagtagtaggttagcctggcaccagcaaaaacctggccagcctccaggctcctcatctatgatgcatcccacaggaccactggtctcccagccaggttcaggtgggagtgggtcgtgggacagtagttcactctcaccatcagcagtctgcagtcggaagtatttgctagtttactattgtcagctagtataggtaacgggccgtctacgtacgtttcgggacgggagggaccgtaagggtggaagtacgtaacgaaacggtagtggtcggctacgacctacctattcttcgtcttcgtaccg

SEQ ID NO: 124897 - DNA, 618 bp, Homo sapiens
  misc_feature: GYAE6OF01A7BBB.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangcccaccctctcctgcagggccagtcagagtgttagtagtaggttagcctggcaccagacaaaaacctggccagcctcccaggctcctcatctatgatgcatccaccaggaccactggtcgtcccagccctaggttcaggtggggacgtgggtcgtgggactaggtagttcactctcacctatcagcagtctgcagtacggaatatttgctagtttactattgtacgagtcgtagtagttaacggtaaccgggtcccgtacttccgtaacgttttccgggaccgggtacggggtaacccgtaagggttcggaaaggtaaccgtaaccggtaaaaccggtaacgttcgggttacggaccgttacggacccgtaacccgtacgttccctttacggttaccctttcgttaaccccgg

SEQ ID NO: 124898 - DNA, 531 bp, Homo sapiens
  misc_feature: GYAE6OF01A043M.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagacaaaaacctggccagcctcccaggctcctcatctatgatgcactccaccaggaccactggtcgtcccagccaggttcaggtgggagtgggtctgggacagagttcgactcgtcaccatcagcagtctgcagtcggaagtatttgctagtttactattgtcagtctagtatacgtaacgggccactcgtacgttcggacggtacgggaccgtaagggtggacgagtaccgaaacgtagtggtcggctggacctacatctcgtcttcgtac

SEQ ID NO: 124899 - DNA, 532 bp, Homo sapiens
  misc_feature: GYAE6OF01EWXN2.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (322)..(322): a, c, t, g, unknown or other
  misc_feature (322)..(322): n is a, c, g, or t
  modified_base (398)..(398): a, c, t, g, unknown or other
  misc_feature (398)..(398): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttancctggcaccagcaaaaacctggccagcctcccaggctcctcatctatgatgcatccaccaggaccactggtntcccagccaggttcaggtgggagtgggtctgggacaggagttcacgtctcaccatcagcagtctgcagtcgaagtnttttgctagtttactatttgtcagtcagttaataggtaacgggccctctcaccgtttcggcggagggacctaaggggtgaacgataccgaaacggtaactggtggctgacctaccagttctgttcttcgtaccg

SEQ ID NO: 124900 - DNA, 498 bp, Homo sapiens
  misc_feature: GYAE6OF01AE6GJ.9.39.D06.1.454.CMB.1.raw
  modified_base (204)..(204): a, c, t, g, unknown or other
  misc_feature (204)..(204): n is a, c, g, or t
  modified_base (439)..(439): a, c, t, g, unknown or other
  misc_feature (439)..(439): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtcgtcccagccaggttcagtgggagtgggtctgggacagagttcacgtctcaccatcagcagtctgcagtcggaagtatttgctagtttactattgtcagcagtatcggtaacggccntcacgtttggacggaggacagggtgagatcgaaacgatgngcngcaccatngtctctac

SEQ ID NO: 124901 - DNA, 507 bp, Homo sapiens
  misc_feature: GYAE6OF01CEEXR.9.39.D06.1.454.CMB.1.raw
  modified_base (204)..(204): a, c, t, g, unknown or other
  misc_feature (204)..(204): n is a, c, g, or t
  modified_base (321)..(321): a, c, t, g, unknown or other
  misc_feature (321)..(321): n is a, c, g, or t
  modified_base (502)..(502): a, c, t, g, unknown or other
  misc_feature (502)..(502): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccacctctcctgcagggccagtcagagtgttagagtaggttagcctggcaccagcaaaaacctggaccagcctcccaggctcctcatctatgatgcatcaccaggaccactggtntccagccaggttcagtgggagtggtctgggacaggagttcacgtctcaccatcagcagtctgcagtcgaagattttgctagtttactattgtcagctagtataagaacgggcactcacgtttcggacggagggaccaagggtgagaatcgaaacgtaatgtggctggcaccatctgtcttntaccg

SEQ ID NO: 124902 - DNA, 504 bp, Homo sapiens
  misc_feature: GYAE6OF01CA124.9.39.D06.1.454.CMB.1.raw
  modified_base (204)..(204): a, c, t, g, unknown or other
  misc_feature (204)..(204): n is a, c, g, or t
  modified_base (437)..(437): a, c, t, g, unknown or other
  misc_feature (437)..(437): n is a, c, g, or t
  modified_base (496)..(496): a, c, t, g, unknown or other
  misc_feature (496)..(496): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtgtcccagccaggttcagtggggagtgggtctgggacagagttcactctcaccatcagcagtctgcagtcggaagtattttgctagtttactattgtcagcagtatagtaacgggcnctcactttcgggcggacgggaccaggtggagatacgaacgatggtggctgacaccatcngtctctac

SEQ ID NO: 124903 - DNA, 574 bp, Homo sapiens
  misc_feature: GYAE6OF01CWINA.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaaangcccaccctctcctgcagggccagtcagagtgttagtagtaggttagcctggcaccagcaaaaacctggccagcctcccaggctcctcatctatgatgcactccaccaggacccactggtcgtcccacgcgaggttcaggtcggggagtgggtctgggacagagttcactctcaccatcagcagtctgcagtcggaagtatttgactagtttactattgtcgagcagttagtaacggtaacgggccgtctcgtacgtttcgggacgggtagggacccgtaagggtaggagtaagtaccgaaaacggtaacgtcgggttggaccgttacggaccaacccgttaattccttacgttccgtttctaacccg

SEQ ID NO: 124904 - DNA, 576 bp, Homo sapiens
  misc_feature: GYAE6OF01DK18B.9.39.D06.1.454.CMB.1.raw
  modified_base (206)..(206): a, c, t, g, unknown or other
  misc_feature (206)..(206): n is a, c, g, or t
  modified_base (252)..(252): a, c, t, g, unknown or other
  misc_feature (252)..(252): n is a, c, g, or t
  modified_base (404)..(404): a, c, t, g, unknown or other
  misc_feature (404)..(404): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaaancgcccaccctctcctgcagggccagtcagagtgtaagtgtaggtancctgcaccagcaaaaacctggccagcctccagctcctcatctatgatgcactccaccaggacctacgtggtcgtacccagccctaggttcaaggtggggagtgggtctgggacagagttcactctcaccatcagcagtctgcagtcgaagtntttgactagtttactattgtacagtactagtagtaacgtaccgggcgtctcgtacgtttcgggcggtacgggaaccgtaagggtacggaagacgttaaccgaaaacggtacgttagggtcggaccgttcgaacccgtacctaacgttccgttacggttccttaccgttaccc

SEQ ID NO: 124905 - DNA, 609 bp, Homo sapiens
  misc_feature: GYAE6OF01BKWPX.9.39.D06.1.454.CMB.1.raw
  modified_base (207)..(207): a, c, t, g, unknown or other
  misc_feature (207)..(207): n is a, c, g, or t
  modified_base (418)..(418): a, c, t, g, unknown or other
  misc_feature (418)..(418): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtcgtctccgaaggggaaancgcccaccctctcctgcgagggccagtcagagtgttagtagtaggttagcctggcacagacaaaaacctggccagcctcccaggctcctcactctatgatgcactccaccgacggaccacgtggtcgtccagcctaggttcaggtgggagtgggtcgtagggacagtacgttcacgtctcgactatcagctagtctgcaggtacgtaagtntttgacttagtttactgttatacgagtcgtaagttacgtacgggtaaccgggccgtacgttaccgtaccggtttcgggaccgggtagggaacccgtaaggggttacgggaacgtaagtaaaccggtaaacggtacgtgggtacggtacgtcggaacctaccgtattaccggttcgttctttccgtaacccg

SEQ ID NO: 124906 - DNA, 578 bp, Homo sapiens
  misc_feature: GYAE6OF01BTMMC.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttagcctggcaccagcaaaaacctggccagcctcccaggctcctcatctatgatgcatccaccaggaccactggtcgtcccagccaggttcaggtgggaggtgggtcgtgggacaggagttcactctccaccatcagcagtctgcagtacggaagtattttgactagtttactatttgtctagctagtaagtaggtaaccgggccgtacgttctacgttttcgggacgggtacgggtaaccgtaagggtcggaagtaacgtaccgaaacggtaaccgttgggtcgggtactaggaccgtaccgtacgttaccgttcggttccttcgtacccg

SEQ ID NO: 124907 - DNA, 536 bp, Homo sapiens
  misc_feature: GYAE6OF01C9S0K.9.39.D06.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaangccaccctntcctgcagggccagtcagagtgttagtagtaggttagcctggcaccagacaaaaacctggaccagcctccaggctcctcatctatgatgcatccacaggaccactggtcgtcccagccaggttcaggtgggagtgggtctgggacagtagtcactctcaccatcagcagtctgcgagtcggaatatttgctagtttactagttgtacagctagtagtaacggtaacgggccgtctcgtacgtttcgggacgggtacgggaaccgaagggtggacgtatacgaaaacgtacgtggtcggctgactaccatctcgtcttctacc

SEQ ID NO: 124908 - DNA, 519 bp, Homo sapiens
  misc_feature: GYAE6OF01ECVYK.9.39.D06.1.454.CMB.1.raw
  modified_base (205)..(205): a, c, t, g, unknown or other
  misc_feature (205)..(205): n is a, c, g, or t
  modified_base (323)..(323): a, c, t, g, unknown or other
  misc_feature (323)..(323): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaaggggaaanagccaccctctcctgcagggccagtcagagtgttagtagtaggttagcctggcaccagcaaaaacctggccagcctccaggctcctcatctatgatgcatccaccaggaccactggtntcccagccaggttcagtgggagtgggtctgggacagagttcactctcaccatcagcagtctgcaggtacggaagtatttgctagttttactattgtacagcagtatagtaacgggccgtctctacgtttcggacggacgggaccgaagggtggagatacgaaacgaatggtggctgacctacatctgttctctacg

SEQ ID NO: 124909 - DNA, 565 bp, Homo sapiens
  misc_feature: GYAE6OF01D7GO6.9.39.D06.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccacctctcctgcagggccagtcagagtgttagtagtaggttagcctggcaccagacaaaaacctggccagcctccaggctcctnatctangatgcatccacaggaccacgtggtcgtcccagccaggttcaggtggagtgggtctgggactagagttcactctcacatcagcagtcngcagtacgaagtntttgactagtttactatttgtacagtctagtaagtacggtaacgggccgtacttacgtacgtttcgggacggtagggtaacctaaggggtcgagaacgttaaccggaaacgttaagtcggtaggtactacgggacctaaccgtattaccgttagttccttcgtaaccg

SEQ ID NO: 124910 - DNA, 592 bp, Homo sapiens
  misc_feature: GYAE6OF01AWDD0.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcgagttctttggggagaactgctcagttaggacccagacggaaccatggaagccccagcgcagcttctcttcctctgctactctgggtcccagactaccacttggagaaatagtgatcgacgcagtcctccagccacctggctgtgtctccgaggggaaanggccaccctctcctagccagggccagtcaggagttgttagtagtaggttacgccgtggtcaccgagaccaaaaaccttggaccacgcctaccaggtactcctcgactctatgactcgcactccacacggaccacgtggtacgtcccagacctaggttacaggtcgggacgtcgggtctgggacaggtacgttcactctacacactcgacgctacgtcacgacgtagtacggagtacttttcgactacgtttactattcgtcagtcagtatacgtaacgggccacttacgtacgtttcgggacggtacgggaccgtaaggtcggacgtacgtacgaacgtaacgtggtcggtctgaccgtacgactacgttcgttccgttcgtaccg

SEQ ID NO: 124911 - DNA, 572 bp, Homo sapiens
  misc_feature: GYAE6OF01BZFT1.9.39.D06.1.454.CMB.1.raw
  modified_base (203)..(203): a, c, t, g, unknown or other
  misc_feature (203)..(203): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctgactgtgtctccaggggaanagccaccctctcctgcagggccagtcagagtgttagtagtaggttagcctggcaccagcaaaaacctggccagcctcccaggctcctcatctatgatgcatccaccaggaccacgtggtcgtcccagccaggttcaggtgggaggtgggtctgggacaggagttcgactctcaccatcagcagtctgctagtcggaatattttgctagtttactattcgtacagtcagttagtacggtaaccgggccgtactccgtacgtttcgggacgggtacgggacccgtaagggtcggagtaacgtaccgaaaacggtaacgttgggtacggccgttaggaccctaaccgtacttcgtcgttccttcggtaaccc

SEQ ID NO: 124912 - DNA, 509 bp, Homo sapiens
  misc_feature: GYAE6OF01B5D3F.9.39.D06.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (380)..(380): a, c, t, g, unknown or other
  misc_feature (380)..(380): n is a, c, g, or t
  modified_base (504)..(504): a, c, t, g, unknown or other
  misc_feature (504)..(504): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccaggggaanagccaccctntcctgcagggccagtcagagtgttagtagtaggttagcctggcaccagcaaaaacctggccagcctcccaggctcctcatctatgatgcatccacaggaccactgtcgtcccagccaggttcagtgggagtgggtctgggacagagttcactctcacatcagcagtcngcagtcggaagtagtttgctagtttactattgtcgagctaagtagtagtaaccggcgtctacacgtttcggcggaggaccaggtaggagatacgaaacgatggtggctggactacatctgtctntaccg

SEQ ID NO: 124913 - DNA, 676 bp, Homo sapiens
  misc_feature: GYAE6OF01BVQ0S.9.39.D06.1.454.CMB.1.raw
  modified_base (204)..(204): a, c, t, g, unknown or other
  misc_feature (204)..(204): n is a, c, g, or t
  modified_base (660)..(660): a, c, t, g, unknown or other
  misc_feature (660)..(660): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaagngccacctctcctgcagggccagtcagagtgttagtagtaggtagcctggcacagacaaaaacctgccagcctccaggctcctcatcctatgatgcactccacgacgacctacgtcggtcgaccacgaccgtacggtcgaggtgggtaggttcgggtcgtcgggaacgtaaggtacgttaccgtaccttctacccgaacctacgtacgacgtacgtacggttctacggaccgtacgggtaaccgggtaaagtttacgttttcggaaccgtttaagttttaacgttagtttcgtacgtaacggtacttaagttaacgtaacggggtaacccggtcccgtaccgttacccgttacggtttacccggggacgggtaaccggggaccgtaaggggttaggaacgtaacgtaaccgaaaccggtagtcgggtcgtaccgtacgaccctaccgtattccggtnttccgttcgttacccg

SEQ ID NO: 124914 - DNA, 535 bp, Homo sapiens
  misc_feature: GYAE6OF01DVN48.9.39.D06.1.454.CMB.1.raw
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtccccagataccactggagaaatagtgatgacgcagtctccagccaccctggctgtgtctccaggggaaancgccaccctctcctgcagggccagtcagagtgttagtagtaggttancctggcaccagacaaaaacctggccagcctcccaggctcctcatctatgatgcatccaccaggaccactggtcgtcccagccaggttcagtggggagtgggtctgggacagacgttcactctcacatcagcagtctgacagtcggaagtatttgctagtttactattgtcagctagtatacggtaacgggcctctctacgttcggacggacgggacgtaaggtggagtagtacgaaaacggtacgtggtggccgtgaccgtaccattcttcgttccttctacc

SEQ ID NO: 124915 - DNA, 546 bp, Homo sapiens
  misc_feature: GYAE6OF01CTEFA.9.39.D06.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangcccaccctntccngcagggccagtcagngtgttagtagtaggttncctggcaccagacaaaaacctggccagcctcccaggctcctcatctatgatgcactccaccaggaccactggtcgtcccagccaggttcaggtgggaggtgggtctgggacaggtagttcactctcaccatcagcagtctgcagtcgaagtatttgctagtttactattgctagtcaagtataacggtaacgggccgtcttcgtacgtttcgggacggtacgggaaccgtaagggtggaagtataccgaaaacggtacgtggtcggactcgactaacactctcgtcttcgtaccg

SEQ ID NO: 124916 - DNA, 543 bp, Homo sapiens
  misc_feature: GYAE6OF01BBO2Z.9.39.D06.1.454.CMB.1.raw
  modified_base (204)..(204): a, c, t, g, unknown or other
  misc_feature (204)..(204): n is a, c, g, or t
  modified_base (389)..(389): a, c, t, g, unknown or other
  misc_feature (389)..(389): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagacaaaaacctggccagcctcccaggcctcctcatctatgatgcatccaccaggaccactggtctccagccgaggttcgagtggggagtgggtcgtgggactagacgttcactctcacatcagcagtcngcagtcggaagtatttgactagtttactagttgtcagctagtactaggtaacgggtccgtactcgtacgtttcgggacggtagggaccgaagggtcggaagagtaccgaaacgtacgtggtacgcgtagacctacattactcgtccttgtaccg

SEQ ID NO: 124917 - DNA, 547 bp, Homo sapiens
  misc_feature: GYAE6OF01BVA6A.9.39.D06.1.454.CMB.1.raw
  modified_base (206)..(206): a, c, t, g, unknown or other
  misc_feature (206)..(206): n is a, c, g, or t
  modified_base (393)..(393): a, c, t, g, unknown or other
  misc_feature (393)..(393): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgcccaccctctcctgcagggccagtcagagtgttagtagtaggttagcctggcaccagacaaaaacctggccagcctcccaggcctcctcatctatgatgcatccaccaggaccactggtctcccagccaggttcaggtgggagtgggtcgtgggacaggagttcactctccaccatcagcagtcngcagtcggaagtatttgctagtttactattgtacagtctagtatacggtaacgggccgtactccgtacgtttcgggacgggtacgggaccgtaagggtggagacgtaacgaaacggtactggtcggctgacctacattctcgttcttcgtaccg

SEQ ID NO: 124918 - DNA, 803 bp, Homo sapiens
  misc_feature: GYAE6OF01ETVCQ.9.39.D06.1.454.CMB.1.raw
tcagtgatacgtctcacgaccggtgctcgatttagtgacatctcgcagttctttgggggaggaactgctcagttaggacccagacggaaccatggaagccccagcgcagcttctcttcctcctgctactcgtcgggtcccagactaccacgtggaagaaatgtgatgacgcagtcctccacgcccacccgtggctggtcgtcctaccggaaggggaaagcgccctaccctctcccgtgacgacgggccagtacgagtagttgttaagtaggtaggttacgccgtggcaccagaaaccaaaaccgtcggaccacggccctacccgaggtccctcctactacgttctagtgtactcgacctacctacccgacgaacgaccctacggtcggtccgtaccacggtaccgtaggttcgagggtggggtacggttcggtacgacgggtaacacggtacgtttaccacgttacctaccgtaacctagtaccgtaagcccgttacggtccgttacggaccgtacgggttaaaccgggttaaagttttactttttacgggaccttttaacggtttttaacgtaagttttacgacggtaacggttaccgtaaggtttaaacggttaaccgggtaacccggggtcccgttaaccttacccgggttccgggtttaacgggggacccggggtaaacgggaaccggttaacggggtaggtaaagtaacccgtaacgggtaaaacccggttaggtcgggtagcccggttaaccgaccgttaacgtagttaccgttccgtttccttacccgttacccgg

SEQ ID NO: 124919 - DNA, 506 bp, Homo sapiens
  misc_feature: GYAE6OF01B0BQD.9.39.D06.1.454.CMB.1.raw
  modified_base (204)..(204): a, c, t, g, unknown or other
  misc_feature (204)..(204): n is a, c, g, or t
  modified_base (484)..(484): a, c, t, g, unknown or other
  misc_feature (484)..(484): n is a, c, g, or t
  modified_base (503)..(503): a, c, t, g, unknown or other
  misc_feature (503)..(503): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtcgtcccagccaggttcagtgggagtgggtctgggacagagttcactctcacatcagcagtctgcagtcggaagtatttgctagtttactattgtcagtcagtatagtaaccgggcgtctcgtacgttcgggcggacggacaaggtgagatcgaacgtatggngcgtgcacatactgtcctntac

SEQ ID NO: 124920 - DNA, 670 bp, Homo sapiens
  misc_feature: GYAE6OF01EJDXS.9.39.D06.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaangccaccctctcctgcagggccagtcagngtgttagtagtaggttancctggcaccagcaaaacctggccagcctcccaggctcctcatctatgatgacactcccaaccgacggacccacgttgggtcccgtacccgacgaccgtacggtacgtagggtgggtagggtcggtcggtacgggaacgaaggttacgttactaccttctacccaaccgtactacgacgacgtacgtcgtcggacgtacggttacgggaagttttaaacggttttcgaacgtttaacgtttaacttacgtttcgtacgtacgtacgtaaggttaacgttaaacgggtacccgggtacccgtaccgtaccgttacggtttaccgggaacggggtaacgggaaccggtaacgggtaggaaaacggtacgtacgaaaaccgtacgtggtcggtacgtacgaccctaactattcgtcgttccttac

SEQ ID NO: 124921 - DNA, 531 bp, Homo sapiens
  misc_feature: GYAE6OF01DEI05.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaaangcccaccctctcctgcagggccagtcagagtgttagtagtaggttagcctggcaccagcaaaaacctggccagcctcccaggctcctcatcatgatgcatccacaggaccactggtctcccagccaggttcaggtgggagtgggtctgggacagtagttcactctcaccatcagcagtctgcagtcggaagtatttgctagtttactattgtcagcagtatacggtaacgggcctactcgtacgtttcggacgggtacgggaccgtaagggtggagtatacgaaaacgagtggtcggctgaccaccgtatctcgtcttcgtaccg

SEQ ID NO: 124922 - DNA, 608 bp, Homo sapiens
  misc_feature: GYAE6OF01DG05O.9.39.D06.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (365)..(365): a, c, t, g, unknown or other
  misc_feature (365)..(365): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggaagaaatagtgatgacgctagtctccagccaccctggctgtgtctaccgaaggggaaangtcccaccctntcctgcgagggccagtcagagtgttagtagtaggttanccgtggcacagacaaaaactggccancctccagctctcatctactgatgcactccacacggaccacgtggtcgtccagccgacggttcgagtggggtaggtggtcgnggacagtgttcacgtctacactatcagcgagtcgtagacgtaggtacggtaagtattttggacttaacgttttaacttagttcgttacgacgtagtaagtaacgttaacggggtaaccggtccgtacgttccgtaacggtttccggggacggtaacggggaacctaaggggttgaaagtacgtaaaccgaaacggtacgttaggacggtcacgactacctagttctctttaccgtcttacccg

SEQ ID NO: 124923 - DNA, 546 bp, Homo sapiens
  misc_feature: GYAE6OF01C2GBH.9.39.D06.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (402)..(402): a, c, t, g, unknown or other
  misc_feature (402)..(402): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaaggggaaancgccaccctntcctgcagggccagtcagagtgttagtagtaggttagcctggcaccagcaaaaacctggccagcctcccaggctcctcatctatgatgcatccaccaggaccactggtcgtcccagccaggttcaggtggggagtgggtctgggacagtagttcactctcaccatcagcagtctgcagtcggaagtntttgactagtttactattgtcagctagtagtacggtaacgggccgtctcgtacgtttcgggacggtagggaccgtaagggtggacgtagtacgaaacggtacgtggtggcgtagcctaccgtacttcgtcgttcttcgtacccg

SEQ ID NO: 124924 - DNA, 532 bp, Homo sapiens
  misc_feature: GYAE6OF01B7P5A.9.39.D06.1.454.CMB.1.raw
  modified_base (373)..(373): a, c, t, g, unknown or other
  misc_feature (373)..(373): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagacaaaaacctggccagcctcccaggctcctcatctatgatgcatccaccaggaccacgtggtcgtcccagccaggttcaggtgggagtgggtctgggacagagttcactcncaccatcagcagtctgcagtacggaagtattttgactagtttactattgtcagctagtatacggtaacgggccgtctacgtacgtttcgggcggacgggaccgtaagggtggagatacgaaacgtacgtggtcggctagccacattctgttcctgtacc

SEQ ID NO: 124925 - DNA, 589 bp, Homo sapiens
  misc_feature: GYAE6OF01EXNBC.9.39.D06.1.454.CMB.1.raw
  modified_base (204)..(204): a, c, t, g, unknown or other
  misc_feature (204)..(204): n is a, c, g, or t
  modified_base (421)..(421): a, c, t, g, unknown or other
  misc_feature (421)..(421): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccatggagaaatagtgatgacgcagtctccagccaccctggctgtgtctccgaggggaaancgccaccctctcctgcagggccagtcagagtgttagtagtaggttagccgtggcaccagcaaaaacctgccagcctccaggctcctcatctatgatgcatccaccaggaccacgtcggtcgtccccgagccctagggttcaggtggggagttgggtcgtgggacaggacgttacgactctacacctatcagactagtctgacgtagtacggaagttntttgctagtttatattgtcgagtactagtaagtacggtaaccgggcctcgttactacggtttcgggacggtacggggaaccgaaggggttacggagtaacgtaacggtaaaacgtaccgtaggtcggaccgtgacctaccgtacttcgttcgttccgtacgttacccg

SEQ ID NO: 124926 - DNA, 592 bp, Homo sapiens
  misc_feature: GYAE6OF01AXVFR.9.39.D06.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgccaccctctccngcagggccagtcagagtgttagtagtaggttancctggcaccagacaaaacctggccagcctccaggctcctcatctatgatcgcactcccacgacggaccacgtggtcgtcccagcctaggttcaggtgggaggtcgggtcgtgggacaggtagttccactctaccacatcgagctagtctcggacgtaggtacggtaagttacgttttgacttagttttactatttacgtacgtagtactagttagtacggtaaccgggtcgtaccgtacgtacgtttcgggacgggtacggaccgtaagggtggacgtaacgtaaccgaaacgtacgtggtcggactacgaccgtactagtaccttgtccttactacccg

SEQ ID NO: 124927 - DNA, 636 bp, Homo sapiens
  misc_feature: GYAE6OF01CZ4NT.9.39.D06.1.454.CMB.1.raw
  modified_base (208)..(208): a, c, t, g, unknown or other
  misc_feature (208)..(208): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagactaccactggagaaatagtgatgacgcagtctccagcccacctggctgtgtcctccgaaggggaaancgcccaccctctcctgcagggccagtcagagtgttagagtaggttgcctggcaccagacaaaactggccagcctccaggctcctcatctatgatcgcactcccaccacggaccctacgtggtcgtcccgacgtccgtaggtttcgagggtcggggtaggtgggtcgtagggacgaggtacgttcctactcctacaccatcgagctagtctgacaggtacggtaagtagttttaggcttacgttttaactagttcgtctagtactaagttaagtaacgggtaaccgggccgtaccgttacgaccggtttcggggaccgggtagggtaaccggaaagggtacggaagtaaccgtaacgtaaaccggtaagtcggtacggaccgttaggaccgtaacccttattacccgttacggttcccttaccgtaccg

SEQ ID NO: 124928 - DNA, 581 bp, Homo sapiens
  misc_feature: GYAE6OF01D2XSF.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (405)..(405): a, c, t, g, unknown or other
  misc_feature (405)..(405): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttancctggcaccagacaaaactggccagcctccaggctcctcatctatgatgcactccaccgagaccacgtggtcgtcccagcctaggttcaggtgggagtgggtcgtgggacaggtagtcactctcaccatcagcagtctgcgtaggtcggtaagtnttttgcttaagttttactagtttgtctaagtctaagttaagttaacgggtaaccgggccgttacgtacttaccggtttccgggacgggtacgggaccgaagggtggaaagtacgtaacgaaacggtaacgtggtcggacctcgaccgtaacctattccgtcgttccgttcgtaccg

SEQ ID NO: 124929 - DNA, 703 bp, Homo sapiens
  misc_feature: GYAE6OF01BGP23.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaangccaccctntcctgcagggccagtcagagtgtagagtaggttancctgcacagacaaaacctgccagcctccagctcctcatcatgatcgcatccacgacggaccacgtgtcgtccagcctaggttcgaaggtgggtaggtcgggtcgtagggacctaggtacgttacaacgttcctaccaacccgtattaccgaacgtcctaacggttccttacggacgtacgggttaacgggtaaacgttacgttttttaggaacccgtttaaggtttttaccgtaagttttacggtacccgtaaggtaccgttaaaggttaacgttaaacgggttaaaccccggggtccccgtacggtttacccgttaaccgggtttttccggggaccggggttaaacgggtaacccgggtaaagggtacgggtaacggtaaacgttaaccgaaaacggtaagtcgggttcggacctacggaccctaactacgttcgttccgttcgttcgtacccg

SEQ ID NO: 124930 - DNA, 597 bp, Homo sapiens
  misc_feature: GYAE6OF01A242P.9.39.D06.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangcccaccctntcctgcagggccaggtcagagtgttagagtaggttancctggcaccagcaaaaacctggccagcctccaggctcctcatctatgatgcatccaccacgaccactggtctccgagccaggttccgaggtgggtaggtcgggtcgtgggacacgagttcactctcgaccatcacgcagtctgacaggtcgtaagtatttcgacttagtttactatttcgatagtctaagtagtaacgggtaaccggtccgtaccgttcgtacgtttcggggacgggtaacggaccgtaaagggttgaaggtaacgtaaccgaaaacgggtacttagggtaccgtacgtacggtactaaccgtacttaccgttaccgtttcgttccgttaacccg

SEQ ID NO: 124931 - DNA, 568 bp, Homo sapiens
  misc_feature: GYAE6OF01D8HLE.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaancgccaccctntcctgcagggccagtcagagtgttagtagtaggttancctggcaccagcaaaacctggccagcctcccaggctcctcatctatgatgcatccaccaggaccactggtcgtcccagccaggttcaggtgggagtgggtcgtgggacagtagttcacgtctacaccatcagctagtctgcagtcggaagtagtttgactagtttactattcgtctagtcagttagtaaggtaaccgggccgtacgttccgtacgtttccgggacgggtacggggaccgaaagggtcgggagagtaccgaaaacggtacgtggttggacctcggacctacctaactcgttcgttccttcgtaacccg

SEQ ID NO: 124932 - DNA, 571 bp, Homo sapiens
  misc_feature: GYAE6OF01BAOBR.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaanagccaccctctcctgcagggccagtcagagttgttagtagtaggttagcctggcaccagcaaaaacctggccagcctcccaggctcctcatctatgatgcatccaccaggaccactggtcgtcccagccaggttcaggtgggaggtggtctgggactaggagttcactctcgaccatcagctagtctgctaggacggtaagtatttgacttagtttactatgtcagctagtagtagtacggcctactccgtacgttacgggacggacgggaaccgtagggtgggaacgtaacgtaccgaaaacggtacgttacggtcgggacgtacggacctaaccgtacgttccttggttcccttcgttacccg

SEQ ID NO: 124933 - DNA, 586 bp, Homo sapiens
  misc_feature: GYAE6OF01EX88E.9.39.D06.1.454.CMB.1.raw
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangcccaccctctctgcgacggccagtcagtagttgttagtaggtaggttacnccgtggcaccgagaacaaaaccgtggaccacgccctccgaggcctcctcatctagtgatcgcactcccacgacgaccacgtggtctcccngccgtagttcaggtggaggtggtcgtggacgagtacgtcncgtcncactancgtagcgtactcgngacgtaggtacggaagttcgttttgacgtttaggttttaactgtttcgtacaggtactagtaacgttacgggaaccgggccgtacttaccgttacggtttcgggacggacggtacgaggtaggacgtatacgaaacgtagtggtcgctacgacctacgtatgttcttctacgtacc

SEQ ID NO: 124934 - DNA, 615 bp, Homo sapiens
  misc_feature: GYAE6OF01DPD2G.9.39.D06.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangcccaccctctcctgcagggccaggtcagngttgttagtagtaggttancctggcacagacaaaactgccagcctccagctcctcatctatgatgcatccaccaggaccactcggtcgtcccagcctaggttccaggtggggagtgggtcgtggggacaggtagttccgactcctcacctatcgtagctagttctagcgaggttacggaagttacttttgtaccgtagttttacttagtttagtcgtaagtcgtaagttacgttaacgggtaaccgggtccgtacttaccgttacggtttccggggacggtacgggtaaccgtaggggtacggagtaacggtaacgaaaacgggtacgttcgggtggaccgtacgacccgacctagtaccgttcgttccttcgtaacccg

SEQ ID NO: 124935 - DNA, 602 bp, Homo sapiens
  misc_feature: GYAE6OF01CT1J5.9.39.D06.1.454.CMB.1.raw
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaanagccaccctctcctgcagggccagtcagagtgttagtagtaggttancctgcacagacaaaactgacagcctccaggcctctcatctatgatgcactccaccacggaccacgtcggtcgtacccagccgtaggttcgaagggtgggtaggtgggttcgtagggacgtaggtacgttcacttcgtacaccgataccagctagtcaggacgtagtacggtaagtacgttttgacttagttttacgtattgtactagtacgtagttaagtaacggtaacgggtcctacgtacgtaccgtttcgggacgggagggtaaccgaagggtaggaacgtaagtaccggaaacgtagtcggtacggccgtacgacctaaccgtattaccgtcgttcgttcgtaccg

SEQ ID NO: 124936 - DNA, 546 bp, Homo sapiens
  misc_feature: GYAE6OF01A6RLU.9.39.D06.1.454.CMB.1.raw
  modified_base (204)..(204): a, c, t, g, unknown or other
  misc_feature (204)..(204): n is a, c, g, or t
  modified_base (251)..(251): a, c, t, g, unknown or other
  misc_feature (251)..(251): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatgtgatgacgcagtctccagccaccctggctgtgtctccgaggggaaangccaccctctcctgcagggccagtcagagtgttagtagttaggttancctggcaccagacaaaaacctggccagccctcccaggcctcctcatctatgatgcatccaccaggaccactggtcgtcccagccaggttcaggtggggaggtgggtcgtgggacagtacgttcactctcaccatcagcagtctgcagtacggaagtattttgacttagtttactattgtcagcagttagtaggtaaccgggccgtctctacgtttcgggacgggacgggaccgagggtcggagactacgaaacgtacgtggtcggctacgactaccattcgtcttccttctaccg

SEQ ID NO: 124937 - DNA, 531 bp, Homo sapiens
  misc_feature: GYAE6OF01EYWK3.9.39.D06.1.454.CMB.1.raw
  modified_base (205)..(205): a, c, t, g, unknown or other
  misc_feature (205)..(205): n is a, c, g, or t
  modified_base (403)..(403): a, c, t, g, unknown or other
  misc_feature (403)..(403): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagngccaccctctcctgcagggccagtcagagtgttagtagtaggttagcctggcaccagcaaaaacctggccagcctcccaggctcctcatctatgatgcatccaccaggaccactggtcgtccccagccaggttcaggtgggaggtgggtctgggacaggtagttcactctcaccatcagcagtctgcagtcggaagtnttttgctagtttactagttgtcagctagtataggtaaccgggccgcttcgtacgtttcggcgggaagggaccaagggtcggagagtacgaaacgtacgtggtcggactgactaccatcctgtctctac

SEQ ID NO: 124938 - DNA, 691 bp, Homo sapiens
  misc_feature: GYAE6OF01CPD9K.9.39.D06.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagtgatacgtctcacgaccggtgctcgatttagtgacatctcgcagttctttgggggaggaactgctcagttaggacccagacggaaccatggaagccccagcgcagcttctcttcctcttgctactctgggtcccagataccactggagaaatgtgatgacgcagtctccagccacccgtggctgtgtctccgaaggggaaacngccaccctntccgtgcagggccagtcagagtgttaagtagtaggttancctggcaccagacaaaactggccacgcctccaggctcctcactctatgatcgactactccaccgacggaccctaacgtcggtaccgtcccgacggcctacggtttacgaggtgggggtacggtcggggtccggtagggacgtaggtacgttacgacttaccgtacaacctactcaacgcgtacgttaccgtaggtaccgtaaggttaccggtaaaggttactttttaggacctttaaacggtttaccgttaagtttcggtaccgtaaggtactaacgggttacgttaaacggtaaccgggtaccgtaccgtaccgttacggtttaccgggacgggtaacgggtaccgaagggttacggacgtaacgtaaccgtaaaaccgtagtcgggtcggaccttggaccctaccgtaattccggtacgttccttccgtacccg

SEQ ID NO: 124939 - DNA, 752 bp, Homo sapiens
  misc_feature: GYAE6OF01AOI1X.9.39.D06.1.454.CMB.1.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
tcagtgatacgtctcacgaccggtgctcgatttagtgacatctcgcagttctttgggggaggaacgtgctcagttaggacccagacggaaccatggaagccccagcgcagcttctcttcctcctgctactctgggtcccagataccactggagaaatagtgatgacgcagtctcagcccaccnggctgtgctccgaggggaaancgccacctctcctgcaggcctagtcagagttgtagtaggtagttnccgtggcaccgagaacctaaaactcggaccacgcctcccgagcctcctcactctacgtgactcgcctaacgtcccaacggaaccggtaccctacggtcggtttccgacccgtacgcccgtaaggtccggaaggtggggtaacggtgggtaccgtggggtaaccgaaggttacgttaccgtaacgtccgtacccaacctaagacctacgcgttaacggtcgtcggtaaccgtaggttacggaaaggtttagttacgtaccttaagtttttacctaggtttctacgtaacggttcgtaaacggttaacgtaaacggggtaccggtacccgacgttttaccggtacgtttacccgggggttaaccgggacggggttaaaccggaacgggtttaggggaaaccaaggtttaaacccgaaaacggggttaccctagggttcccgggaaccgttaggacccgttaacccgtcgtttaaccgttcggtttaccgttcccgtttaaacccg

SEQ ID NO: 124940 - DNA, 616 bp, Homo sapiens
  misc_feature: GYAE6OF01DB2LJ.9.39.D06.1.454.CMB.1.raw
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccacctggctgtgtcctccgaaggggaaacgcgcccaccccttctcctggcagggccagtcaggtagtgttaagtagtaggttagccgtaggcaccagacaaaaaccgtcggaccaacgccctacccgacggtcctcctcactctatgatgcactcccaccgacggaccacgtcggtcgtacccacgtccgtaacggttcgaggtggggtaggtcgggtcgtagggacgtagtacgttcactctacaccactcacgacagttctgacagtcgtagtaagttgttttgacgttagtttactagttcgtacacgtataagttagtaacggtaccggtccgtctacgtacggtttcgggacgggtacggaacgtaagggtacggagtacgtaaccgaaacgtacgtcggtaggcctaggtaccactattctcgttcttaccg

SEQ ID NO: 124941 - DNA, 657 bp, Homo sapiens
  misc_feature: GYAE6OF01CE2WX.9.39.D06.1.454.CMB.1.raw
  modified_base (210)..(210): a, c, t, g, unknown or other
  misc_feature (210)..(210): n is a, c, g, or t
tcagtgatacgtctcacgaccggtgctcgatttagtgacatctcgcaggttctttgggggaggaactgctcagttaggacccagacggaaccatggaagccccagcgcagcttctcttcctcctgctactctgggtcccaggataccactggagaaattagtgatgacgcagtctccagccacctggctgtgtccgtccgaaggggaaancgccaccctctccgtggccagggccagtcagagtgttagtagtaggttgcctgcacagacaaaaacctggaccacgcctcccgaggcctcctacactctagtgatgcactccacacggacctacgtggtcgtccgagccgtaggttcaggtagggagtcgggtcgtgggacgaggtacgttacactctcacatacagcgtacgtctagactaggtacgtaagttatttcgacttaacgttttactacgttacgtacaggtactaagtaacgtacggtaaccgggccttacgttacgttaccggtttcgggacgggtaacgggtaaccgtaagggtacggtaacggtaacgtaaccggtaaaacgggtaacgtttacgggtccgggaccggttacgggacccgtaacccgttacggtttaccgttacggttcctttaccgttaccccg

SEQ ID NO: 124942 - DNA, 743 bp, Homo sapiens
  misc_feature: GYAE6OF01DMHK9.9.39.D06.1.454.CMB.1.raw
  modified_base (210)..(210): a, c, t, g, unknown or other
  misc_feature (210)..(210): n is a, c, g, or t
  modified_base (718)..(718): a, c, t, g, unknown or other
  misc_feature (718)..(718): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccatggagaaatagtgatgacgcagtcctccagccaccctggctgtcgtccgtccgaaggggaaacncgcccaccctctcctggaccgaacggggcccaaggttcaggtacgttaggttagtaggttaggttacgccgttggaccaccgagaaccaaaaacctgggaccaacgccctacccgaggtcccttcctactacttacgttatacggtaactcgacctaccgtacccaaccgacggaacccgtacgttccggtaccgtaccccgacgtaccggtacggttacgaagggtggggtaacggttcggggttacgtagggaaccgtaggtagttaccgacttccgtacaccctagtacgacgtctaacgtcgtacggagtaacggtacggttaagttctttaggaccttagttttactgttaccgtacgtagtacgtaagttagttaacggaccggtcccgtagttaccgttacggtttccgggaaggtaaccgggaaaccggtagggttcggaacgtaacgtaacccgaaagtaggttaccggtcgtacgtcggtaaccccaagtttacccgngttttacgtacctttcccgtacccg

SEQ ID NO: 124943 - DNA, 607 bp, Homo sapiens
  misc_feature: GYAE6OF01CPVYB.9.39.D06.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgcccaccctntcctgcagggccagtcagagttgttagtagtaggttagcctggcaccagacaaaaacctggccacgcctcccaggcctcctcatcctatgatgcactcccaaccaggacccacgtggtcgtccccagcctaggttcaggtggggaggtgggtcgtgggacagtagtcacgtctacaccatcagcagtctgcgagtcggaagtacttttgacgtagttttactagttcgtacagtacctaggttaagtaacggtaaccggggcccgtccgttcctacggtttccgggacgggtacgggaacccggtaagggtagggacgtaacgtaccgaaaacggacgttggtcggtacgtacgaccgtaaccgtatccgttacgttccgttccgtacccg

SEQ ID NO: 124944 - DNA, 620 bp, Homo sapiens
  misc_feature: GYAE6OF01B36VO.9.39.D06.1.454.CMB.1.raw
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgcccaccctctcctgcagggccagtcagagtgttagtagtaggttancctggcaccagacaaaaacctggaccagcctacccaggcctcctcatctatgatgcactacccaccgagacctacgtcggtcgtcccagccgtaggttcgaggtgggaggtcgggtcgtcgggacaggtacgttacactcgtaccacgactcgagcagtctcgacgagtacggtaagttagttttacgacgttagtttacttagtttcgtactagtacgtaagttaagtacggtaaccgggccgtacgttaccgtaccggtttcgggaccgggtacgggaccggtaagggtgggacgtaagtaccggaaaacgtacgtaggtcggacgttcggaccctacgtacgttacctcgttccttcgtacccg

SEQ ID NO: 124945 - DNA, 584 bp, Homo sapiens
  misc_feature: GYAE6OF01BEZ0L.9.39.D06.1.454.CMB.1.raw
  modified_base (202)..(202): a, c, t, g, unknown or other
  misc_feature (202)..(202): n is a, c, g, or t
  modified_base (377)..(377): a, c, t, g, unknown or other
  misc_feature (377)..(377): n is a, c, g, or t
  modified_base (472)..(472): a, c, t, g, unknown or other
  misc_feature (472)..(472): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccaggggaancgccaccctctcctgcagggccagtcagagtgttagtagtaggttagcctggcaccagacaaaaacctggccaacgcctcccaggcctcctcactctatgatcgcactccaccgacggacctacgtggtctcccgacgccgaggttcgaggtcgggaggtgggtcgtgggacagngttaccacgtctcaccatcagtcagtctgcaggtacggtaagttatttgacttagtttactattgtaccagtctagtagtacggtaccgggtccncgttacgttacgttcgggacggtacgggaccgtaagggtcggtaagtacgtaaccgaaacgtacgtggtcggctacggaccctaactacgttccttcgttcttcgttacccg

SEQ ID NO: 124946 - DNA, 537 bp, Homo sapiens
  misc_feature: GYAE6OF01C5K6Y.9.39.D06.1.454.CMB.1.raw
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactgganaaatagtgatgacgcagtctccagccacctggctgtgtctccgaggggaaangcccaccctctcctgcagggccagtcagagtgttagtagtaggtncctgcaccagacaaaactggccagcctccaggctcctcatctatgatgcactccaccagaccactggtcgtcccagccaggttcaggtgggagtgggtcngggacngagtcactctcaccntcagcagtctgctagtcggaagtacttttgcttagtttactagttgtcagtcagtataaggtacggccgtctcgtacgtttcgggacggtacgggaccgtaaggtaggaggataccgaaaacgtacgtaggtcggctcgacctacctattcgttcgttcttcgtac

SEQ ID NO: 124947 - DNA, 705 bp, Homo sapiens
  misc_feature: GYAE6OF01COXWR.9.39.D06.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
  modified_base (444)..(444): a, c, t, g, unknown or other
  misc_feature (444)..(444): n is a, c, g, or t
tcagtgatacgtctcacgaccggtgctcgatttagtgacatctcggacgagttcgtttgggggagaactgtctccacgttacggacccagacggaaccatggaagccccgagcgcagcttctcttcctcctgctactctgggtcccagactaccactaggaagaaatgtgatgacgcagtctccagcccaccctggctgtgtcnccgaaggggaaancgccaccctctccngcagggccagtcaagtgtagttagtaggtaggttacgcctggcaccagacaaaaacgtggaccagtcccncccaggctcctcactntatgatgcactacccaacacggacctacgtcgtacgtaccccgacgccgtaggttaccgaaggggttgggggaggttcgggtcgtacggggaactagggtaacgtttcgaaccttccaccaaacctntaccaagtccgtaacgttcgacggacgtaacggttacggaaaagtttgttttacggacttaacggtttactagtttcgtatagtacgtaagttaacggttaacggaaccgggtcccgacgttacctaaccgggtttcggggaccgggtaacgggaaccggtaaagggtacgggaacgttaaggtaacccgtaaaacggtagttacggtcggaccgtacggtactaacccgtattacccgttcggttcccttacttaacccg

SEQ ID NO: 124948 - DNA, 558 bp, Homo sapiens
  misc_feature: GYAE6OF01E0WZV.9.39.D06.1.454.CMB.1.raw
  modified_base (206)..(206): a, c, t, g, unknown or other
  misc_feature (206)..(206): n is a, c, g, or t
  modified_base (253)..(253): a, c, t, g, unknown or other
  misc_feature (253)..(253): n is a, c, g, or t
  modified_base (402)..(402): a, c, t, g, unknown or other
  misc_feature (402)..(402): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccgaggggaaangcccaccctctcctgcagggccagtcagagtgttagtagtaggttancctggcaccagcaaaaacctggccagcctcccaggcctcctcatctatgatgcatccaccaggaccactggtcgtcccagccaggttcaggtgggagtgggtctgggacagtagttcactctcaccatcagcagtctgcagtcgaagtntttgctagtttactattgtcagctagtactaggtaaccggccgtctaccgtacgtttcgggacggtacgggacctaaggggtcgaggaacgtaccgaaaacggtacgttggtcgggcctggacccaaccgtacttacgtcgttcctttcgtacccg

SEQ ID NO: 124949 - DNA, 664 bp, Homo sapiens
  misc_feature: GYAE6OF01CBRKN.9.39.D06.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaanagcccaccctctcctgcagggccagtcagngtgttagtgtagttagctgcacagacaaactgcacgcctccaggctcctacatctatgatgcactccaaccgaggacctacgtcggtcgtccccgagccgtacggttcgagggtgggaggttcggggtcgtaggggactacggtacgttccgtacttctacaccatacacgtactacgtctcgacgtaggtacggtaagttagttttgtacgttagtttacgttatttcggtacgtagtactaaggttaacgttacgggtaaccgggcccgttacgttaccggttaccggttttacgggaccggggtaacgggtaaccggtaagggttacgggtaacgtaacgttaacccggaaaacggttacggttacgggtcggaccgttacggaaccgttacccgtacgttccgtttcgttccgttacttaccccgg

SEQ ID NO: 124950 - DNA, 840 bp, Homo sapiens
  misc_feature: GYAE6OF01DLUSB.9.39.D06.1.454.CMB.1.raw
  modified_base (353)..(353): a, c, t, g, unknown or other
  misc_feature (353)..(353): n is a, c, g, or t
  modified_base (406)..(406): a, c, t, g, unknown or other
  misc_feature (406)..(406): n is a, c, g, or t
  modified_base (533)..(533): a, c, t, g, unknown or other
  misc_feature (533)..(533): n is a, c, g, or t
  modified_base (825)..(825): a, c, t, g, unknown or other
  misc_feature (825)..(825): n is a, c, g, or t
tcagtgatacgtctcacgaccggtgctcgatttagtgacatctcgcagtttctttgggggagaactgctcagttaggacccagacggaaccatcggaagccccagcgcagccttctcttccctcctgcctactctgggtcccagataccgatggagaaatagtgacgtgacgctacgtcctccacgcccacccgttggcttacggtcgtaccggtacccggaagggggaaaactccgcccctacccctcgttcccgtaggccgaccgggtcctaaggtccaaggttacggttagttaaggttacgttacggttacgcctaccggaccaaaccggaactaaccgtaaaacccgnggaccccaaccggtcctacccgacggtccctactacctatcgttaagcgtaanccgaacacccgtaacccgacggtacctacgtcggtcctccggtaccacggtaccgtggtacggttagggacgggttcggtacggtacgggtacgtaacgtacgttaccgttaccaccgttccaaacnccgtagtaccaggtacttcgaacgtcttaaagggtcgttaaacggttagtttaccgtttacgtacgttttaagttacgtaccgttaagggtaacacggtttaaccgttacgttaaaacggggacccccgttcgggtaacccggttcgggttaaaccggtttccgggggaaaggttaccgggaaaccgggttacgtaaagggaacgttaccgaaaacccgggttaaaggctttaaccggggcgtcgtaaaccccgtagtaacccgtttcccgaattttttaccgggttccccngttaccgttcccccg

SEQ ID NO: 124951 - DNA, 602 bp, Homo sapiens
  misc_feature: GYAE6OF01CBTCI.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaanagcccaccctctcctgcagggccagtcagagtgttagtagtaggttgcctggcaccagacaaaaacctggccagcctccaggctcctcatcctatgatgcatccaccaggaccacgtggtctcccagcctaggttcaggtgggtagtgggtcgtgggacaggtagttcacgtctcaccatcagcacgtctgcgaggtacgaagttatttcgattacgtttactagtttcgtacagtactaagtagtaaacggtaccgggcccgtaccttaccgtaaccggttttcggggaccgggtacgggtaaccgtaagggtacggaagtacgtaaccgtaaaacggtaacgtcggtggtacctcggacctaacccgtagttacgttcgttaccgttcttaacccg

SEQ ID NO: 124952 - DNA, 815 bp, Homo sapiens
  misc_feature: GYAE6OF01EE7QD.9.39.D06.1.454.CMB.1.raw
  modified_base (255)..(255): a, c, t, g, unknown or other
  misc_feature (255)..(255): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaagacgccaccctctcctgccagggccagtcagagttgttagtagtaggttanccgtggcacagacaaaacctggaccacgcctacccgaggcctcctctactctatgatgcactaccaccgacggacctacgtcggtccgtacccgacgtacccgtacggttcggtagggttggggacgggttcggggttacggtacggggaacgtacggtacgtttaccgtacccgttaccgtacccaaacctacgttaccgaaggtaccgttaagttcccgttacggtaccgtaaacggggttacgggttaaacggtttaacgtttttaccggtaccgttttaaaggtttttaaccgtttaagttttacggttaccgttaacggtacgttaaggttaacggttaacgggttaacccggggtcccggttaaccgttaccggttaaccgggttttacccgggggaaccgggtaaccgggggttaaccggtaaacgggggtaacgggtaacggtaaaccgttaaaccggtaaaacccggttaacggttacgggttcgggaaccgtaccggtaacccctaccgtaacgtttaccgtttacgtttcccgttaccgttaaccccgg

SEQ ID NO: 124953 - DNA, 537 bp, Homo sapiens
  misc_feature: GYAE6OF01A692D.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (401)..(401): a, c, t, g, unknown or other
  misc_feature (401)..(401): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttagcctggcaccagcaaaaacctggccagcctcccaggctcctcatctatgatgcatccacaggaccactggtcgtccccagcccaggttcaggtggggagtgggtctgggacaggagttcactctcaccatcagcagtctgcagtcggaagtntttagctagtttactatttgtcagtcagtatacgtaacgggccgacttctacgtttcggcggtagggacctagggtggacgagtaccgaaacggtactggtcggacctcgacctaccatcctgttccttcgtaccg

SEQ ID NO: 124954 - DNA, 670 bp, Homo sapiens
  misc_feature: GYAE6OF01BO34F.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaaanacgcccaccctctcctgcagggccagtcagagtgttagtagtaggttagcctggcaccagacaaaaacctggccagcctcccaggcctcctcatctatgatgcactccaccacggaccactgggtcgtcccagccacgggttcaggtggggaggtcgggtcgtggggaacaggtacgttacgaccttcgtcccaaccgacttccgaaggcctacggtccttggaccgtaggtacgggtaagtacgtttttggacttaggtttacttagtttcgtacagtcgtaagttaacgtaacggttaaccgggcccgtacgttacccgttaccggttttcggggaccgggtacgggggtaaacccgtaagggggttacgggaagaacggttaaccgaaaaacggtacgttagggttcgggtacctaggacccgtaaccgtacgttaccgtcgtttcctttaccgttacccg

SEQ ID NO: 124955 - DNA, 667 bp, Homo sapiens
  misc_feature: GYAE6OF01EEGMR.9.39.D06.1.454.CMB.1.raw
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtctccagccaccgtggctgtcgtctccgaaggggaaancgcccaccctctcctgcgagggccagtcagagtgttagtagtaggttancctggcacagacaaaacctggccagcctccaggcctcctcatctactgatgcactccacgacggaccacgtcggtcgtccgacgccgtaggtcgaggtgggaggtcgggtcgtagggacaggtacgttacacgtctaccacgtactcgaagctagtccgtagacgtaggtacggtaagttattttcggacttagtttacttagtttcgtactagtacgtaagttaacgtaacgggtaaccgggccgttaccgttaccggttaccggtttccggggacggggtaacgggtaacccgtaagggggtacggtaaacgtaacgtaaccggaaaaacggtacggttagggtacgggtaccgtacgacccgtacccgttaacgtttccgttacgtttcccgtttcgttaaccccgg

SEQ ID NO: 124956 - DNA, 725 bp, Homo sapiens
  misc_feature: GYAE6OF01A5Q2X.9.39.D06.1.454.CMB.1.raw
  modified_base (205)..(205): a, c, t, g, unknown or other
  misc_feature (205)..(205): n is a, c, g, or t
tcagtgatacgtctcacgaccggtgctcgatttagtgacatctcgcagttctttgggggagaactgctcagttaggacccagacggaaccatggaagccccagcgcagcttctcttcctcctgctactctgggtcccagataccactggagaaatgtgatgacgcagtctccagcccaccctggctgtgtctccgaggggaaacngcccaccctctcctggcacggggccaggtccagtaggttgttagaggtaggttagcctggcaccagaccaaaaacctggaccacgcctccaggcctcctcactctatgactgcactcccgaccgacggtaccacgtcggtcgtcccaggtccgtaggtcgaggtgggaggtcggtcgtagggacgtagtacgttcacgttctaccgaccagttaccgacgtcgtacgtctcggtactaacgggttcggtaaagttcgttttacgacgttaacgtttttaacgtagtttacggtactacggtacttacggtaacgtttaacgggtaaccgggtccgtaccgttacccggttaacggtttacccggggacggggtaaccgggtaccggtaacgggggtaggtaacggtaaacgttaaaccggaaaaccgggtttcggtaaggggtttccggaaccggttaccggaaccccgttaaccgttacggttacccggtttccgtttaccgtttcccggttaccccgg

SEQ ID NO: 124957 - DNA, 800 bp, Homo sapiens
  misc_feature: GYAE6OF01C9EXS.9.39.D06.1.454.CMB.1.raw
  modified_base (151)..(151): a, c, t, g, unknown or other
  misc_feature (151)..(151): n is a, c, g, or t
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccatgganaaatagtgatgacgcagtctccagccaccctggctgtntctccgaaggggaaanacgcccaccctctaccngcgagggccagtcaggtatggtttaagtaggtaggttagcccgtaggaccaacgaagaaccgtaaaaaccgtcggacccacgtaccctacccgaaggtcctcctactaattacctaattggaacgttcgacctaacgtaccccgaacccgaacgggtacctaacggttcgggtaccgtaaccccgacggtacccgtagggtttacgaagggttggggtaacgggtcggggttcgtacggggaaacgtaggtaaccgtttacgtaacccgttcctaccaaaccgttactaccgtaacggacctaacggtcgttacgaacggtaacgggttaacggttaaaggttacgtttttacggactttaacggttttaactttacggtttagtacctaagggaccgttaaaggtaaccgggtttaaggaacccggggtactaccgtttccgtaaccggttttccggggaacgggtaacgggaaaccggtaagggttaacgggacttaaacggaaacccgtaaaagggtacccgtgggtaacgtccggtaagaccctaacgtacgttctaacgttcctacgttaccg

SEQ ID NO: 124958 - DNA, 780 bp, Homo sapiens
  misc_feature: GYAE6OF01DC09O.9.39.D06.1.454.CMB.1.raw
  modified_base (157)..(157): a, c, t, g, unknown or other
  misc_feature (157)..(157): n is a, c, g, or t
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
tcagtgatacgtctcacgaccggtgctcgatttagtgacatctcgcagttcgtttgggggaggaactgctcagttaggacccagacggaaccatggaacgccccagcgcagcttctcttcctcctgctactctgggtcccagactaccacgtggaanaaatagtgatgacgcagtcctccacgccacctggctgtgtcctccgaaggggaaanacgcccaccctcncctgcgagggccagtcaagagttgttagtagtaggttacgccgtggaccaccaagaaccaaaaaccgtcggacccaacgccctacccgaggtcctcctcatctatgatcgacactcccaacgacggacctacgtcggtacctcccgagtccgtacggtttcgagggttacgggggtaggttcggggttacgtacggggaacaggttaacggttcctacctccgttaccaaaccctactaccgaagtaccgtaaggttccgtaggaccgtaagggttacgggtaaagtttacgtttttcggacgtttaaggttttaacctagtttcggtacagtaactaagggttaacgttaacgggtaaccggggtcccttacgtttacccggtaccgggttttacggggaccggggtaacgggtaacccggtaaagggttacgggaaacgtaaccggtaaaccgtaaaaaccgggtacggttacgggttcgggaccctttaacgggaacccccttaaacgttacgttacccgttttacggttaccctttcccgttaaccccgg

SEQ ID NO: 124959 - DNA, 599 bp, Homo sapiens
  misc_feature: GYAE6OF01B2DNK.9.39.D06.1.454.CMB.1.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccatggagaaatagtgatgacgcagtctccagcccaccctggctgtagtctaccgaaggggaaangccctaaccctntcccagcagggccagtcagagtgtttaagagtaggttancctggcacagcaaaaactggaccagcctccaggctcctcactcctatgatgcatccaaccaggaccacgtggtcgtacccagccaggtttccaaggtgggaagtcgggtctggggaccaggtaacgttcgaacttctacgaccagtcaagcagtctgcagtcggaagtatttgactagttactagttgtacagactagtaatacgtaacggggcctcctacgtaccgttttcgggacggtacgggaacccgtaagggttcggaacggaattacccgaaaacgtaacccgttggtacgggcttaacggcgaacccgtactacggtccttgttccttacccg

SEQ ID NO: 124960 - DNA, 524 bp, Homo sapiens
  misc_feature: GYAE6OF01EDDTS.9.39.D06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (514)..(514): a, c, t, g, unknown or other
  misc_feature (514)..(514): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctcagccaccctggctgtgtctccaggggaaangccaccctntcctgcagggccagtcagagtgttagagtaggtancctggcaccagcaaaaacctggccagcctcccaggctcctcatctatgatcgcactccaccaggaccactggtctccccagccaggttcaggtgggagtggtcgtggacagagttcactctcaccatcagcagtctgcagtacggaagtagtttgctagtttactagttgtcagtctaagtataaggtaacggtccgcttactacgtttcggacggtaggaccgaaggtggagagtacgaaacggtatggtgctgacaccatccgtnttcttcgtac

SEQ ID NO: 124961 - DNA, 565 bp, Homo sapiens
  misc_feature: GYAE6OF01BGVIP.9.39.D06.1.454.CMB.1.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (397)..(397): a, c, t, g, unknown or other
  misc_feature (397)..(397): n is a, c, g, or t
  modified_base (561)..(561): a, c, t, g, unknown or other
  misc_feature (561)..(561): n is a, c, g, or t
tcagtgatacgtctcacgaccggtgctcgatttagtgacatctcgcaggttctttgggggaggaactgctcagttaggacccagacggaaccatggaagccccagcgcgagcttctcttcctcctgctactctggggtcccagataccactggagaaatagtgatgacgcagtctccagccaccctggctgtgtctccaggggaaaangccaccctntcctgcagggccagtcaagagtgttagtagtaggttagcctggacacaagacaaaaaacctggaccagacctcccaaggcctcctcatctatgatgcatccaccaggaccaatggtgtcccaagcctaggtcaagtgggacgtgggtcngggacagagttnaactcgtcaaccatacagnaagtctgaccaggtcgaagtattttgctaagtttactattgtcagacagttaataagtaaaccgggccgacttctaactttccgggagggaacgggaccgaaagggttaggagaattagaaaaacggaaactggttggacctggacaaccagttcctgtccttntaac

SEQ ID NO: 124962 - DNA, 885 bp, Homo sapiens
  misc_feature: GYAE6OF01ED2CB.9.39.D06.1.454.CMB.1.raw
  modified_base (207)..(207): a, c, t, g, unknown or other
  misc_feature (207)..(207): n is a, c, g, or t
  modified_base (264)..(264): a, c, t, g, unknown or other
  misc_feature (264)..(264): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactcgtgggtcccagataccatggagaaatgtgatgacgcagtctccagcccacctggctgtgtctaccgaaggggaaacncgcccacccgtctccgtgcgacgggccagtcaggtagttgttagtaggtaggttacnccgtgcaccagaaccaaaaccgtcggccacgccctacccgaggtccctcctacacttacctagtcgaatcgacctacctacccaacccgtacggaacccgtacgttcgggtaccgtaccccacggtacccgtacgggttccgaggggttcgggggtaacggttcggggttcggtagggtaacggtaacggttacgttacccgtacgttaccccgtacggtaaccctacgttaccgaacggtccgtaacggtttccgtagtacccggttaaggggtaacccggttaaaggtttcgttttaaccgtacggttttaaacgtttttaacggttacgtttttacggtaacccgtaaggtttaacccgtttaaacggggtttaaacggttaaacccgggggtttaacccccggggggtacccctttacggtttaacccccgggttttaaccggggttttacccgggggaaccgggggttaaccgggggtaaacccggtaaggggtaccgggtaaacgtaaaccggttaaaccggtaaaaccgggttacggttacgggtcggtaacccgttaccggacccgttaacgttacgttcccgtttacgtttcccgttaactttacccccggg

SEQ ID NO: 124963 - DNA, 607 bp, Homo sapiens
  misc_feature: GYAE6OF01AGIBL.9.39.D06.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (600)..(600): a, c, t, g, unknown or other
  misc_feature (600)..(600): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactgganaaatagtgatgacgcagtctccagccacctggctgtgtctccgaggggaancgccaccctctcctgcagggccagtcagagtgttagtagtaggttancctggcaccagaccaaaacctggccagccctcccgaggcctcctcatctagtgatcgcactacccaccgacggaccctacgtgggtaccgtaccccgacgccgtaggttcgaggtggggaggttggggtacgtgggacaggtacgtcctactacctcaccctatcacgctagttctacgacgtaggtacggtaagttagttttcgacgttagtttactagttgtcagtacagttagtacggtaaccgggtcctacgttccgtacggtttcgggacgggtacgggaacgtagggtggacgataaccgtaaacgacgttaggcggctacgacgtacctactcgttattcctnttacccg

SEQ ID NO: 124964 - DNA, 729 bp, Homo sapiens
  misc_feature: GYAE6OF01EBVT6.9.39.D06.1.454.CMB.1.raw
  modified_base (210)..(210): a, c, t, g, unknown or other
  misc_feature (210)..(210): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagactaccatggaagaaatagtgatgacgcagtcctccagcccaccgtgcctgtcgtctaccgaggggaaancgcccaccctctcctgcgaacgggtccagtcaggtagttacgttagtacggttaggttacgccgttaggacctaaccgaacgaaccgtaaaaaaccgtcggaccctacgtaccctacccgacggtcccttccctacgtaacttcgtaagtacgtacgtcgaccacgtacccgaaccgaccggacctacgtcggtcgtacccgacgtaccgtaggtccgagggtcgggtaggtcgggtacgtcggaacgtagtacgttaccgacttactacctaaccacgttaccgacgtcctagtcgtgtacgtacggtacgtaagttgtttcgacgttacgtttactagtttcgtacgtacgtagtaacgtaagtaacggtaccggtccgtacgttacgttaccgttacgggacgggtaacgggtacgtaagggtacggtaacgtaacgtaaaccgtaaaccgtaaggtacggtacggtaccgttacgaccgtaaccgtacgttaccgttacgttcccgttctacccg

SEQ ID NO: 124965 - DNA, 708 bp, Homo sapiens
  misc_feature: GYAE6OF01B9H8U.9.39.D06.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (302)..(302): a, c, t, g, unknown or other
  misc_feature (302)..(302): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtcctccgaaggggaancgcccaccctctcctgcagggccagtcagngtgttagtagtaggttagcctggcaccgagacaaaaaccgtggaccacgcctacccaggcctcctnactcctatgatgactactccaaccgacgacccacgtggtccgtaccacgccgtaacggttcgaaggttcggggacggtcggggttcggtagggaacgaggttacggttccaccgttactccaaccctagtccgaacgcgtaacgtccgttacgccgtaaggtaccggtaagttattttcggactttaggttttaaactcgtttaggtacctagtacttaaggttacgtaacgggtaacccgggtcccgtacgttaccgtaccggtttcggggaccggggtaacggtaaccggtaaacgggttagggacgttaaacggtacccgtaaaaacggtagtttaccgggtacggtaccggttacgaacccgttacgtacttaccggttcgtttaccgttacccgtaacccg

SEQ ID NO: 124966 - DNA, 788 bp, Homo sapiens
  misc_feature: GYAE6OF01D49UN.9.39.D06.1.454.CMB.1.raw
  modified_base (152)..(152): a, c, t, g, unknown or other
  misc_feature (152)..(152): n is a, c, g, or t
  modified_base (775)..(775): a, c, t, g, unknown or other
  misc_feature (775)..(775): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagactaccatgganaaatgtgatgacgcagtctccagccacctggctgtcgtccgtaccgaaggggaaacacgccctacccttctcctggcgacgggccagtcaaggtagttacgttagtaggttaggttaccgccgtagggacctaaccgaacgaaccgtaaaaaccgtcgggaccctaacggtcccgtacccgaaggtccccttacctactacgttccttaagtacgtacgttcgacctacctacccgaaccgaaccggtacccgacgttacgggtccgtaccccgacggtacccggtaggtttaccggaagggttcggggtacggttccggggttaacggtagggaaaccgtacgggttacgtttaccgtacctttaccgacctaaccgtacttaccggacgaccgttacggttcgtcgtacggtacggttacgaaggttttcgttacgtaccgtttagttttaactacgtttcgactaggtaactaacggttaacgtaaccgggtaccggtccgtaacgttccggtacggttacgggacgggtaaccggacggttaacgggtggaaacgtaacggtaacgtaaacggtacgttacggcgacgtccgtaccgtaaacttcgtacgtttccgttnttcttaaccccgg

SEQ ID NO: 124967 - DNA, 735 bp, Homo sapiens
  misc_feature: GYAE6OF01EAJIP.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgctcagttaggacccagacggaaccatggaagccccagcgcagcttctcttcctctgctactctgggtcccagactaccactggagaaatagtgatgacgcagtctccagccacccgtggctgtgtctccgaaggggaancgccacccgtctcgtagcgacggccagtcagagttgttagtaggtaggttacgcgtaggaccaccaagaaccaaaaaccgtggaccctaacgccctcccgaaggtcccttacctactacttacctagtagaacttcgacctactacccgaacgacggtacctacgtcggtctacccgacgtcgtacggttcgtagggtcggggtacggttgggtacgtgggaacgtaggtacgttaccgtacgttacctacccgaacctacgtaccgaaggtccgtaacggttccgtagaacccggttaacgggttaacgggtaaagttttacggtttacggtaacctttacggttttaaacctaaggtttccgtaacgtaacggtactaacgggttacgaaaccggggttaccggtccgtaccttacggttaccgttacggggaccggtacgggacgtaagggtacgaacgtaagtaaccgtaaaaccggtgtacggtgaccgtgaacccgtactcttacgttcgttctcgttacccg

SEQ ID NO: 124968 - DNA, 779 bp, Homo sapiens
  misc_feature: GYAE6OF01AHY0W.9.39.D06.1.454.CMB.1.raw
  modified_base (208)..(208): a, c, t, g, unknown or other
  misc_feature (208)..(208): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagactaccactggagaaatagtgatgacgcagtctccagcccaccctggctgtcgtctaccgaggggaancgcccaccctctcctgcgagggccagtcagtagtgttagtaggtaggttagccgtggcctaccgagaccaaaaaccgtggaccacgccctcccgaggcctcccgtacactctagtgactcgccactcccaaccgaacggaccctacgttcgggtaccgtacccgacggtacctacgggttcgaagggtggggaggtcggggtcgtagggtacaggtacgttaccaccgttcgtaccaccgtacgtacgacgtcctaaggtccgtcgtacggtaacggttacggtaaagttacgttttacggaccgtttaagttttacgtacgtttacggtaccgtaaggtaccgtaaaggttaacggtaaccgggttaaccggggttccccgtacgtttaacccggttaccgggttacccggggaacggggtaccgggtaaacccggttaaggggtacggtaaacgaaccggttaaaccgaaaaccgggttacggttacgggtaccgggttaaacccgttccgggaaaccgttacccgtaacggttttacccgacgttttcccgttaccgtttaaccccgg

SEQ ID NO: 124969 - DNA, 632 bp, Homo sapiens
  misc_feature: GYAE6OF01BRFUN.9.39.D06.1.454.CMB.1.raw
  modified_base (205)..(205): a, c, t, g, unknown or other
  misc_feature (205)..(205): n is a, c, g, or t
  modified_base (334)..(334): a, c, t, g, unknown or other
  misc_feature (334)..(334): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtcgtctccaggggaaangcccaccctctcctgcagggccagtcagagttgttagtagtaggttagcctggcacagacaaaaacctggaccagcctcccaggctcctcatctatgatgcactccacacggaccacgtggtcgtaccncgccaggttcaggtgggaggtgggtcgtgggacaggtagttcactctcactatcagctagtctagacgtagtacggtaagtacttttggacttaacggtttactagtttcgtactacggtacgtagttaagtaaccggtaaccgggtcccgtacgttaccgtaccggtttaccggggacgggtaacggggtaccggtaaagggtacgggtaaggtaacgtaccggtaaaacggtaacgtacgggtcgggtacgtaccggactaacccgtacgttaccttcggttccttacctacccgg

SEQ ID NO: 124970 - DNA, 883 bp, Homo sapiens
  misc_feature: GYAE6OF01CR74L.9.39.D06.1.454.CMB.1.raw
  modified_base (99)..(99): a, c, t, g, unknown or other
  misc_feature (99)..(99): n is a, c, g, or t
  modified_base (156)..(156): a, c, t, g, unknown or other
  misc_feature (156)..(156): n is a, c, g, or t
  modified_base (217)..(217): a, c, t, g, unknown or other
  misc_feature (217)..(217): n is a, c, g, or t
tcagtgatacgtctcacgaccggtgctcgatttagtgacatctcgcagttcgtttgggggaggaactgctcagttaggacccagacggaaccatggaanccccagcgcagcttctcttcctcctgctactcgtggtcccagactaccacgtggaanaaatgtgatgacgctagtctccagcccaccgtggctgtcgtccgtaccggaaggggaaacncgcccacccgttctccgtcggccgacgggcccaagttccgaagggttagtttacggtttaaggtacgggtttacgggttaacgcccggtaggaccgaacccgaacggtaaacccgaaaaaacccggttcgggaacccgaaccgtaccccgttacccgaacgggtccctttcccgtaccgtaaccttccgttaacgttacgggacttaccggtacctaacccgttaccccgaaaccggtaaccggaaaccccgttaaccggttcgggttaccggtacccccggtacggtacccggttaacggggttaccggtaaggggtacggggttacgggttacgggggttaccggtacggggtaaaccggtacggttacgtttacccgtaacgttcccgtaacccgtaacccgtacgttacgaaccgtccgtacggttccgtacgggtaccgttaaggttaacggtaagtttacgtttacgttcgtttaacgtttacgttattcggtacgtaacgtacgtaagtttaacggaacgttaccgggtacctaccgttcggtacggttacgggacgggttacggaaccggtaaggtacggtaacgtacgtaacgtaaaccggtggtacgtccggacgtccgaaccgttactagtttccgttactccgttcgtaccccg

SEQ ID NO: 124971 - DNA, 740 bp, Homo sapiens
  misc_feature: GYAE6OF01BHF4S.9.39.D06.1.454.CMB.1.raw
  modified_base (206)..(206): a, c, t, g, unknown or other
  misc_feature (206)..(206): n is a, c, g, or t
  modified_base (343)..(343): a, c, t, g, unknown or other
  misc_feature (343)..(343): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccacgtggagaaatagtgatgacgcagtctccagccaccctggctgtgtctccgaaggggaancgcccacctctcctgccgagggccagtcaggtagttggttaagtaggttaggttacgccgttggactacccgaagaacctaaaaaaccgtcggacccacgtccctacccacggtcctcctcatctatcgatcgcacnccaccgacgaccacgtggtcctaccgacgtaccgtaggttcgaggtacgggaggttcggtcgtacggggactaggtacgttactaccgttcctaccgaacctacgtacgacgtcgtacgttcgtacggtacgtaggtaacggtaagtttacgttttacgagtttaacgttttaacgttacgtttacgtactacgttaacgtaagttaacggttacggtaaacccgggtccgtacttacccggttaacggtttaccggggaccgggtaacggggtaccgtaaggggtacgggtaaccgtaaacggttaaaccgtaaaacgggttacggttacgggcggttacccggagtaacccgtaccgttacggtttacgtcgtttaccgttacctttaaccccgg

SEQ ID NO: 124972 - DNA, 724 bp, Homo sapiens
  misc_feature: GYAE6OF01BUUP1.9.39.D06.1.454.CMB.1.raw
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (682)..(682): a, c, t, g, unknown or other
  misc_feature (682)..(682): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagactaccactggaagaaatagtgatgacgcagtctccagcccaccctggctgtgtcctacgaaggggaacncgcccacctctcctgcgacggccagtcagtagtgttaggtagtaggttacnccgtggacaccagaaccaaaaccgtggaccacgccctacccgacggtcctcctactattctagtcgatcgacctactacccaaccgacgaccctacgtcggtccgtacccgacggtccgtaggtacgagggttcgggtagggtcgggtcgtacgggaactacggtacgttaccctaccgttaccgtaccaccgtaatccgaacgtaccgtacgttaccgtcgacggttaacggtacggtaaagttttactttacggtacgttttaagtttaacgttagtttacggtacgtacggtaaccgttaaggtttaaccggtaacgggttacccgggaccgttcgttaaccggttacggtttaccggggaacgggtacgggtacgtaaggggtaccgtaagtaaccgtaacggaacgtagttacggngtaccagtaccctacgtacgttccgtattccgttcgtacccg

SEQ ID NO: 124973 - DNA, 738 bp, Homo sapiens
  misc_feature: GYAE6OF01DRTE0.9.39.D06.1.454.CMB.1.raw
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (330)..(330): a, c, t, g, unknown or other
  misc_feature (330)..(330): n is a, c, g, or t
  modified_base (645)..(645): a, c, t, g, unknown or other
  misc_feature (645)..(645): n is a, c, g, or t
tcagtgatacgtctcacgaccggtgctcgatttagtgacatctcgcagttctttgggggagaactgctcagttaggacccagacggaaccatcggaagccccagcgcagcttctcttcctcctgctactctgggtcccagataccactggagaaatgtgatgacgcagtctccagcccacccgtggctggtcgtctaccgaaggggaaancgcccaccctctcctgcgacggccagtcagtagtgttaagtgtaggttacnccgtggacaccaacgaaccgaaaaccgtcggaccacgcctcccgaaggtcctcctcgattactatagancgtacactccaaccacggacctacgtcggtaccgtaccccgacgtaccggtacggttacgaagggttcggggtaggttacggggtccgtaaggggacgtacgtaacggttcctaactccgtaacccactagtaccaggtacctaaggttccgtacgacgttaacggttacgggtaaactttgttttaccggacgttttaagttttaccttaagtttccgtaaacggttcgtaacgttagttaacggtaccggggtaacccggttcctacgttacggttaccgggtttccggacggggtacggaccggtaaagggnggtaacggtaactaaccggaaaccgttaggtacgggttacgtaccgtccggtaccctaacgtacgttacctttacggttccttccttacccgg

SEQ ID NO: 124974 - DNA, 709 bp, Homo sapiens
  misc_feature: GYAE6OF01D1DA0.9.39.D06.1.454.CMB.1.raw
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
  modified_base (666)..(666): a, c, t, g, unknown or other
  misc_feature (666)..(666): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaanacgccaccctctccgtgcagggccagtcagagtgttagtagtaggttancctggacacacgacaaaacctcggaccacgcctccgacggcctccgtcatctactgtatcgacactaccacgacggaccactggtcgtacccagaccgtacggttcgaggtcggggtaaggttcggggtacgtacggggtaaccaggtacggttccaccttcccgtacaaccctaacgttccacgacgttacgttcgtcgtaactacgggttacggtaagttacggttttagaccgtttaagttttacgttacgtttacggtacgtacgtacgtaacgggttaacgttaaccgggtaccgggtaccgtacccgttacttaccgggtttaccgggacggggtaacggtaaccggtaaagggttcggaacgtaacgttaaccggaaaacggtaaccggttgggtccgtacggtanacccgttacaccggtttcctaaccggtttctccggttaccccg

SEQ ID NO: 124975 - DNA, 876 bp, Homo sapiens
  misc_feature: GYAE6OF01DUOU9.9.39.D06.1.454.CMB.1.raw
tcagtgatacgtctcacgaccggtgctcgatttagtgacatctcgcagttcgtttgggggagaactgctcagttaggacccagacggaaccagtggaagccccagcgcagcttctcttcctcctgctactagtgggtcccagactaccacgtggaagaaatagtgatgacgcagtctcagccacctggcgtgtgtcgtacggaaggggaacgcgcccgaccctcgtccgtggaccgacggccagtcagtgttagttagtagtaggtcgccgtgccaccgagacgaaaacgtcgccgacgcctccgcggtcctcctacctattaccgtagtgtacgttacggacctaccggtacccgaaccggtaacggtaccgtacggttacgggttccgaaccccggtacggtacccggtaaggttccggtaggggttcgggggtaaggttcggggttacggtacgggtaacgtaacggtacgttcccgtacgtccgtaccgtaacctacgtacgacgtacgtacggtaccgtacggaacgtttaacggtacggttaaacggtttacgtttacgtacgttttaacggtttaaccgtttaagttcggtaaccgttagtaacggtaaggtttaaccggtaaacggggttacccgggtccgttaaccggttacccggttttaaccgggtttacccgggggaacggggttaaccgggtaaaccgggttaaacgggggtaaccgggggaaaacgttaaccgggtaaaaaccccgggtaaacggggttacccggttaagggtaccccgggttacgttaaacccggtacccgttaaaccgggttaccggtttccggttacccggttttcccgttaaccggggtttacccccc

SEQ ID NO: 124976 - DNA, 732 bp, Homo sapiens
  misc_feature: GYAE6OF01D4EY9.9.39.D06.1.454.CMB.1.raw
  modified_base (157)..(157): a, c, t, g, unknown or other
  misc_feature (157)..(157): n is a, c, g, or t
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
tcagtgatacgtctcacgaccggtgctcgatttagtgacatctcgcagttcgtttggggggaggaactgctcagttaggacccagacggaaccatggaacgccccagcgcagcttctcttcctcctgctactctgggtcccagactaccactggaanaaatagtgatgacgcagtcctccagccctacccgtggctggtgtcctaccggaaggggaaancgccctaccctctccgtgcgacgggcctagtcagtgttgttaagtagtagggtacnccgtgaccacgagaaccaaaaaccgtcggaccacgccctaccgacggccttcctctattctagtcgatcgacactacccaaccgaacggaccctcggttcggtaccgtaccccgagtacccgtaggttccgaaggggtcgggtagggtacggggtcggtacggggaacgtacggtacggttaccaccggttacctaccgaaccgtactacgacgtctaacggtcgtcgacggttaacggtacggtaattcgtttacgacgtttagtttaacgttagtttacgacgtagtacgtaagttaacggtaacggtacccgggtcctaccgttacggtccggtttacggggaaccgggtacgggaaccgtagggtacggtacgtaacgtaaacgaaaccggttaattcgggtacgtccgtaacggacctaaccgtcttaccgtacggtttcctcgttaccccg

SEQ ID NO: 124977 - DNA, 739 bp, Homo sapiens
  misc_feature: GYAE6OF01CM301.9.39.D06.1.454.CMB.1.raw
  modified_base (160)..(160): a, c, t, g, unknown or other
  misc_feature (160)..(160): n is a, c, g, or t
  modified_base (229)..(229): a, c, t, g, unknown or other
  misc_feature (229)..(229): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (486)..(486): a, c, t, g, unknown or other
  misc_feature (486)..(486): n is a, c, g, or t
tcagtgatacgtctcacgaccggtgctcgatttagtgacatctcgcagttctttgggggagaactgctcagttaggacccagacggaaccagtcggaacgcccccagcgcagcttctcttcctcctgctactctcgggtcccagactaccacgtaggaanaaatagtgatgacgcagtcctccgacgccaccgtgctgtcgtccacggaagggaacacgtcccacctcncgtcgcgtaggacctgtcgagtagttgttaagtaggtaggtctccgtagcaaccgagaaccgtaaaacgtcggccaacgccaccgngtacctcctanaccttctagtnacgtctaccactcccaacgtacgaccttacgtcggtacctaccgaagccgtagtacggacggtggggtaccgggtggttccgacgggacgtaacgttacgtaccgtaccttacggaacctactaacgccgtagtaccgtggttaaccgnggtaccgtaaggtaccggttaagttacggtttagtcgttttaaagtttacctttaggttaccgtacctaagtaaccgttaagggttaaccggtaaccggttacccggtcccgttacggtaccgtttcgggtaccggggtaaccgggtaacgggtaccggtaagggtacgtaaacgtacgtaaaccggtaaacgttagggtacggtacgaccgtaacgtaccgtacttacacggtttaccttctccggttaccc

SEQ ID NO: 124978 - DNA, 648 bp, Homo sapiens
  misc_feature: GYAE6OF01BXRRA.9.39.D06.1.454.CMB.1.raw
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (631)..(631): a, c, t, g, unknown or other
  misc_feature (631)..(631): n is a, c, g, or t
tcagtgatacgtctcacgaccggtgctcgatttagtgacatctcgcagttcgtttgggggagaactgctcagttaggacccagacggaaccatggaagccccagcgcagcttctcttcctcctgctactctgggtcccagtactaccactggaagaaatagtgatgacgcagtcctaccagcccaccgtggctgtgtcctacgaagggaancgccaccctntccngcgaggcctagtacaggtagtgttagtagtaggtacncctagcacagacaaacgtgccacgccnccgagcctccnagtctatgactcgacactaccacgacgacctacgtcgacgtccagtccgtaggtcgagggtgggacggttcggtacgacgggataggtacgttacgacctcgtaaccactagtaccgaacgtcgtagttacggacgacggttaacggtacggtaacgtttatttacggaccttttaagttttaccgtaattcggtactaacgttacgtaaagttaacgttaacggaacgggtccctagttccgttacgttaccgggacggtacggaacggaggtacgtagaacgtaacgtaaacggtagtacgtcggactaccgataacccgtagttaccncgttatttccgtacccg

SEQ ID NO: 124979 - DNA, 755 bp, Homo sapiens
  misc_feature: GYAE6OF01AVW8F.9.39.D06.1.454.CMB.1.raw
  modified_base (219)..(219): a, c, t, g, unknown or other
  misc_feature (219)..(219): n is a, c, g, or t
  modified_base (508)..(508): a, c, t, g, unknown or other
  misc_feature (508)..(508): n is a, c, g, or t
  modified_base (690)..(690): a, c, t, g, unknown or other
  misc_feature (690)..(690): n is a, c, g, or t
tcagtgatacgtctcacgaccggtgctcgatttagtgacatctcgcagtttcgtttgggggaggactgctcagttaggaccagacggaaccatggaacgcccagcgcagcttctcttcctctgctactcgtcgggtccagactaccacgtggaagtaaatagtgatgacgcagtctaccacgccaccgtggcttggtcgtccgtacggaaggggaaacncgccctaccctctccgtgacggacggccagtacgaagtaggtttagttaggttaggttaggtacgccgtacggaccaaccgtaacgaaaccgtaaaaccggtcggaccaccgtccctcccgacggtcctccgtactattctacgtagaactcgaacttaccacccgaacggtaacacctacggttcgtaccgacccgtagtaccgtaggttacgacggggtaggggttcggtacggggttacggaaggtacgtaggttacttaccaccgttacgtaccactagtaccgngtaagtccgtcgtaacgtacggtaacgggtaacgtaagttttcttaaggttaccctttaagtttacggttacgttcgaaccggttaagtaccgtaaagggtttaccggtaacgggacccggttctacggttaaccgggtacgggttaccgggaggaacccgggttaaggaacggacggtaanaacgttaacggaaacgttgggtacgacgtcacacgtacctgttaccgcttaaccttcgtaacccg

SEQ ID NO: 124980 - DNA, 737 bp, Homo sapiens
  misc_feature: GYAE6OF01BLEAD.9.39.D06.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatgtgatgacgcagtctccagccaccctggctgtgtcctcgaggggaanagcccaccctntcctggcagggccagtcagagtgttagtagtaggtanccgtgcaccagacaaaaaccgtggaccacgcctaccgacggctccctctactctancgtactcgcactaccaccgacggacctacgtcggtcgtaccccacggtccgtacggttacgaacgggttcggggtaagggtcggggtcggtacggggaacgtaacggtacgttccgtaccttaccgtaccgaaccctactaccgagtacgtacgtaccgtcggacgtacggtaaccgggtaagttaagttttacggacgtttaacgttttaaccttaggtttacgtacgtaacggtactaacgggttaagttaacgggtaacccgggtaccgtccgttaaccgttaaccgggtttccgggacgggtaaccggggtaaaccggtaggggtacgggtaacgtaacgtaaacccggtaaacggtaacggttaggtccggtaacgtccggtaccgttaccacgttaccgtacgtttccgttaccgttaaccccg

SEQ ID NO: 124981 - DNA, 776 bp, Homo sapiens
  misc_feature: GYAE6OF01D1SSV.9.39.D06.1.454.CMB.1.raw
  modified_base (210)..(210): a, c, t, g, unknown or other
  misc_feature (210)..(210): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
tcagtgatacgtctcacgaccggtgctcgatttagtgacatctcgcagttctttgggggaggaactgctcagttaggacccagacggaaccatggaagcccccagcgcagcttctcttcctcctgctactctgggtcccagataccactggagaaatagtgatgacgcagtcctccagcccaccctggctgtgtcctccgaaggggaaancgcccaccctctcctgcgacgggcctagcagagtgttagtagtaggttanccgtgcacanacaaaacctgccagcctccgacggcctctcatctatgatgcactccaccagacctacgtggtccgtaccgacgtaccgtaggttacgagggttaggggacggttcggggtcgtaggggaacgacggttacgttccacctttaccgtacaaccgtactaccgtaaggtcctaacggttccggtagtaccggttaagggtaccgggttaaagtttacgttttacggacgtttaacgttttaacgtagttttaccggactaacggttaaccgtaaggttaacgtttaaccggggtaaccgggtcccgttaccgtttacccggttaacccgggttttaccgggggaaccgggtaacccgggggtaaaccggttaaagggtacgggggtaaacgtaccggtttaaaacccggaaaaccgttaagggttacgggttaaccgggtaccgggtaacgtaccccgtaaccgttaacctttccggtttaacccgttcctttacggttaaccccccg

SEQ ID NO: 124982 - DNA, 711 bp, Homo sapiens
  misc_feature: GYAE6OF01BTZ8G.9.39.D06.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccatggagaaatagtgatgacgcagtctccagccaccctggctgtgtctccgaggggaaacncgcccaccctctcctgcngggccagtcagagtgttagtaggtaggtagcctggcacagaaccaaaaacctcggccacggccctcccgacggcctccctcactctatgatcgcactccaaccacggaccctacgtcggtcgccccacgcccgtaggttacagggtgggtagggtcgggtacgtgggaacgtaggtacgttcctaccgtcttaccaacctactacgacgtcctaacgtttcgtacgtacgacgggttaaccggtaagtttagttttacggtactttaacgtttttaacgttagtttcgtacgtacgttacgttaagttaaacggttaccgggtaaaccgggtccccggttacttacccggttaaccgggtttaccgggaacggggttacgggaacgggttaacgggtagggtaaccgtaacgtaacgtaaaccgtacgggttgggtcggacgttcggaccgtaccgttacgttacttcgttccgttacgttaccccg

SEQ ID NO: 124983 - DNA, 799 bp, Homo sapiens
  misc_feature: GYAE6OF01A3EBJ.9.39.D06.1.454.CMB.1.raw
  modified_base (205)..(205): a, c, t, g, unknown or other
  misc_feature (205)..(205): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgcccaccctctcctgcagggccagtcagagtgttaggtagtaggttagcctggcaccagaccaaaaacctggaccagcctccgaggacctcctcatctatgatgctactcccgaccgtaacggaccctacgttcgggtacccgttacccgacggtacccgtagggtttaccgaaggggtagggggtaacgggttcgggggttacgttacgggggaacctaggtacgttttaccacccgttaccttacccgaaccctaacgtaccgaacggtccgtaacggtttccgtacggaccggttaacgggttaaccggggtaaaggttacgtttttaccggaccgttttaaggttttaacccgtttagtttcgtaccgtacggtacttaaacggttaagtaaccggggtaacggggtccccgttacgttaccggttaccggtttacccggggaaccgggtacggggtaacccggtaaagggggttcggtaaacggtaaaccggttaacccggtaaaaccggtaacggttcgggtacggtaccgtcggtaacccgtaacccgttacgttcctttaccggttccctttaccgttaaccccg

SEQ ID NO: 124984 - DNA, 768 bp, Homo sapiens
  misc_feature: GYAE6OF01EYM91.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagtgatacgtctcacgaccggtgctcgatttagtgacatctcgcaggttcgtttgggggaggaactgctcagttaggacccagacggaaccatggaagccccagcgcagcttctcttcctcctgctactctgggtcccagataccactggagaaatagtgatgacgcagtctccagccacctggctgtgctcgaggggaaangccaccgtntcctgcagggccagtccagagtgttagtacgtaggttacgcctggcacgagaacaaaaaccgtggaccacgcctcccgaggtcctcccgtataactccgtaatgtactggcctactacccaaccgaggacccctagttcggtacgtccccgaagtaccctaggggtttaccaagggttaggggacggttcgggtacgtacgggggaactacggtacggtttaccaaccgttcgtaccgaccctaagttccgaacgtaccgtacgttccggtgtaccggtaaggttaccgggtaagtttagtttttaccgattttaacgggttttaacttacgtttacggtaaccgtagtacggtagttaacgttacgggtaaacccggggtccctaaggttaccgttaccggtttaccggggaacccgggtaggggtaaccccgtaagggggtaagtacgggtaaaccgttaaaacccgggtaaaacgtaacggttcgggtcggtaaccgtttccgggaccttaaaccgtcggttaacccttggttttaaccctccgggttaccc

SEQ ID NO: 124985 - DNA, 920 bp, Homo sapiens
  misc_feature: GYAE6OF01DPVXN.9.39.D06.1.454.CMB.1.raw
  modified_base (156)..(156): a, c, t, g, unknown or other
  misc_feature (156)..(156): n is a, c, g, or t
  modified_base (217)..(217): a, c, t, g, unknown or other
  misc_feature (217)..(217): n is a, c, g, or t
tcagtgatacgtctcacgaccggtgctcgatttagtgacatctcgcagttcgtttgggggaggaactgctcagttaggacccagacggaaccatggaagccccagcgcagcttctcttcctcctgctactctgggtcccagactaccacgtggaanaaatgtgatgacgctagtctccgacgcccaccgtggcttgtcgtccgacggaaggggaaanccgcccacctctcgcgcgacggctagcgagtacgttaggttagtaggtaggtacgcgtacgacaccgaacgaaccgaaaaccgtcggaccgaccgtcccgtaccggaccggtccttacccctacgtacttacgtacttaggacgttccggacctaccctacccgaaccggaccggtacccgtacgggttaccggtacccgtacccggtacggtacccggttaagggttacggtaaggggtcgggggttaacggggttccggggttaccgggtaggggtaaaccgtaacgggttacttacccgttacccgtttaccgtaacccaaccgtttacctaggaacccgtacggttaccggtaccggttaaccggacggttaacggggttaaacggtttaacgggttttacgtttacccgtaaaccgttttttacggtttaaacttttcgggtttaccgtaacgtttaacgggtaccgtttaaacggggtttaaccgggttaaacccgggtaaccccggggggttcccgtttacccgttaaccggggtttacccggggttaacccgggggaacggggtaaccggggtaaacccgggggtaagggtaacggggttaaccaaaaccggttaacgtaaaacggttcgggttacgtcgggtaccgttacgaccttaccgtacgtttacgtccggttaccttcccggttacccg

SEQ ID NO: 124986 - DNA, 680 bp, Homo sapiens
  misc_feature: GYAE6OF01CEJJJ.9.39.D06.1.454.CMB.1.raw
  modified_base (173)..(173): a, c, t, g, unknown or other
  misc_feature (173)..(173): n is a, c, g, or t
  modified_base (209)..(209): a, c, t, g, unknown or other
  misc_feature (209)..(209): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (507)..(507): a, c, t, g, unknown or other
  misc_feature (507)..(507): n is a, c, g, or t
  modified_base (655)..(655): a, c, t, g, unknown or other
  misc_feature (655)..(655): n is a, c, g, or t
tcagtgatacgtctcacgaccggtgctcgatttagtgacatctcgcagttctttgggggaggactgctcagttaggacccagacggaaccatggaagccccagcgcagcttctcttcctcctgctactctgggtcccagactaccactaggagaaatagtgatgacgcagtcnccagccaccgtggctgtgtcctacggaaggggaacncgcccacccttctccgtagcgacggccagtcgagtagtggttaagttaggtagtagtcctggaccaaccgaagaacctaaaaccgtcgaccacgacctccgagtcctaccgtcatntactagntcgacactacccgaaccgacgaccgtcgttcggactaccgacgtcgttacggtacgaggtcgggagttcgggacgtacggatacgtaacgtcactccgtacacatacgacgtcgatcgtagctaaggtaacggttaagttcgtttacactttaggtttcctaaagttccggtaanaccggtagttaacgtaacggttaccgggtaaccggtcctacccgttaccgttacgggttacggaccgggtaaagtaaccgggtaaggacggtaaacctaaggtaaacccgtaaacggtaggttcggtacgaccggtacacgaacgttntaccgtttctaacgttccttacccg

SEQ ID NO: 124987 - DNA, 655 bp, Homo sapiens
  misc_feature: GYAE6OF01CQ3JJ.9.39.D06.1.454.CMB.1.raw
  modified_base (533)..(533): a, c, t, g, unknown or other
  misc_feature (533)..(533): n is a, c, g, or t
  modified_base (595)..(595): a, c, t, g, unknown or other
  misc_feature (595)..(595): n is a, c, g, or t
  modified_base (626)..(626): a, c, t, g, unknown or other
  misc_feature (626)..(626): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagactaccactggagaaatagtgatgacgcagtctccacgccacccgtggctgtcgtctccgaaggggaagcgcccaccctctccgtgcgacgggccagtcaggtagttgttaggtagtaggttcgccgtggaccaaccgagaacctaaaaaccgtcggacccacgccctaccgacggtcctccctacactctaatgtatcgactaccacccgtaaccgacgtacctacggtcggtaccgtacccgacggtccgtaggttccgagggtacggggtacggtcggggtacgtagggacgtacggtacgtcctaccgtcctaccacctactcgagccgtatccgtgtacgtaggtaggtaagttagttcgtacttagtttactagtcgtactaacgtntaaggttagtaaccggtaccggctacgtcgttacggttccgggacggtacggacgtaagggngtaagaccgtaagaacgtagtggtcgtacgngacctacgtagttctcgtcttacgtcccg

SEQ ID NO: 124988 - DNA, 700 bp, Homo sapiens
  misc_feature: GYAE6OF01BHBAD.9.39.D06.1.454.CMB.1.raw
  modified_base (151)..(151): a, c, t, g, unknown or other
  misc_feature (151)..(151): n is a, c, g, or t
  modified_base (212)..(212): a, c, t, g, unknown or other
  misc_feature (212)..(212): n is a, c, g, or t
  modified_base (422)..(422): a, c, t, g, unknown or other
  misc_feature (422)..(422): n is a, c, g, or t
  modified_base (681)..(681): a, c, t, g, unknown or other
  misc_feature (681)..(681): n is a, c, g, or t
tcagtgatacgtctcacgaccggtgctcgatttagtgacatctcgcagttctttgggggaggaactgctcagttaggacccagacggaaccatggaagcccagcgcagcttctcttcctcctgctactctgggtcccagataccactgganaaatgtgatgacgcagtctccacgccacccgtggctagtcgtccgtaccgaaggggaaacncgccctaccctctccgtagacgacggccaagtcgagtagttgttacggtaggtaggttacgccgtggaccaccgaagtaaccaaaaaccgtcggaccgaaccgccgtacccgacggtcctaccgtactacgtaccgtaatcgtactcgacctactaccaaccgtacgacctacgtcgtccgtaccacgtctaggtcgaggtggtgtcggngtggatgtacgttacactcgtaccactacgtcacgtcacgttcgacgtaccggtaaggtacggtaacgttttagttaccggttaaccgttaacgtttttagtacgtttgtaaccgtaggtacgtaagtttaacggtaaccgggtacggtcccgttacgtccgttaaccggttcggaaccgggtaggtaaccggtagggtacggaacgtagtaaaccggtacgttagggcgtcgactaccgtacgtaaccttgtttaccncgttaccgttcgttacccg

SEQ ID NO: 124989 - DNA, 788 bp, Homo sapiens
  misc_feature: GYAE6OF01BDRIO.9.39.D06.1.454.CMB.1.raw
  modified_base (219)..(219): a, c, t, g, unknown or other
  misc_feature (219)..(219): n is a, c, g, or t
tcagtgatacgtctcacgaccggtgctcgatttagtgacatctcgcaggttctttgggggaggaactgctcagttaggacccagacggaaccatggaacgccccgagcgcagcttctcttcctcctgctactctcgggtcccagactaccactaggagaaatagtgatgacgcagtcctccacgcccaccgtggtctgtcgtctccggaaggggaaacncgaccctacccttcgtcctacgaccggacgggccagtccgaagtaggttgttagtaggttacggtacgcgtcggaccaaccaacgaacctaaaaccgtcgaccgacgaccctccgacgtcctccgtactctactatcgacgtcgactactaccacgacgtaccgtacgtacggtccgaccgtacgtaccgtacggtacgtacgggtggggtacggtcggtacggtacgggaacttacggtacgttaccctacgtacctaccgtacgtactaaccggacgtaccgtacggttcacggtacgttaacgggtaccgttaaaggtttcgtttacggtaacggttttaacgtttacgttacgttactacggtaacggttactaacggttaacgggtaaccgggtaacccggtccttcgtaaccggtttacgggtacggggaaccgggtacgggtaaacgggtacgggtaggtaaaccgtaacgtaaacggttaaccggtaaggtttccgggacgggtaccctacggacccgttaccgttaggttacccgtttcccttaacgttaccgttccccg

SEQ ID NO: 124990 - DNA, 564 bp, Homo sapiens
  misc_feature: GYAE6OF01E0UG1.9.39.D06.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (356)..(356): a, c, t, g, unknown or other
  misc_feature (356)..(356): n is a, c, g, or t
tcagtgatacgtctcacgaccggtgctcgatttagtgacatctcgcagtttctttgggggaggaactgctcagttaggacccagacggaaccatggaagccccagcgcagcttctcttccctcctgctactctgggtcccagataccactggagaaatgtgatgacgcagtctccagccaccctggctgtgtctccaggggaaancgcccaccctntcctgcagggccagtcaggagtgttagagtaggttanccgtggcaccagacaaaaaccgtggccagcctccaggctcctcactctatgatgcactccaccaggaccaacgtggtcgtccccagcctaggttcgagtgggngtcgggtctggacagtatcgactcgtcaccatcagcagtctgactagtacggaagttattttgcttaagtttactagttcgtacagtacagtataaggtaaccgggccgcttacgtacgtttcgggacggtacgggaaccgaagggtgaagactacgaaacgaacgtcggtacggctacgcctaaccattactcgttacttctaaccg

SEQ ID NO: 124991 - DNA, 839 bp, Homo sapiens
  misc_feature: GYAE6OF01BU7PW.9.39.D06.1.454.CMB.1.raw
  modified_base (286)..(286): a, c, t, g, unknown or other
  misc_feature (286)..(286): n is a, c, g, or t
tcagtgatacgtctcacgaccggtgctcgatttagtgacatctcgcagttcgtttgggggaggaactgctcagttaggacccagacggaaccatggaagccccagcgcagcttctcttcctcctgctactctgggtcccagactaccactggagaaatgtgatgacgctagtctccagccctaccgtggctgtcgtcctaccggaaggggaacacgtcccaccctctccgtcgaccgacgggcctagtctaaggtggtttacggttagttacggttagggttaccnccgtaggaccaccgaacgtaaccgaaaaaccgtcggaccctaccgccctacccggacggtcccttacctacgtacttcgtaacgttcgtagtccgtacactacccgaaccggaccgaccgtacgtccggttacgtacccgagtccgtaggttcgtaagggtcgggtagggtacggtcgtagggtaacgtacggtacgttacccgtacgttcccgtaaccgtacctacgtcggtacgtacggtaccgttaccggtacggaaccgttaacgggtaacgggttaaacgtttacgtttaaccggtaacgtttttaacggttttacgttacgtttaggtaacccgttaaggtacgtttaaacgggttaagttaaccccgggttaacccgggtcccgttaccgtttaccgggttaaccggttaccgggggaaaccggtacggggtaaacccgtaggggtaaacccggagttaaaccgaaacgggtaaaccgttaggtcggtacggtacctaaccggtacccgacgttaccgttagtaccttttccgtcttaacccccgg

SEQ ID NO: 124992 - DNA, 901 bp, Homo sapiens
  misc_feature: GYAE6OF01EQAX6.9.39.D06.1.454.CMB.1.raw
  modified_base (148)..(148): a, c, t, g, unknown or other
  misc_feature (148)..(148): n is a, c, g, or t
tcagtgatacgtctcacgaccggtgctcgatttagtgacatctcgcagttcgtttgggggagaactgctcagttacggacccagacggaaccatggaagccccagcgcagcttctcttcctcctgctactcgtgggtccccaagtacnccacgtggagaaatgtgatgacgcagtcctccagcccaccgtggacttgtcgtacctaccggaaggggtaaacgcgaccccacccttcgtccgtcgacgtacggggacctagtacgtagtacggttaggttagttagggttaggttacccggtacggaccaacgaacgtaaccgtaaaaacgtcggaccaccgtacccgtaccgtaccggtccccttccgtacgtagttacttagtcgtaacgtcgacctaccgtccgaccggaacgtaccgacggttcgtacgaccgacggtaccgtaggttaggtacggtggggtaggtacgggttagggtacgggacgtaacgggactttccaccgtttcggaccctacggtatacccgtacggtactacggttaccgtcggtaccgttagggttaaccggtaaagttttcggtttaacgtacgtttaaacggtttttaacccttagggttccgttaagtacggtaacggttaaacggttaccggtttaaaccgggacgggttaccccgttaccgttacgggttttaccgggttaccggggaacggggttaaccggggttaccggaacgggggttaacggtaaacggtttaaacccccgggtaaagtttaacccggggtaaaccgggtttagggtaccccggtacgttacccccgggttaaacttttaaaccggggccctttttaccggggttaccttttaacccccgggttaactttaacccccccggg

SEQ ID NO: 124993 - DNA, 760 bp, Homo sapiens
  misc_feature: GYAE6OF01C492E.9.39.D06.1.454.CMB.1.raw
  modified_base (128)..(128): a, c, t, g, unknown or other
  misc_feature (128)..(128): n is a, c, g, or t
  modified_base (286)..(286): a, c, t, g, unknown or other
  misc_feature (286)..(286): n is a, c, g, or t
  modified_base (571)..(571): a, c, t, g, unknown or other
  misc_feature (571)..(571): n is a, c, g, or t
  modified_base (694)..(694): a, c, t, g, unknown or other
  misc_feature (694)..(694): n is a, c, g, or t
  modified_base (706)..(706): a, c, t, g, unknown or other
  misc_feature (706)..(706): n is a, c, g, or t
tcagtgatacgtctcacgaccggtgctcgatttagtgacatctcgctagttcgtttggggggagaactgctacaggttacggacccaggacggaaccagtggaacgcccagcgcagtcttctcttccnctgctactcgtcgggtaccagactaaccgagtaggaaagtaaagtaggtagacgtcggacgactagtccctaccgacgccctaccggtgacgtcgtacgtaccgacgggaaggggaaccgtcgaccctccgtacgtcgcgaccggacgggacaggttnagggtagttagtacggtaggtcggtacgccgacgactacgactaacaaacgtgaccgcgtaccacgcgtactcctactacttacgtcgtagtactaccgactaccgtaccgacgtaaccgtacggtacgttacggtcccgaccgtcgggtacctggtaacggtggggtaggtacggtggtacggtacggacgtggtactacctctacgtcaaccgtgtacgagtacgtcggtacgcggacgttacggttaagggttaacttacgttacgtacgttttaaacgttnttttttaacggacgtacgaggtttacacgggtttaacgtacccgggtacggtaccggtacctttaccggtaccgggttcggttaaccggggacgggtaaccggttaggaaacgtaccggtaanaccgggttaacnggtaaaggccgtacggaacttaccgacgttactccgttactcgttactacccgg

SEQ ID NO: 124994 - DNA, 719 bp, Homo sapiens
  misc_feature: GYAE6OF01EC1LZ.9.39.D06.1.454.CMB.1.raw
  modified_base (211)..(211): a, c, t, g, unknown or other
  misc_feature (211)..(211): n is a, c, g, or t
  modified_base (649)..(649): a, c, t, g, unknown or other
  misc_feature (649)..(649): n is a, c, g, or t
  modified_base (702)..(702): a, c, t, g, unknown or other
  misc_feature (702)..(702): n is a, c, g, or t
tcagtgatacgtctcacgaccggtgctcgatttagtgacatctcgcagttcgtttggggggaggaactgctcagttaggacccagacggaaccatggaagccccagcgcagcttctcttcctcctgctactctgggtcccagataccactggaagaaatagtgatgacgcagtctccacgccaccctggctgtgtctaccgaaggggaaancgcccaccctctcctgcgacgggtccagtcaggtagttagttaggtagttaggttacgccgtggacaccgaacgaacaaaaccgtcggaccacgccctaccgacggtcctacctcactactagtacgtatacgcctaactccccgaaccgaacggtacctacgttcgggtaccgtacccgacggccgtaacgggttcgaggggtaggggtacggtcggggtcgtacgggaacgtacggtaacgttcctaccgttccctaacgaccgtaacttaccgacgtacgttaaccggtcgtaggacgttaacggtacggttaaagttacgttttacgacgtttaagttttacttacgtttgacgtagacgttaagttaacgtaacgggtaccgggtcctacgttaccgtacgggttccgggacggtaacgggaccggtaagggnggaactacgaaaccgaaacggtacgtaggtcggactcggacctaacgtagttntcggtttctctaacccg

SEQ ID NO: 124995 - DNA, 495 bp, Homo sapiens
  misc_feature: GYAE6OF02INPYV.9.39.D06.1.454.CMB.1.raw
  modified_base (204)..(204): a, c, t, g, unknown or other
  misc_feature (204)..(204): n is a, c, g, or t
  modified_base (436)..(436): a, c, t, g, unknown or other
  misc_feature (436)..(436): n is a, c, g, or t
  modified_base (493)..(493): a, c, t, g, unknown or other
  misc_feature (493)..(493): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagtatttgctagtttactattgtcagcagtatagtaacgggccntcacgtttcggcggaggaccaggtgagatcgaaagactggtgctgcacatctgtctnac

SEQ ID NO: 124996 - DNA, 507 bp, Homo sapiens
  misc_feature: GYAE6OF02HYUOF.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtgtccccagccaggttcagtgggagtgggtctgggacaggagttcactctcaccatcagcagtctgcagtcggaagattttgctagtttactattgtcagcagtatagtaacgggccgctcactttcggcggaggaccgaagggtgagatcgaaacgactggtaggctgcaccagtctgtctctac

SEQ ID NO: 124997 - DNA, 558 bp, Homo sapiens
  misc_feature: GYAE6OF02IZNUH.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctntcctgcagggccagtcagagtgttagagtaggttagcctggcaccagacaaaaacctggccagcctcccaggctcctcatctatgatgcatccaccaggacccactggtcgtcccagccaggttcaggtgggagtgggtctgggacagagtcactctcaccatcagcagtctgcagtcggaagtattttgcttagtttactattgtacagcagttatacggtaacgggccgtctcgtacgtttccgggacgggtacgggaaccgtaagggtaggagagttaaccgaaacggtaaccgtgggtacggcgttaggaccaacctagtccgtacgttccttactaccg

SEQ ID NO: 124998 - DNA, 501 bp, Homo sapiens
  misc_feature: GYAE6OF02ITZJX.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (498)..(498): a, c, t, g, unknown or other
  misc_feature (498)..(498): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgctagtttactattgtcagcagtatagtaacgggcgctcacgtttcggcggaggaccaagggtggagatcgaaacgactgtggctgcacatctgtcttntac

SEQ ID NO: 124999 - DNA, 581 bp, Homo sapiens
  misc_feature: GYAE6OF02IHSDR.9.39.D06.1.454.CMB.1.raw
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (300)..(300): a, c, t, g, unknown or other
  misc_feature (300)..(300): n is a, c, g, or t
  modified_base (381)..(381): a, c, t, g, unknown or other
  misc_feature (381)..(381): n is a, c, g, or t
tcagtgatacgtctcacgaccggtgctcgatttagtgacatctcgcagttctttgggggaggaacgtgctcagttaggacccagacggaaccatggaagccccagcgcagcttctcttcctcctgctactctgggtcccagactaccactggagaaatagtgatgacgcagtctccagccacctggctgtgtctccaggggaaangccaccctctcctgccagggcccagtcagagtgttagtagtaggtancctggcaccagcaaaacctggaccagcctcccaggcctcctcatctangatgcatccaccaggaccactcggtcgtcccagcccaggttcaggtgggagtgggtctgggacagagttcactctcaccancagcagtctgcagtacgaagtcgttttgcttagtttactagtttcgtactagtcaaggttagtacgttaaccgggaccgtcgttacctacggtttccgggacggtaacgggaccgaagggtcgggagagtaccgaaaacggtaacctgggtacggacgttacggccaaccgttataccgttgttaccttacgtttacccg

SEQ ID NO: 125000 - DNA, 511 bp, Homo sapiens
  misc_feature: GYAE6OF02G5XUR.9.39.D06.1.454.CMB.1.raw
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttancctggcaccagcaaaaacctggccagcctcccaggctcctcatctattgatgcatccaccaggaccactggtcgtcccagccaggttcagtgggagtgggtctgggacagagttcactctcaccatcagcagtctgcagtcggaagtattttgctagtttactattgtcagcagtataggtaacgggccgctcacgtttcgggcggagggaccaagggtggagagtcgaaacgaactggtcggctgcacatctgtcttcac

SEQ ID NO: 125001 - DNA, 508 bp, Homo sapiens
  misc_feature: GYAE6OF02HXEPX.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (395)..(395): a, c, t, g, unknown or other
  misc_feature (395)..(395): n is a, c, g, or t
  modified_base (434)..(434): a, c, t, g, unknown or other
  misc_feature (434)..(434): n is a, c, g, or t
  modified_base (505)..(505): a, c, t, g, unknown or other
  misc_feature (505)..(505): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctntcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcacatcagcagtctgcagtcgaagtntttgctagtttactattgtcagcagtatagtaacgggcnctcacgtttcggcggaggaccgaagggtggagtagtacgaaacgtactggtagctggcaccatctgttctntac

SEQ ID NO: 125002 - DNA, 556 bp, Homo sapiens
  misc_feature: GYAE6OF02JBFPC.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtgtccccagccaggttcagtgggagtgggtctgggacagagttcactctcaccatcagcagtctgcagtcggaagtattttgctagtttactattgtcagcagttagtaggtaaccgggccgtctcacgtttcgggacggtagggtaaccgaaggtggagtagtacgaaaaccgtaacgtaggtacggaccttaggaccgtaacccgaagttccgtacggttctttacgtaaccg

SEQ ID NO: 125003 - DNA, 497 bp, Homo sapiens
  misc_feature: GYAE6OF02HMYL8.9.39.D06.1.454.CMB.1.raw
  modified_base (204)..(204): a, c, t, g, unknown or other
  misc_feature (204)..(204): n is a, c, g, or t
  modified_base (436)..(436): a, c, t, g, unknown or other
  misc_feature (436)..(436): n is a, c, g, or t
  modified_base (481)..(481): a, c, t, g, unknown or other
  misc_feature (481)..(481): n is a, c, g, or t
  modified_base (494)..(494): a, c, t, g, unknown or other
  misc_feature (494)..(494): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtggtctgggacagagttcactctcaccatcagcagtctgcagtcggaagtattttgctagtttactattgtcagcagtatagtaacgggcnctcacgtttcggcggaggaccaaggtgagatcgaaacgatgtgcngcacatctgtctntac

SEQ ID NO: 125004 - DNA, 518 bp, Homo sapiens
  misc_feature: GYAE6OF02GF3VI.9.39.D06.1.454.CMB.1.raw
  modified_base (252)..(252): a, c, t, g, unknown or other
  misc_feature (252)..(252): n is a, c, g, or t
  modified_base (385)..(385): a, c, t, g, unknown or other
  misc_feature (385)..(385): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagcccaccctctcctgcagggccagtcagagtgttagtagtaggttancctggcaccagcaaaaacctggccagcctcccaggctcctcatctatgatgcatccaccaggaccactggtgtcccagccaggttcagtgggagtgggtctgggacagagttcactctcaccatcagcagtcngcagtcggaagtattttgctagtttactattgtcagtcagtataggtaacgggccgtctcgtactttcggcggagggaccaagggtggagatacgaaacgaacgtgtggctggacaccatctcgtcttctacg

SEQ ID NO: 125005 - DNA, 523 bp, Homo sapiens
  misc_feature: GYAE6OF02JO9JB.9.39.D06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (510)..(510): a, c, t, g, unknown or other
  misc_feature (510)..(510): n is a, c, g, or t
  modified_base (520)..(520): a, c, t, g, unknown or other
  misc_feature (520)..(520): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaangccaccctntcctgcagggccagtcagagtgttagtagtaggttagcctggcaccagcaaaaacctggccagcctcccaggctcctcatctatgatgcatccaccaggaccactcggtcgtcccagccaggttcaggtcgggagtgggtctgggacagagtcactctacaccatcagcacgtctgcagtcggtaagtattttggctagtttactagttagtcaagtctagtataaggtaacggccgatctacgtttcggacggagggtaccagggtgagactacgaaacgaactgtggctgctacgntcgtgtcctntac

SEQ ID NO: 125006 - DNA, 516 bp, Homo sapiens
  misc_feature: GYAE6OF02HLYS7.9.39.D06.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctntcctgcagggccagtcagagtgttagtagtaggttancctggcaccagcaaaaacctggccagcctcccaggctcctcatctatgatgcatccaccaggaccactggtgtcccagccaggttcagtgggagtgggtctgggacaggagttcactctcaccatcagcagtctgcagtcgaagtattttgctagtttactattgtcagctagtataggtaacgggccgtctcgtacgtttcggcggtaggaccaagggtggagatacgaaacgactggtggctgacacatctagtcttactacc

SEQ ID NO: 125007 - DNA, 507 bp, Homo sapiens
  misc_feature: GYAE6OF02HEFXT.9.39.D06.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
  modified_base (485)..(485): a, c, t, g, unknown or other
  misc_feature (485)..(485): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcgaagtntttgctagtttactattgcagcagtatagtaacggccgtctctacgtttcggacggaggaccaagggtggagatacgaaacgtattggngctgcacatctgtcttatcccg

SEQ ID NO: 125008 - DNA, 514 bp, Homo sapiens
  misc_feature: GYAE6OF02IOXS9.9.39.D06.1.454.CMB.1.raw
  modified_base (204)..(204): a, c, t, g, unknown or other
  misc_feature (204)..(204): n is a, c, g, or t
  modified_base (497)..(497): a, c, t, g, unknown or other
  misc_feature (497)..(497): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtcgcccagccaggttcaggtgggagtgggtctgggacagagttcactctcaccatcagcagtctgcagtcggaagtattttgctagtttactattgtcagcagtatagtaacggcgctcacgtttcgcggaggaccaaggtggagatacgaaacgtacgtggtcggctgcaccgtntccgtgttccttctacg

SEQ ID NO: 125009 - DNA, 515 bp, Homo sapiens
  misc_feature: GYAE6OF02H7JYE.9.39.D06.1.454.CMB.1.raw
  modified_base (364)..(364): a, c, t, g, unknown or other
  misc_feature (364)..(364): n is a, c, g, or t
  modified_base (477)..(477): a, c, t, g, unknown or other
  misc_feature (477)..(477): n is a, c, g, or t
  modified_base (511)..(511): a, c, t, g, unknown or other
  misc_feature (511)..(511): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaaacctggccagcctcccaggctcctcatcctatgatgcatccaccaggaccactggtgtccccagccaggttcagtgggagtgggtctgggacaggngttcactctcaccatcagcagtctgcagtcggaagtattttgctagtttactattgtcagcaagttatagtaacgggccgactcactttcgggcggaggaccaagggtggagntacgaagaactgtggtctgcaccatctgtccttntacc

SEQ ID NO: 125010 - DNA, 510 bp, Homo sapiens
  misc_feature: GYAE6OF02F1RAI.9.39.D06.1.454.CMB.1.raw
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
  modified_base (439)..(439): a, c, t, g, unknown or other
  misc_feature (439)..(439): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttancctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagtattttgctagtttactatttgtcagctagtatagtaacgggccnctctacgtttcggcggaggaccgagggtggagagtacgaaacggactggtggctgcacatctgtcttctac

SEQ ID NO: 125011 - DNA, 500 bp, Homo sapiens
  misc_feature: GYAE6OF02FF0C4.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctntcctgcagggccagtcagagtgttagtagtaggttancctggcaccagcaaaaacctggccagcctcccaggctcctcatctatgatgcatccaccaggaccactggtgtccccagccaggttcagtggggagtgggtctgggacagagtccactctcaccatcagcagtctgcagtcggaagtattttgctagtttactattgtcagcagtatagtacggcgctcactttcggcgaggaccaaggtgagatcgaaacgactgtggctgcaccatctgtcttctac

SEQ ID NO: 125012 - DNA, 513 bp, Homo sapiens
  misc_feature: GYAE6OF02FTJNH.9.39.D06.1.454.CMB.1.raw
  modified_base (204)..(204): a, c, t, g, unknown or other
  misc_feature (204)..(204): n is a, c, g, or t
  modified_base (508)..(508): a, c, t, g, unknown or other
  misc_feature (508)..(508): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagtattttgctagtttactattgtcagctagtatagtacgggccgtctctacgtttcggcggagggaccaaggtggagagtacgaaacgactggtggctgcacctatctgtccttntaccg

SEQ ID NO: 125013 - DNA, 506 bp, Homo sapiens
  misc_feature: GYAE6OF02F3W6T.9.39.D06.1.454.CMB.1.raw
  modified_base (204)..(204): a, c, t, g, unknown or other
  misc_feature (204)..(204): n is a, c, g, or t
  modified_base (503)..(503): a, c, t, g, unknown or other
  misc_feature (503)..(503): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtgtcccagccaggttcaggtgggagtgggtctgggacagagttcactctcaccatcagcagtctgcagtcggaatattttgctagtttactattgtcagcagtatagtaacgggccgctcgtactttcgggcgtaggaccaagggtggagatacgaaacgactggtgctgcacgatctgtctntac

SEQ ID NO: 125014 - DNA, 506 bp, Homo sapiens
  misc_feature: GYAE6OF02HZRAB.9.39.D06.1.454.CMB.1.raw
  modified_base (204)..(204): a, c, t, g, unknown or other
  misc_feature (204)..(204): n is a, c, g, or t
  modified_base (503)..(503): a, c, t, g, unknown or other
  misc_feature (503)..(503): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtgtccccagccaggttcagtgggagtgggtctgggacagagttcactctcaccatcagcagtctgcagtcggaagattttgctagtttactattgtcagcagtatagtaacggcgctcacttcggcggaggaccgaaggtggagagtacgaaacgaactgtaggctgcaccatcgtgtcttntac

SEQ ID NO: 125015 - DNA, 595 bp, Homo sapiens
  misc_feature: GYAE6OF02I7NHZ.9.39.D06.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
tcagtgatacgtctcacgaccggtgctcgatttagtgacatctcgcgagttctttgggggaggaactgctcagttaggacccagacggaaccatggaagccccagcgcagcttctcttcctcctgctactctgggtcccagataccactggagaaatagtgatgacgcagtctccagccacctggctgtgtctccaggggaaatgccaccctntcctgcagggccaggtcagagtgttagtagtaggttancctggcaccagcaaaaacctggcctagcctcccaggctcctctatctatgatgcatccacagaccactggtcgtcccagtcctagttcaggtgggacgtgggtctgggacaggacgttcactctacacatcagcagtcncgcagtcggaagtntttgctagtttactagttgtcacgtctagttactagtaaccggtccgtacttcgtacgtttccgggacggtacggtaaccgtaagggtcgggacgtacgtaaccggaaaccggtaaaccgttcgggtacggtaccgttcggacccgtaacccgtacgttaccgtttaccgtttaccgttacttaaccccgg

SEQ ID NO: 125016 - DNA, 567 bp, Homo sapiens
  misc_feature: GYAE6OF02I4NPQ.9.39.D06.1.454.CMB.1.raw
  modified_base (204)..(204): a, c, t, g, unknown or other
  misc_feature (204)..(204): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccattggagaaatagtgatgacgcagtctccagccaccctggctgtgtctccaggggaaangcccaccctctcctgcagggccagtcagagtgttagtagtaggttancctggcaccagacaaaaactggccagcctcccaggctccncatctatgatgcatccaccaggaccactggtcgtcccagccaggttcaggtgggagtgggtcgtgggacaggagttcacgtctacacctatcagcagtctgcgagtaggaagtagtttgctagtttactagttagttcaagtctaagttagtaaggtaaccgggccgtacgtactaccggttttcgggacgggtagggaccgtaagggtggagtacgtacgtaaacggaacttgggtacgcgttagaccaacctacgtcgtagttccttcgtaccg

SEQ ID NO: 125017 - DNA, 606 bp, Homo sapiens
  misc_feature: GYAE6OF02GPOLX.9.39.D06.1.454.CMB.1.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtcgtcccagccaggttcagtgggagtgggtctgggacagagttcactcncaccatcagcagtctgcagtcggaatattttgacttagtttactattgtcagtctagtaagtaggtaaccggggtcctacgttacgtacgttttaccggggaccgggaaacggggtaacccgtaaaggggttacgggacggtaaacgtttaccggaaaaacggttaaccgttagggtacgggaccgttacggaccctaacccgtagtttccgttacggttcctttacgttaacccg

SEQ ID NO: 125018 - DNA, 513 bp, Homo sapiens
  misc_feature: GYAE6OF02G1O60.9.39.D06.1.454.CMB.1.raw
  modified_base (204)..(204): a, c, t, g, unknown or other
  misc_feature (204)..(204): n is a, c, g, or t
  modified_base (509)..(509): a, c, t, g, unknown or other
  misc_feature (509)..(509): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagtattttgctagtttactagtttgtcagtcagtataggtaacgggccgtctctactttcgggcggaggaccaagggtggagatacgaaacgactggtgctgccacgatctgtcttntacg

SEQ ID NO: 125019 - DNA, 667 bp, Homo sapiens
  misc_feature: GYAE6OF02JZMCK.9.39.D06.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaanacgccaccctctccngcacggccagtcagagtgttagtagtaggttanccgtggcaccagacaaaacctggaccagcctcccgaggcctcctcatctatgtatcgcactccaccacggaccacgtggtcgtcccgagccgtaggtcgaggtcgggagtgggtcgtgggactagtacgttacgacttcgacacctatcgacgctacgtactcgacgtaaggtacggtaaagttacgttttacggaactttaagtttaaccttagtttacggtactacggtacgttaaacggtacggtttaacgggtaccgggtccgtaccgtcgttaaccgggtttacgggaccgggtaacggggtaacccgtaaggggttacggagtaacgtaaccggtaaacgtaacggtcgggttacggtaccgtacggaccgttaccgtacgttcgttacggttacccttacgttaccccg

SEQ ID NO: 125020 - DNA, 586 bp, Homo sapiens
  misc_feature: GYAE6OF02IEVH8.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (430)..(430): a, c, t, g, unknown or other
  misc_feature (430)..(430): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttancctggcaccagcaaaaacctggccagcctcccaggctcctcatctatgatgcatccaccaggaccactggtcgtcccagccaggttcaggtgggagtgggtctgggacaggtatcactctcacatcagcagtctgcagtacggatacgttttgacttagtttacttagttgtacgacgtnaagttatacggtaaccgggtccgtacgtacgtacgtttcgggaccgggtacggggtaaccgtaagggtcggagtaacgtaccggaaaacggtaacgttaggtcgggtacctcggacctaaccgtacgttacctttacggttacctttcgtaacccg

SEQ ID NO: 125021 - DNA, 689 bp, Homo sapiens
  misc_feature: GYAE6OF02IR8G0.9.39.D06.1.454.CMB.1.raw
  modified_base (114)..(114): a, c, t, g, unknown or other
  misc_feature (114)..(114): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (299)..(299): a, c, t, g, unknown or other
  misc_feature (299)..(299): n is a, c, g, or t
tcagtgatacgtctcacgaccggtgctcgatttagtgacatctcgcagttctttgggggaggaacgtgctcagttaggacccagacggaaccatggaagcccagcgcagcttcncttcctcctgctactctgggtcccagataccactggagaaatagtgatgacgcagtctcagccacctggctgtgtctccaggggaaangccacctntcctgcagggccagtcagatgttatgtaggttanccgtggcacgagacaaaaaccgtggaccaggccctccgaggcctcctcactctancgtatagcatccaccgtacggaccacgtcggtcgtcccgacgtcctacggttcagggttcgggaggttcggggtacttggggaactaaggtacgtttaccacgttccgtacctaccgaagttcccgaagtcccgtaacggttctaccgggtacctacgggttaccgggtaaacgttacgttttacggtaccgttaaggttttactttaagtttcgttaccgtagttacctaggttaaacgttacggttaaccgggccgtaccgttacgtaccggttttccgggacgggttacgggaaaccgtagggttacggacgtaacgtaacgtaaaccggtacgttagggtacgtcgtacgaccgtaccgtgttacccgtgttaccctacgttaccg

SEQ ID NO: 125022 - DNA, 527 bp, Homo sapiens
  misc_feature: GYAE6OF02I5P10.9.39.D06.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (480)..(480): a, c, t, g, unknown or other
  misc_feature (480)..(480): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccaggggaaangccacctntcctgcagggccagtcagagtgttagagtaggttagcctggcacagcaaaaacctggccagcctcccaggctcctcatctatgatgcatccaccaggaccacgtggtcgtcccagccgtaggttccaggtcggggaggttcgggtcgtgggaactagtagttcactcgtacaccatcacgcagtctgctagtcggaatgtttgactagtttactattgtacagtcagttatacggtacggcgctcgtacgttcggacggacggacaggngagacgtacgaaacggatggtgacgtagcactatctacgtctctacg

SEQ ID NO: 125023 - DNA, 509 bp, Homo sapiens
  misc_feature: GYAE6OF02G26BY.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (505)..(505): a, c, t, g, unknown or other
  misc_feature (505)..(505): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttagcctggcaccagcaaaaacctggccagcctcccaggctcctcatctatgatgcatccaccaggaccactggtgtcccagccaggttcaggtgggagtgggtctgggacaggagttcactctcaccatcagcagtctgcagtcggaagtattttgctagtttactattgtcagtcagtatagtaacgggccgtctctacgtttcggcggaggaccgaggtggagagtacgaacgactggtggctgcacatctgtctntacg

SEQ ID NO: 125024 - DNA, 569 bp, Homo sapiens
  misc_feature: GYAE6OF02IU6HW.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (394)..(394): a, c, t, g, unknown or other
  misc_feature (394)..(394): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaancgccaccctntcctgcagggccagtcagagtgttagtagtaggttagcctggcaccagacaaaaacctggaccagcctcccaggctcctcatctatgatgcactccaccacggaccactggtcgtcccagccgaggttcaggtgggaggtgggtcgtagggacagagttcactctcaccatcagcagtcngcagtacggagttactttgacttagtttacttattgtactagtctagtagtaggtaaccgggtccgtctacgtacgtttcggacggaacggtaccgtagggtaggagtacgtaacgaaacgtaccgtaggttacggactcgaccgtacgtacgttaccgtcgttccttactaccg

SEQ ID NO: 125025 - DNA, 516 bp, Homo sapiens
  misc_feature: GYAE6OF02F275L.9.39.D06.1.454.CMB.1.raw
  modified_base (203)..(203): a, c, t, g, unknown or other
  misc_feature (203)..(203): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaanagccaccctctcctgcagggccagtcagagtgttagtagtaggttagcctggcaccagcaaaaacctggccagcctcccaggctcctcatctatgatgcatccaccaggaccactggtcgtcccagccaggttcagtggggagtgggtctgggacagagttcactctcaccatcagcagtcngcagtcgaagtntttgactagtttactattgtcagtcagtatacggtacggccgtctcgtacgtttcggcggtacgggacaagggtggagatacgaaacgactggtagctagacacgatctcgttctctac

SEQ ID NO: 125026 - DNA, 606 bp, Homo sapiens
  misc_feature: GYAE6OF02IM5MW.9.39.D06.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (485)..(485): a, c, t, g, unknown or other
  misc_feature (485)..(485): n is a, c, g, or t
  modified_base (564)..(564): a, c, t, g, unknown or other
  misc_feature (564)..(564): n is a, c, g, or t
  modified_base (587)..(587): a, c, t, g, unknown or other
  misc_feature (587)..(587): n is a, c, g, or t
tcagtgatacgtctcacgaccggtgctcgatttagtgacatctcgcagttctttgggggaggtaacgtgctcagttaggacccagacggaaccatggaagccccagcgcagcttctcttcctcctgctactctgggtcccagactaccactggagaaatagtgatgacgcagtctccagccacctggctgtgtctccgaggggaaangccacctcncctgcagggccagtcagacgtgttagtagtaggttagccttaggcaccagactaaaaaccgtggaccaggcctccgaggcctcctacactctatcgatgctactccacacggaccagtcggtcgtccagcctaggttccaggttcgggagtgggtcgtacggggactacgtagtttcaacttcgtacaccctagtccgaagctaagtctacgacgtaggtacgggaaagttcgttttagaccttaaggttttactagttcgttacagtntacgttagtacggtaacgggccgcttacgtacgtttcggacgggtacggaaccgtaggtagagactacgaaaacgtacnggttaagcgttagaccgaacctntacgtcgttactacctacg

SEQ ID NO: 125027 - DNA, 563 bp, Homo sapiens
  misc_feature: GYAE6OF02HGD07.9.39.D06.1.454.CMB.1.raw
  modified_base (204)..(204): a, c, t, g, unknown or other
  misc_feature (204)..(204): n is a, c, g, or t
  modified_base (406)..(406): a, c, t, g, unknown or other
  misc_feature (406)..(406): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtgtaggttagcctggcaccagacaaaaacctggccagccctcccaggcctcctcatctatgatgcactccaccaggaccactcggtcgtcccagccaggttcaggtgggaggtgggtctgggacaggagttcgactctcaccatcagcagtctgctaggtcggagtnttttagctagtttactattgtcagcagttataggtaccgggccgtctcgtacgttcgggacggacgggtaaccgtagggtggagacgtaccgaaacggtaacgttcggtacggtaccgtaggaccaccgtacttaccgtgtttccgttattaacccg

SEQ ID NO: 125028 - DNA, 552 bp, Homo sapiens
  misc_feature: GYAE6OF02HDRCI.9.39.D06.1.454.CMB.1.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (329)..(329): a, c, t, g, unknown or other
  misc_feature (329)..(329): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagtgatacgtctcacgaccggtgctcgatttagtgacatctcgcagttctttgggggaggaacgtgctcagttaggacccagacggaaccatggaagcccagcgcagcttctcttcctcctgctactctgggtcccagactaccactggagaaatagtgatgacgctagtctccagccacccttggctgtgtcaccaggggaaangcctaccctctcctgcagggccagttcagagtgttacgagtaggttacncctggcaccagactaaaaacnggacagcctccaggtcncctcatctagtgatgcatccacgagacctactggntcccagccaggttcaggtgggagtgggtctgggacaggtattcacttcgcacanacagcagtcagcaggtcgaatatttgcttaagttactagttntacagntagtataacggtaaccgggccnctacacgtttcgcggtaaaggaccgtaaggngggaanacgtaccgaaaagaaccttggtaccggtatcggacaaccaattccgtgttccgtataaccgg

SEQ ID NO: 125029 - DNA, 534 bp, Homo sapiens
  misc_feature: GYAE6OF02JJKVD.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcacagcaaaaactggccagcctcccaggctcctcactctatgatgcactccaccacggaccacgtcggtcgtcccagccaggttcaggtgggagtgggtctgggacagtagtcactctcacatcagcagtctgcaggtcggaagtatttcgcttagtttactagttgtcagtcagttataggtaacgggccatctacgtttcggcggtacggaccgtaaggtggagtagtacgaaacggtactggtacgctaggcctaccattcgtagttccttcgtac

SEQ ID NO: 125030 - DNA, 539 bp, Homo sapiens
  misc_feature: GYAE6OF02IABJR.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcatccaccaggaccactggtgtcccagccaggttcaggtgggagtgggtctgggacaggtagttcactctcaccatcagcagtctgcaggtcggaatattttgactagtttactattgtcagtcagtataggtaaccgggcgctctacgtttccgggacggacgggactaagggtcggagagtacgaaacgaccgttgtggactaggcctaacctagttccgtacgttccttctaccg

SEQ ID NO: 125031 - DNA, 733 bp, Homo sapiens
  misc_feature: GYAE6OF02GHX7W.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgcttcaggttaggacccagacggaaccatggaagccccagcgcagacttctcttcctcctggctactctgggtcccagataccactggagaaatagtgatgacgcagtctcagccaccgtggctgtgtctcgaggggaangccaccgtctccgtgcaggccagtcagacgtgttagtacgtaggttcgcctggcaccacgacaaaaccgtggaccagcctacccaggcctccgtcactctagtcgagtcgcactccgaccgacggacctacgtcggtcgtcccacgccgtaggttacgagggtcggggtacggttcggggtacggtaggggactaacgggtaagtttccgaacgttccgtaccgaaccgtagttaccgaaggtaccgtaacggttccgttacggaccggtaacggttaccgggtaaagttacggtttttccggacgttaacggtttttaacttagtttacggttactaaggtacctaagggtttaagttaaccgggttaaccgggtcccgtacgttaccgttaccggttttacggggaaccgggtaccggtaaccgtaaggggtagggaacgtacggtaaccgaaaaccggtaacgttcgggtacggtacgtacggaccgtacccgtagttccgttacgttaccttacgttaacccg

SEQ ID NO: 125032 - DNA, 754 bp, Homo sapiens
  misc_feature: GYAE6OF02H2XAN.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgccaccctctcctgcgagggccagtcagagtgttagtaggtaggttacgccgtggacaccacgaaccaaaaaccgtggaccacgccctcccgaggcctcctacactctatgactgacactaccaccgaacggacctacgtcggtcgtcccgacgtccgtacggttacgagggttacggggtaggttgggtcgtaggggacgtaaggtacgttcgaccttccgtacctaaccgtaacttaccgacgtccgtacggttcccgtacggtacgagggttaaccgggaaaggtttacgtttttacggaccgtttaaacgtttttacgttaagttttcggtaacgttaacggacgttaagttaaacggttaacgggttaacccggggacccgttccgtttaccgtaccggttttaccggggacggggtaaaccgggtaaccggaaggggttacggacgtaacgtaaccggaaaacggtaaccgtagggttaccggtaccgtacggacccgtaaccgttattacccgtttacggttaccctttacgtaaccccg

SEQ ID NO: 125033 - DNA, 557 bp, Homo sapiens
  misc_feature: GYAE6OF02GN0QL.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangcccaccctntcctgcagggccagtcagagtgttagtagtaggttagcctggcaccagcaaaaacctggccagcctcccaggctcctcatctatgatgcatccaccaggaccactggtcgtcccagcctaggttcaggtgggagtgggtctgggacagacgttcactctcaccatcagcagtctgcagtcgagtagttgttgacgtttactttattagttcgtacgatacgtagttaagtacggtacggtcctacgttacgttacgttcgggacggaacggacggtaggtacgagtacgtaacgaacgtacggtgtacggtcgtacgacctaccgtatcgttcgttcttaccg

SEQ ID NO: 125034 - DNA, 571 bp, Homo sapiens
  misc_feature: GYAE6OF02IKSUJ.9.39.D06.1.454.CMB.1.raw
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaaggggaaagacgcccaccctctcctgcagggccagtcagagtgttagtagtaggttacgcctggcaccagtaccaaaaaacctcggaccagcctcccaggcctcctcactctatgatgcactccaccgacggacccacgtggtcgtccccgagtcctacggtttcaggtcggggagtcgggtcgtgggacaggtagttcgacttctcacctatacacgctacgtcgtgctaggtcggaagtattttgacttagtttacttattagtactagtactagtagtaggtaaccggccgacgttctacgtttcgcgggtacggacgtaggtagagacgtacgaacgtactggtgctagcacctagtcgtgtcctctaccg

SEQ ID NO: 125035 - DNA, 571 bp, Homo sapiens
  misc_feature: GYAE6OF02HCDNT.9.39.D06.1.454.CMB.1.raw
  modified_base (205)..(205): a, c, t, g, unknown or other
  misc_feature (205)..(205): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctcctgcagggccagtcagagtgttagtagtaggttagcctggcaccagacaaaaacctggccagcctcccaggctcctcatctatgatcgcactccaccacggaccacgtggtcgtcccagcctaggtcaggtcgggagttgggtcgtgggacaggtacgttcactctacacatcagccagtcngcgagtcgaagtntttgacttagtttactagttcgtctagtctaggtaagtacgggttaccgggccgtcgtacgtaccgtttcgggacgggtaacggaccgaagggtaggacgaatacgaaaacgtactaggtggtaccgtgaccctactaccgtccgtacgtctacttaccg

SEQ ID NO: 125036 - DNA, 504 bp, Homo sapiens
  misc_feature: GYAE6OF02FMY24.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagactccactctcaccatcagcagcctagagcctgaagtattttgctattttatactgtcagcagcgtgaccaagtgcttctctactttcggcggtagggacaggtggagaccagaccgaacgtgtaggctgccaccatcgtgttcc

SEQ ID NO: 125037 - DNA, 646 bp, Homo sapiens
  misc_feature: GYAE6OF02FO4UU.9.39.D06.1.454.CMB.1.raw
  modified_base (204)..(204): a, c, t, g, unknown or other
  misc_feature (204)..(204): n is a, c, g, or t
  modified_base (251)..(251): a, c, t, g, unknown or other
  misc_feature (251)..(251): n is a, c, g, or t
  modified_base (355)..(355): a, c, t, g, unknown or other
  misc_feature (355)..(355): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaancgccaccctctcctgcagggccagtcagagtgttagtagtaggttancctggcaccagcaaaaacctggccagcctccccaggctcctcactctatgatgcatccaccaggaccactggtcgtcccagccaggttcagtgggagtgggtcngggacaggagttcactctcaccatcagcagtctgcaggtacggaagtagttttcgacgtaagttttactatttcgtactaggtactaggttacgttaacgggtaaccggggtcccgtaccgttaccgtaaccgtttttaccggggaccggggtacggggtaacccgtaaaggggttacggggacgtaacggttaaccggtaaaaaccggtaaccggttagggttacgggtaccgttcggtacctaaccccgttagttacccgtttacggttacccgtttaccgttaacccg

SEQ ID NO: 125038 - DNA, 573 bp, Homo sapiens
  misc_feature: GYAE6OF02G2A3D.9.39.D06.1.454.CMB.1.raw
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (378)..(378): a, c, t, g, unknown or other
  misc_feature (378)..(378): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgccaccctctcctgcagggccagtcagagtgttagtagtaggttanccgtggcaccagacaaaaacctggccagcctcccaggcctcctcatctatgatgcactccaccaggaccacgtggtcgtcccagccaggttcaggtgggagtgggtcgtgggacagtagtcactcncaccatcagctagtctgcgtaggtacggaagtattttcgacttagtttactagttcgtcagtctaggttataacgggtaaccgggccgtacttccgtacggtttccgggacgggtacgggaccgtaagggtacggtagaacgtacgaaacggtacgtaggtcggctagacctacgacttcgtcgttcttctaccg

SEQ ID NO: 125039 - DNA, 612 bp, Homo sapiens
  misc_feature: GYAE6OF02IODPX.9.39.D06.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (296)..(296): a, c, t, g, unknown or other
  misc_feature (296)..(296): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctntcctgcagggccagtcagagtgttagtagtaggttancctggcacagacaaaaactggccagcctccaggctcctcatctangatgcactccacgagaccactggtcgtcccagccaggttcagtgggagtggtcgtggacagtagtcgactctcgacctatctagctagtctgacgaggtacgaagttatttcggactaaggtttaactatttacgtacagtacctagggttaacttaacgggtaacccgggtaccgccgttaaccttaccgggttttaccggggaccgggtaaaggggtaaccccgtaaaggggtcggaaagtacgtaaccgtaaaacggaaccgttggtacggcgtacgaccgacccgtagttcctcgttacgtccttaacccgg

SEQ ID NO: 125040 - DNA, 580 bp, Homo sapiens
  misc_feature: GYAE6OF02JC94P.9.39.D06.1.454.CMB.1.raw
  modified_base (204)..(204): a, c, t, g, unknown or other
  misc_feature (204)..(204): n is a, c, g, or t
  modified_base (393)..(393): a, c, t, g, unknown or other
  misc_feature (393)..(393): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcactccaccgacggaccacgtggtcgtcccagcctaggttcaggtgggagtgggtcgtgggacagtagttcactctccacatcagcagtcngcagtcggaagtatttgcttagtttactagttgtcagtcaagtacgtaaggtaaccggccgtactcgtacgtttacgggcggtaacggacccgtaagggtggacgtaacgtaccgtaaacggtaacgtacgggtacggacgtaagcccgtaacctacgttaccgtttcggttaccttcgttaacccg

SEQ ID NO: 125041 - DNA, 615 bp, Homo sapiens
  misc_feature: GYAE6OF02HVYQU.9.39.D06.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagatacccactggagaaatagtgatgacgcagtctccagccaccctggctgtgtctccaggggaaagngccaccctctccngcagggccagtcagagtgttagtagtaggttagctggcaccagacaaaaacctggaccacgcctcccaggctcctcatctatgatgcatcccaccacgaccacgtggtcgtccccagcctaggttcaggtagggcggtggttcgtgggacagtacgtcactctccactatcagtcgagtctgactaggtacggaagtagtttgacttagtttacttattcgtactagtactagttagttaacggtaacgggtccctacgttaccgtaccgttttcgggaccgggtaacgggaaccgtaagggtacggtacgtacgtaaccgtaaacggtaacgttagggtacggaccgtacggaccgtaccgtacgttaccgtttacgttaccttaccgttacccg

SEQ ID NO: 125042 - DNA, 592 bp, Homo sapiens
  misc_feature: GYAE6OF02I8H4K.9.39.D06.1.454.CMB.1.raw
  modified_base (206)..(206): a, c, t, g, unknown or other
  misc_feature (206)..(206): n is a, c, g, or t
  modified_base (255)..(255): a, c, t, g, unknown or other
  misc_feature (255)..(255): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaaanacgcccaccctctcctgcagggccagtcagagtgttagtagtaggttancctggcaccagcaaaaacctggccagcctcccaggcctcctcatctatgatgcatccaccaggaccactcggtgtcccagccaggttcaggtgggagtgggtctgggacaggtacgttcactctcaccatcagcatctgcagtcggaatgtttgacttagtttactattgtactagctagttattagggtaaccgggtccgtactacgtaccgtttccgggacgggtacgggtaacccgtaaggggttacgggagtacgtacggaaaccggtaaccgttagggtacgggtacttacggaccctaacgtacgttacgtacgttccgttacgtaacccg

SEQ ID NO: 125043 - DNA, 596 bp, Homo sapiens
  misc_feature: GYAE6OF02GFKQM.9.39.D06.1.454.CMB.1.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangcccaccctctcctgccagggccagtcagagtgttagagtggttancctgcacagcaaaaacctggccagccctcccaggcctcctcactcctatgatgctactccaccacggaccacgtggtcgtcccagcctaggtcagtgggagtcgggtcgtgggacagtagtttactcgtcacctatcacgcagtctcgacgagtcggaattacgttgacgtagtttactgttgtcagtctaggttataggtaaccgggccgtacgtcctacggtttccggacggggtacggaccgtaaaggtcgggaacgtacgtaccggaaaacgtacggttacggtcggtaacgtccgaccgtaacctcgttaccgttcggtaccttaccgtcgttacccccg

SEQ ID NO: 125044 - DNA, 521 bp, Homo sapiens
  misc_feature: GYAE6OF02IYN9Y.9.39.D06.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (374)..(374): a, c, t, g, unknown or other
  misc_feature (374)..(374): n is a, c, g, or t
  modified_base (517)..(517): a, c, t, g, unknown or other
  misc_feature (517)..(517): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccagggggaaangccaccctntcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccntcagcagtctgcagtcggaagtattttgctagtttactattcgtcagcagttataggtaacgggccgtctcgtacgttcgggacggagggaacctaagggtcggagagtacgaaacgacgtggtcggctgcactatctgtctntacg

SEQ ID NO: 125045 - DNA, 534 bp, Homo sapiens
  misc_feature: GYAE6OF02IJICF.9.39.D06.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (519)..(519): a, c, t, g, unknown or other
  misc_feature (519)..(519): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagttgttagtagtaggttagcctggcaccagacaaaaacctggccagcctcccaggctcctcatctatnatgcactccaccaggaccactggtctcccacgccaggttcaggtgggtaggtggggtctgggacaggtacgttcactctcaccatcagcagtctgcnggtacggagtnttttgcttagtttactattgtacngtcagtatagtaccgggctcttcgtacgtttcggcggagggaccagggtggagagtacgaaacgaactggtacgcgtagaccacctnttcgcgttctatccg

SEQ ID NO: 125046 - DNA, 698 bp, Homo sapiens
  misc_feature: GYAE6OF02G4CH2.9.39.D06.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgacatctcgcagttctttgggggagaactgctcagttaggacccagacggaaccatggaagcccagcgcagcttctcttcctcctgctactctgggtcccagataccactggagaaatagtgatgacgcagtctccagccacctggctgtgtcctccgaaggggaaancgccaccctctcctgcgagggccagtcagtagtgttagtagtaggttagccgtggcaccgagaccaaaaccgtggaccagtccctcccacggcctccgtcctatctagtcgtactgcactacccaccgacggacctacgtcggtcgtcccgacgccgtaggttcgagggtggggtacggttcggggtacgtacgggacgtagtacgttaccacttcctaccacctactaccgacgcgtacgtcgtagacgtaggttacggtaagttagttttacgactttacggtttaacttagtttacgtacgtacgtacgtaacggttacgtaacgggttaaccgggtccgttacgttaccgttaccggtttccggggaaccggggtaacgggtaacgtaaggggtacggtacgaacgttaaccggaaacggtacggttacggtacggaccgtacggtacccgtaccgttacgttccgtttacggtttaccttacttacccg

SEQ ID NO: 125047 - DNA, 524 bp, Homo sapiens
  misc_feature: GYAE6OF02GCLLC.9.39.D06.1.454.CMB.1.raw
  modified_base (204)..(204): a, c, t, g, unknown or other
  misc_feature (204)..(204): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangcccaccctctcctgcagggccagtcagagtgttagtagtaggttagcctggcaccagcaaaaacctggaccagcctcccaggctcctcatctatgatgcatccacagaccactggtctcccagccaggttcaggtgggagtgggtctgggacagagttcactctcaccatcagcagtctgcagtacggtaagtatttgacttagtttactatttgtcagtctagttataggtaccggccgtcgtcctacgtttcggacggtacggacgtaggtggagtacgtacgaaacgtacgtgtggctgcactntctntctntacc

SEQ ID NO: 125048 - DNA, 622 bp, Homo sapiens
  misc_feature: GYAE6OF02GN54B.9.39.D06.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (416)..(416): a, c, t, g, unknown or other
  misc_feature (416)..(416): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctcctgcagggccagtcagagtgttagtagtaggtancctggcaccagacaaaaacctggccagcctcccaggctcctcactctatgatcgcactccaccacggaccactggtcgtcccagcctaggttcaggtgggaggtcgggtcgtgggacaggagttcgactctcacctatcagctagtctgacgaggtacggaagttnttttacgacgttagtttaacttagtttgtactagtctaaggttagttaacgggtaaccgggtccgtcgttaccgttaccggtttccggggaacgggtacgggtaaccggtaagggtcggaacgtacgtaaccgaaaacgggtacctagggtacgggtctacggtacccgaaccgtacgttcctttacggttcccttacgttacccg

SEQ ID NO: 125049 - DNA, 604 bp, Homo sapiens
  misc_feature: GYAE6OF02HC2BQ.9.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtccagagtgttaagtagtaggttagcctggcaccganacaaaaacctggccagcctccgaggctcctcatctangatgcatccacgacgacactgtcgcctagccaggtcagtgggagtggtctgggaacaggacgttcgacttcgtccacgataccgagtctagtacctggcctagtacggagttaacgttttgctaagtttactacttggtaacctgacgagttaatacgggtaaccggcctagttcctaccggttacggtcgggaaaccggtaacgaacgggttagggagaaagttcccggaaaacggtaccttaggttaccgggactttacggactaaccgaactttcggtacggtttacccttacgtaaccc

SEQ ID NO: 125050 - DNA, 518 bp, Homo sapiens
  misc_feature: GYAE6OF02G5OHS.9.39.D06.1.454.CMB.1.raw
  modified_base (204)..(204): a, c, t, g, unknown or other
  misc_feature (204)..(204): n is a, c, g, or t
  modified_base (513)..(513): a, c, t, g, unknown or other
  misc_feature (513)..(513): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaaacctggccagcctcccaggctcctcatctatgatgcactccaccaggaccactggtgtcccagccaggttcaggtgggagtgggtctgggacagtagttcacttctcaccatcagcagtctgcagtcggaagtattttgactagtttactattgtcagctagtataggtaccgggcctctcgtacgtttcgggcggagggaccgaggtggagagtacgaaacgacgtgtggtctgcacatctgtctntaccg

SEQ ID NO: 125051 - DNA, 596 bp, Homo sapiens
  misc_feature: GYAE6OF02H4XBG.9.39.D06.1.454.CMB.1.raw
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (396)..(396): a, c, t, g, unknown or other
  misc_feature (396)..(396): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagagtaggttancctggcaccagcaaaaacctggccagcctcccaggctctcatctatgatgcatccaccaggaccactggtgtccccagccaggttcagtgggagtgggtctgggacaggagttcactctcaccgatcagcagtctgcagtcggaagnttttgactaggtttactagtttcgtctagacagttagtaaggtaaaccgggcccgtcttaccgtacgttttccgggacgggtaacgggaacccgtaaggggttacggacggtaacgttaccgaaaaccggtaaccgttcgggttacgggaccgttcgaccgtacccgaagttcccgttacggttaccttacgttaacccg

SEQ ID NO: 125052 - DNA, 520 bp, Homo sapiens
  misc_feature: GYAE6OF02GCIK2.9.39.D06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (395)..(395): a, c, t, g, unknown or other
  misc_feature (395)..(395): n is a, c, g, or t
  modified_base (514)..(514): a, c, t, g, unknown or other
  misc_feature (514)..(514): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaangccaccctntcctgcagggccagtcagagtcgttagagtaggttancctggcaccagcaaaaacctggccagcctcccaggctcctcatctatgatgcatccaccagaccactggtcgtcccagccaggttcaggtggagtgggtctgggacagtagttcactcacaccatcagcagtctgcagtcgaagtntttgcttagttactattgcagcaggtatacggtaacgggcgtctctacgttcgggcggaggaccaaggtggagactacgaacgtactggcggactgaccacgtacttcgtcgttacttntacccg

SEQ ID NO: 125053 - DNA, 625 bp, Homo sapiens
  misc_feature: GYAE6OF02GVMTR.9.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (397)..(397): a, c, t, g, unknown or other
  misc_feature (397)..(397): n is a, c, g, or t
tcagtgatacgtctcacgaccggtgctcgatttagtgacatctcgcagttctttgggggagaactgctcagttaggacccagacggaaccatggaagccccagcgcagcttctcttcctcctgctactctgggtcccagataccactggagaaatagtgatgacgcagtctccagccacctggctgtgtctccgaaggggaaancgccaccctntcctgccgagggccaggtcaggagttgttagagtaggtancctggcaccagacaaaaacctggccagcctccaggctcctcatctatgatgcataccaccaggacccagtggtcgtacccagccaggttcgaggtgggagtgggtacgtgggacagtacgtcaacgtctaccacctaatcgancgtagtcgtacgctaggtacgaagttactttggactagttttaactagttgtacacgtagtaagttaataacgggttaaccggcgtaccgtcgtaaccgtttccggggaacgggtaacggaacgaacgggtaggtacgtaacgtaacggaaaaccggtaacgttacgggtagtaccggttagtacccgtaaccgtaatttccgtacggtttaccgttacgttaacccg

SEQ ID NO: 125054 - DNA, 778 bp, Homo sapiens
  misc_feature: GYAE6OF02ICH98.9.39.D06.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
  modified_base (741)..(741): a, c, t, g, unknown or other
  misc_feature (741)..(741): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctcagccacctggctgtgtctccgaaggggaaacngcccaccctctccngccgagggccagtcagacgtgttagtagtaggttncctggcaccagaaccaaaaaccgtcggacccacgccctacccgaggccctcctactactccttaatggacttgcctaactacccaccgaacggacccgtacgttcggtccgtaccccgacgtccgtaacgggttcgagggttaggggacgggtttcggggtaccgttgggggtaaacaacgggttacggtttaccgaaccgtttcccgtaccaaccctaaccgttcggtaaccgtaccgttacggtttaccgtacggtacgggttaacggtaaaccgggttaaagttacggttttttacggtaccgtttaagtttttaaaccgttacgttttacgtacgtaaacgtaccgttaagggttaacggtaacccggggttaaaccgggtccccgtaaggttacctttaccggggtttaccggggaacgggtacgggtaacgtacgggtgaacgtacgtaacgggaaacgtaccgtgggtaccgtacggtanacccggtaacttcgtacgttcggtttaccacgttacc

SEQ ID NO: 125055 - DNA, 874 bp, Homo sapiens
  misc_feature: GYAE6OF02HLMCG.9.39.D06.1.454.CMB.1.raw
tcagtgatacgtctcacgaccggtgctcgattttagtgacatctcgtcgtagtttcctttcggggaggaactggcgtcagttacggacccagacggaaccgactggaacgcccgagcgacagcttcgtctttccgtccctgctacgtctaggggtcccctaggatacccactcggagaaacttagtgactggacgctaggtctccacgcctaccctgggtcttggtttcgttcgtccggaaggggtaaacggaccggcccaacccgttccttcccgtagggacggacgggtccgaagttccaggtaggttaggtttaggttacgttacggttacgccgttggccgtaaccgtacgtacctaaaaaaccgtcgggaccctacgtacccctcccgaagggtccttacccgtacgtaactaccctaagttacgtaacttcgtaccgtaaccttaccccgaccgaacgggtaccctaacgttcggttaccgtttaccccaggtaccgtacggtttacgaacgggttcggggtaggttacggggttaccggtacgggtactaacggttaacggtttacccggtaacgttttccgttaccgaccgttacgttaccgaacggtccgtaacggttacttacggtacgttacgggttacggtttaacggttagtttttacggtactttaacggtttaacttacgttacgtacgacggtacggtacgttacgtaccggtaacgggccgtacgttacgttaccggttcgggacggtaaccggtacgtaacgggtcggtaccgtacgtaaccggtaaacggtcgtacggttacggttccgtaccggtacgtaccctaccgttccgtacgttacgtaccttacccgg

SEQ ID NO: 125056 - DNA, 631 bp, Homo sapiens
  misc_feature: GYAE6OF02GPYCM.9.39.D06.1.454.CMB.1.raw
  modified_base (259)..(259): a, c, t, g, unknown or other
  misc_feature (259)..(259): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagtgatacgtctcacgaccggtgctcgatttagtgacatctcgcagttctttgggggaggactgctcagttaggacccagacggaaccatggaagccccagcgcagcttctcttcctcctgctactctgggtcccagataccactggagaaatagtgatgacgcagtctccagcccaccctggctgtgtcctccgaggggaaagacgcccaccctctcctgccagggcccagtcagagtgttagtaggttaggttancctggcaccagacaaaaacctggccacgcccctcccgaggcctcctcacttctataggatcgactactcccaaccgacggaccacgtggtccgtcccacgccaggttcgaggtgggaggtgggtcgtgggacaggtacgtcactccacaccntcgngcagtcngcaggtcggaagttgttagcttaatttacgtattgactagtactaagtacgttacggtaacgggtcctaccttacgtaccggttacgggacgggtaacgggtaaccgtaacgggtaggtacgtaacgtaaccggaaaccggtaacgttcgggtacggtccgtacgtacccgtactaaccgttaccgtttcgttaccttcgttaccccgg

SEQ ID NO: 125057 - DNA, 619 bp, Homo sapiens
  misc_feature: GYAE6OF02GIEPX.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgccaccctctcctgcagggccagtcagagtgttagtagtaggttagcctggcaccagacaaaaacctggccagccctcccaggcctcctcatctatgatgcatccaccgaggaccacgtggtcgtcccacgccgtaggtcaggtggggagtgggtctgggacagtacgttcactctacaccatcgacgcagtctggacgtaggtacggtaagttagttttacgacgttaagttttactagtttgtacgagtcgtaagttaacgttaaggtaacccgggtcctcgttaccgttacgtttccggggaaccggtaacgggtaaccggtaagggtaggtacgaacgttaaccggaaaacggtacgttagggtcggtacgtcgacgaaccgttcgtccttcgttccttacttacccg

SEQ ID NO: 125058 - DNA, 791 bp, Homo sapiens
  misc_feature: GYAE6OF02I9MZA.9.39.D06.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagactaccactgtagaaatagtgatgacgcagtctccagcccacctggctgtcgtctccgaaggggaanacgccaccctctcctgcagggcagtcagagtgttagngtaggtanctgcacgagacgaaaacctggaccncgcctccgaggcctccgcctactctatgtactcgcctactacccgaccgtaccggaacccgtaccgttacgggttccgtaccccgaccggtacccgtacggttccgaaggggttcggggtaacggttcgggggtaccgttgggggaacctacggtagtttacccgaaccgttccgtaccgaacccgtatccgggtaaccgacgttaacggtccgttacggaccgttaacgggtaacgggtaaacgtttacggttttcggtaacgtttaacgggtttaacctttcggtttaccgttcgtaacggtcttaaacggttaacgttaacgggtaacccggggttcccgttaagtcccgtttacgggttaccgggtaccggggtaacggtaaaccgggttacgggtaacggagttaaccgtaacccggttaaaacggaccgttggggtaaccggttcgtaaccggttaaccgtacccgttaccggtaccgttttaccggtacccgttttaacgaccccgg

SEQ ID NO: 125059 - DNA, 573 bp, Homo sapiens
  misc_feature: GYAE6OF02GOPU7.9.39.D06.1.454.CMB.1.raw
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
  modified_base (411)..(411): a, c, t, g, unknown or other
  misc_feature (411)..(411): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtcctccagccacctggctgtgtctccgaggggaaangcccaccctctcctgcagggccagtcagtagtgttagtagtaggttacnccgtggcaccagacaaaaacctggaccagcctcccaggcctccgtcactctatgatgcatccacacgaccacgtcggtcgtcccagccaggttcaggtgggaggtgggtcgtgggacagtagttcactctacacatcagcagtctgcagtacgagtntttcgctagtttactgttcgtcagtctagtagtacggtaccggccgtctacgtacgtttccgggacgggtacggtacgagggttagacgtaacgtacgaaacggtacgttacgggtgtccgtacgtaccgtaccgtcttaccgtggttaccttcgttacccg

SEQ ID NO: 125060 - DNA, 611 bp, Homo sapiens
  misc_feature: GYAE6OF02GW2GH.9.39.D06.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (528)..(528): a, c, t, g, unknown or other
  misc_feature (528)..(528): n is a, c, g, or t
tcagtgatacgtctcacgaccggtgctcgatttagtgacatctcgcagttctttgggggaggaactgctcagttaggacccagacgggaaccatggaagccccagcgcagcttctcttcctcctgctactctgggtcccagataccactggagaaatagtgatgacgcacgtctccagccaccctggctgtgtctccgaggggaaancgccaccctctcctgcgagggccagtcagngtgttagtagtgttacgccgtggcaccagacaaaaacctggaccagccctcccaggctcctcatctatgatcgcactccaccacgaccntcggtctccngccgagtcgaggtggaggtggtcgtggacgagtacgtcacctctcaccactcagctagtctgcgtacggtacggtagttagtttcggacttacgttttacttagttgtacgtagtacttaagtacgttacggtaccgggccgtaccttcggtttacggttaccgggacgggtacgggaacccggttaagggnggtaacgtaccgtaaccggaaaaggtacggttacggtcggtacttcggaccaccgttagtccgttacgttcgttcttacccgg

SEQ ID NO: 125061 - DNA, 612 bp, Homo sapiens
  misc_feature: GYAE6OF02F3H0F.9.39.D06.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaanagccaccctctcctgcaggccagtcagngtgttagtagtaggttagcctggacaccagcaaaaacctgaccagcctccaggctcctcatctatgangcactaccacacgaccacgtggtcgtccagtcctagtcagtgggagtgggtctggactagacgttcactcctacacctatcacgcacgtctcgacaggtacggaagtagttttcgacgttaagtttactagtttcgtactagtacctagttaacgtaacggttaccgggcccgtacgttacctacggtttccgggaccgggttaacgggaacccgtaaggggttacggaagtacgtaaccggtaaacggtaaacgttggtacggtaccgtacgaccgtaaccgtattacccgtcgttaccttccgttaacccg

SEQ ID NO: 125062 - DNA, 624 bp, Homo sapiens
  misc_feature: GYAE6OF02GWF8Y.9.39.D06.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaangccaccctctcctgcagggccagtcagngtgttagagtggtancctgcacagcaaaacctggccagcctcccaggcctcctcatctatgatgcactccaccacggaccacgtcggtcgtccccagaccgtacggttcaggtggggagtggggtcgttaggggacaggtagttccactcctccacctactcgaacgccgtaagtctggacgtacggttacggaagttattttcggacttaagttttactacgtttcgtacacgtactaagttaactaggtaaccgggccgtaccttacgtacgtttcgggacgggtaaacggtaaccgaagggtacggtagaacgttacgaaaaccggtaacgttgggtaacggtacgttaggacctaccgtacgttcgttcggtttacttacgttacccg

SEQ ID NO: 125063 - DNA, 550 bp, Homo sapiens
  misc_feature: GYAE6OF02F133D.9.39.D06.1.454.CMB.1.raw
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttancctggcaccagcaaaaaacctggccaagcctcccaggctcctcatcctatgatgcatccaccaggaccactggtgtcccagccaggttcagtgggagtgggtctgggacaggagttcactctcaccatcagcagtctgcagtcgaagtagtttgcttagtttactattgtctagacagttataaggtaaccgggcgtactcgtacgtttccgggacggtacgggaaccgtaagggtcggagacgtacgaaacggtaactggtaggacctggacctaccacgttcttcgtcgttctaaccg

SEQ ID NO: 125064 - DNA, 608 bp, Homo sapiens
  misc_feature: GYAE6OF02FMBWV.9.39.D06.1.454.CMB.1.raw
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaanacgcccaccctctcctgcagggccagtcagagtgttagtagtaggttancctggcaccagcaaaaacctggccagcctcccaggctccctcatctatgatgacatccaccaggaccactggtctccagcctaggttcaggtgggaggtcgggtcgtgggacaggtagttaccactctacacctatcgacgtcacgtctgcgtacggtacggtaagtagttttagacgttagtttaactagtttacgtcgagtaccgtagttaacgtaagggtaaccgggcccgtacgttacgtaccggtttcgggacggtacggaaccggtaagggtacgagtaacgtaccgaaacggtaacgttggtacggtcgtacgtccgaacctacgttcgtacgttccttacgttacccg

SEQ ID NO: 125065 - DNA, 695 bp, Homo sapiens
  misc_feature: GYAE6OF02HSSUC.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccgtggctgtgtctccgaaggggaaancgcccaccctctcctgcgacgggccagtcagtagttgttaagtagtaggtcgctgacaccgagaccaaaaacctggaccacgccctccgaggcctcctactactctatgatcgcactccacgacgacctacgtcggtcgtacccaggtccgtagtcgagggtgggtagggtcggtcgtacgggacgtaggtacgttacaccgtactcaaccgtataccgacgaccgtacgttcgtggtaccgtacgggtaacgggtaacgttagttttaccggtacgtttaacgtttaacgtttagtttcggtacctaaggtactaaggttaacgtaaacgggttaccgggtccgtacgttaccgttaccggtttaccggggaccgggtaaacggggtaaccgtaagggggtacgtaacggtcgtaaaccgaaacggttaacggtacggttcggcctacgaccgtaaccgttagttccgttacgttcttaccgttaccc

SEQ ID NO: 125066 - DNA, 685 bp, Homo sapiens
  misc_feature: GYAE6OF02GAULT.9.39.D06.1.454.CMB.1.raw
  modified_base (205)..(205): a, c, t, g, unknown or other
  misc_feature (205)..(205): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctcctgcagggccagtcagagtgttagtagtaggttagccgtggcaccagaccaaaaacctggaccagcctcccaggcctcctcatctatgatcgctactcccaaccacggacccacgttcgggtacgtccccgacgccgtaggttaccgaggtggggaggttggggtcgtggggaacaggtacgtttccacgtcctaccaacctactacgacgctacgttcgtagcgtaggtacggtaagttacgttttacgacgtttacggttttaacttagtttcgttaccgaagtctaagttagttacgggtaaccgggtccgtaccgttaccgttaccggtttaccgggaccggggtaacgggtaaccgtaacggggttaggacgtaacgtaaccggtaaaccggtaaccggttcgggtacgggtaccgtacggtaccctaccgtacgttccgtacgtttacccttacgttaccccg

SEQ ID NO: 125067 - DNA, 707 bp, Homo sapiens
  misc_feature: GYAE6OF02H0Z7N.9.39.D06.1.454.CMB.1.raw
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
  modified_base (314)..(314): a, c, t, g, unknown or other
  misc_feature (314)..(314): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggaagaaatagtgatgacgcagtctccagccaccctggctgtgtctcgaggggaaagngccaccctctcctgacagggccagtcagagtgttagtagtaggttancctggcaccgagaacaaaaccgtggaccacgcctcccgagcctcctcatactatagtatncactaccaaccgacggacctaccgtggtcgtaccacgccgtaggtacgagggtggggtagtgggttcggaggacgaagtgtacactcctcacatacgagactagtcctgacgtaggtacggtaaagttcgttttaggacgtttaacgttttaacgttagtttacgtaacggtacgttacgtaaaggttaacggtaaaccgggttaaaccgggtacccgttacccttaccggttaaacccgggttttaccgggaaccggggtaacgggtaaccggaagggtccgggtaacgtaaccgttaaaccggaaaacgggttacgttaacggggcgttaccgacggttacccgtaaacccttacggtttaccgtaacgttttacccgtactttaacccgg

SEQ ID NO: 125068 - DNA, 642 bp, Homo sapiens
  misc_feature: GYAE6OF02IEFMX.9.39.D06.1.454.CMB.1.raw
  modified_base (206)..(206): a, c, t, g, unknown or other
  misc_feature (206)..(206): n is a, c, g, or t
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccgaggggaaangcccacctctcctgcgagggccagtcagagttgtagtagtaggtanctgcacagacaaactgcacgcctccngctccncatctatgatgcactccaccagaccacgtggtactcccgacgtccgtaggtcgaggtcggtaggttcgggtcgtagggacaaggtacttccacttcctccaactactaccgacggtacgtacgttaccgtcgacgtaggtaacggtaagttacgttttacgtacgttaaggttttactagtttacgtaccgaagtacgtaaggttagttaacgggtaaccgggtccgtaccgttaccgttaccggtttcgggaaccgggtacgggaaccgtaaggggtagacgtacgtaaccgaacgttaccggtggtaccggcgtacggaccctaacgtacgttccgttcggtttctacgttacccg

SEQ ID NO: 125069 - DNA, 602 bp, Homo sapiens
  misc_feature: GYAE6OF02HEQWC.9.39.D06.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggtancctggcaccagacaaaaacctggccagcctcccaggcctcctcatctatgatgcactcccaccacggacccacgtcggtcgtccccacggcctaggttcaggtggggtaggtcggggtcgtgggacaggtacgttacactcctccacctatccagctaacgtctcgactaggtacggtaagttagttttcgacttagtttactattcgtcagtctagtagttaacggtaaccggtccgtacttccgtaccggtttccgggcgggtacgggaaccgtaaggggtggtagaacgtaccgaaacggtacttagggtcgagtacgacctaccgtacttcgtcgttactcttacccg

SEQ ID NO: 125070 - DNA, 784 bp, Homo sapiens
  misc_feature: GYAE6OF02H218Y.9.39.D06.1.454.CMB.1.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
tcagtgatacgtctcacgaccggtgctcgatttagtgacatctcgcagttctttgggggaggaactgctcagttaggacccagacggaaccatggaagccccagcgcagcttctcttcctctgctactctgggtcccagataccacgtggagaaatagtgatgacgcagtctccagccaccctggctgtgtctccgaaggggaancgcccaccgtctcctgcgacgggccagtcagngttgttaagtagtaggttacncgtggctaccagaccaaaaacgtcggaccacgccctccgaacggcctccgtaccagttcctaatcgtactcgactactaccccgaaccgacggaccctacgtacgggtcgtaccccgacgccgtacggttaccgtaagggttggggaacggttgggtcggtacgggaacgtaggttacgttcctaccgtccgtaccaacgtacgttccgacgtaccgtacgtcgttgacgtaagtacgggtaagttagttttaccggacgtttaaacgtttcgtttaacgttacgttacgtaacgttacgtaacgggtttaaacgttaacggggttaaaccgggtccccgttacgtttaacccggttaccgggtttacgggtaaacccggggtaaacggggtaaccgttaaggggttaccggaacggttaaccggttaaaccggaaacggtttaaacgttacgggtcggttaacccgtacggtacccgtaaccgttacgtttacccggttttgtacccggtttaccttaaccccgg

SEQ ID NO: 125071 - DNA, 636 bp, Homo sapiens
  misc_feature: GYAE6OF02HHWPH.9.39.D06.1.454.CMB.1.raw
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgccaccctctcctgccgagggccagtcagagtgttagtagtaggttancctggcaccagacaaaaacctggaccagcctccaggctcctcatctatgatcgcatccacgacgacctactggtcgtcccacgcctaggttcaggtcgggtaggtgggtcgtagggtaactaggtacgttacacgttctacgtaacctactacagtacgtacgtcgttcggacgtaacgggtacggtaaaggttattttcgtacgttaacggttttacttagttgttacagtactaagtacgtaacggtaaccgggtcgtaccgttacgtaccggtttcgggacgggtaaacggaaccgtaagggtgacgtaacgtacggaaaacgtacgtaggtacggcgtacgactaccgtaagttcgttcggttaccttacgtaacccg

SEQ ID NO: 125072 - DNA, 1046 bp, Homo sapiens
  misc_feature: GYAE6OF02ISC16.9.39.D06.1.454.CMB.1.raw
  modified_base (99)..(99): a, c, t, g, unknown or other
  misc_feature (99)..(99): n is a, c, g, or t
  modified_base (212)..(212): a, c, t, g, unknown or other
  misc_feature (212)..(212): n is a, c, g, or t
tcagtgatacgtctcacgaccggtgctcgatttagtgacatctcgcagttctttgggggaggaactgctcagttaggacccagacggaaccatggaacnccccagcgcagcttctcttcctcctgctactctgggtccagactaccacgtggaagaaatagtgatgacgcagtctccagccaccgtggctgtcgtctaccggaaggggaaanaccgccctaccgtcttaccgtaggccgaacggggtaccctaggtaccaagggttacgttagtttaacggttaggttaacggggtttacgtacccgttagggaacccgtaaacccgtaacgggtaaaaacccctaaaaaaacccggttcggggaaccccctaaaccgggtacccccgtttaacccccggaacggggttacccccttttaccccgtaacgttaaaccgtttacccgtttaaagtaccgggtaacgtttaccggacccgttaaacccgttaaccccgaacccgggtaaaccgggtaaccccgttaacgggtttaccgggtacccgtaacccccggtaacgtaccccgggttaacgggtttaccgtaaagggggttacggggtaaccgggtttacgggggtacggttaaccggggtaacgtaaccgggttacgtttacccggaaacctttaccggtacccgtaaacctaccggttacgaaccggtaccgtttaaaggtccgtaaccgggtaactaacgggttaacgggtaaacgtttcggttttacggtacgtttaaacgttttacggttactttaccgggtactaaccggtatttaaacgggtaacggttaaaccgggtacccgggtacccgttacgttaaccggttacccgggtttaccggggtaaccgggtaaaccgggttaaaccgtacgggggttaacgaaccgttaaacgttaacccgggtaaaacgttaaacggttccgggaaccggttccggttaaacgtacccgttaaccgtttaccgtaacccggtttacgtttaaccccgttaccgttaacccccgg

SEQ ID NO: 125073 - DNA, 566 bp, Homo sapiens
  misc_feature: GYAE6OF02FI46I.9.39.D06.1.454.CMB.1.raw
  modified_base (204)..(204): a, c, t, g, unknown or other
  misc_feature (204)..(204): n is a, c, g, or t
  modified_base (440)..(440): a, c, t, g, unknown or other
  misc_feature (440)..(440): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggcctcctcatctatgatgcatccaccaggacccacgttggtcgtccccagcctaggttcaggtgggaggtggggtcgtgggacgaggagttcactctcaccatcagcagtctgacagtacggaagtatttcgcttagtttactattgtacagtanagttataggtaacgggcgtcgtctaccgtttcggacggtacggaaccgaggtacgggagacgtaccgaaacggtaaccgttagggtcgtacgtggaccactacttaccgtcgttccttacgtaccg

SEQ ID NO: 125074 - DNA, 702 bp, Homo sapiens
  misc_feature: GYAE6OF02FS68T.9.39.D06.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctcagccaccctggctgtgtctccgaggggaaanagccaccctctcctgcagggccagtcagagtgttagtagtaggttacnccgtggcaccagacaaaacctggaccagcctacccgagcctcctacacttcctatgatcgcctacgtaccaaccgacggaccacgttcggtccgtaccccgacgtaccgtacggttacgacgggttaggggtacggttacggggtaccgtaggggaacgtaggtacgtttaccgacgttccgtaccaccacgtacacggtactacgttcgtcgacgtacggtacggtaaagttagttttacgacgttaacgttttacgtagtttcgtacgtagtacgtagttagtaacggtaaccggtccgtacgtaccgtacggtttcgggaaccgggtacgggtaacgtaacgggtaggacgtacgtaaccggtaaacggtacggttacgggtacggttaccgttacggaaccgttaccgttaccgttaccggttcgttttaccgtaccgtttacccg

SEQ ID NO: 125075 - DNA, 811 bp, Homo sapiens
  misc_feature: GYAE6OF02JCXWC.9.39.D06.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
  modified_base (533)..(533): a, c, t, g, unknown or other
  misc_feature (533)..(533): n is a, c, g, or t
  modified_base (782)..(782): a, c, t, g, unknown or other
  misc_feature (782)..(782): n is a, c, g, or t
tcagtgatacgtctcacgaccggtgctcgatttagtgacatctcgcagttcgtttgggggagaactggctcagttaggacccagacggaaccatggaagccccagcgcagcttctccttcctcctgctactctgggtcccagactaccagtggacaaatgtgatgacgcagtctccagccacctggctgtcgtcaccgaagggaacncgtccaccttcncctgccagggccagtaccaggtcgttagttacgagttaacggttanccgttggcctaccgaagaccaaaaaccgtcggaccaacgtccccgtaccccgacggcccttccgtactacgttacctagtacgtagtacgtcctaactaccgaacccgtacgggaaccctaccggttacggttaccggtccccgaacggaccgttaacggtttcgtaacggggtccgggtacgggttccgggtacggtaggggacctacggtacggttaccgtacctaccgtaccgtaccgattaccgaacgtcgttaacggtttccnggggtaccgtaagggtaccgggtaaagtttaggttttaccggacggtttaaacgttttacgtttaacggtttcgtaacctagttacggtaaacttaagggtttaacccggtaacccgggacctttacggtttaaccgtacggtttaccgggaccgggttaaaccggtaacgggtaagggtacggtaacgtaacggtaaccggaacggtttaaaccgtgggtccggtactaacggtccctaccggttacncccggtttagtacccgttacttaaccccg

SEQ ID NO: 125076 - DNA, 567 bp, Homo sapiens
  misc_feature: GYAE6OF02FH585.9.39.D06.1.454.CMB.1.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (358)..(358): a, c, t, g, unknown or other
  misc_feature (358)..(358): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccagggggaaangcccacctctcctgcagggccagtcagagtgttagtagtaggttancctggcaccagcaaaaacctggccagcctcccaggctcctcactctatgatgcatccaccaggaccactggtcgtcccagccgtaggttcaggtgggagtgggtcgngggacagagtcactctcaccatcagctagtctgcagcggtaagtatttcgcttagtttactagttcgtacagactaggtaatacggtaacgggcccgtcttaccgtacgttttcgggtacggacgggtaccgaaggggtggagtaacgtaccgtaaaacgacgttaggtcggtactcggactaccgagttcgtacgttacttcttaccg

SEQ ID NO: 125077 - DNA, 535 bp, Homo sapiens
  misc_feature: GYAE6OF02FG5UT.9.39.D06.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (520)..(520): a, c, t, g, unknown or other
  misc_feature (520)..(520): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaangccaccctctcctgcagggccagtcagngtgttagagtaggttancctggcaccagcaaaaacctggccagcctcccaggctcctcatctatgatgcatccaccacggaccactcggtcgtaccccagccctaggttcgaggtcggggagttggggttactggggacaggacgttaccacgttcctccaccatccgaagcacgtcgtgcagtcggaagtactttgctagtttactattcgtcagctagtatagtacggccnctcacgtttcggcgtaggacctaggngagancgaaacgatggtcgtcacgcaccgntcgtcgttctctacc

SEQ ID NO: 125078 - DNA, 728 bp, Homo sapiens
  misc_feature: GYAE6OF02GDWH5.9.39.D06.1.454.CMB.1.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgccacctctcctgcagggccagtcagagtgttagtagtaggttanccgtgcaccagaccaaaaacctggaccagccctcccgaggcctccctcatctatagatgctactccaccgacgaaccctacgtggtcgtacccacgccgtaggttacgaggtcggggaggttcggggtcgtaggggactaggtacgtttcacgttctccaaccgtatcgacgtacgtagttccgtacgtcgtaacgggtaacgggtaaagttaacgttttcggtaccgttaagtttttaactaacgttttacggttaccgaagtacgttaagggtttaaacgttaacggggtaacccgggtacccgttaccgtaccgttaccggtttaccggggtaaccggggtaaccgggtaaccgggtaaagggggtggtaacgggtaaccgtaaccggtaaaacgggtaccggttagggtccggtacgtaccgtaacccgaccgttaccgttacggtacgtttacccgttaccgttaaccccgg

SEQ ID NO: 125079 - DNA, 768 bp, Homo sapiens
  misc_feature: GYAE6OF02HSVW0.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaaancgcccaccctctcctgcgacgggccagtcagtacgttgttagtagtaggttagccgttggcaccgagaaccaaaaaccgtcggaccacgcccctccgacggcctcctacactctatgatgctactaccacgacgacctacgtcggttccgtcccgacggtccgtacgggttacgtaggggtaggggtacgggttcggggtcggtacgggacgtaacgggttacgttaccgtaccttaccgtaccaacgtactacgacgtacgtacggttacgtggaaccgtacgggttaacggtaaacgttcgttttaggtacgttaacgttttaacttaagtttcgttaccgtaacggtacgtaacggtttaacgtaaccggggttaaccgggacccttaccgtttaccggttaccgggtttaccgggggtaaccggggtaaaccgggtaaaccggtaagggttaacgggaacgtaacggtaaccggtaaaacggtaacggttcgggttacggaccgttcggaacccgtaacgttaccgtttacggttcgtttacccttaccgttaacccg

SEQ ID NO: 125080 - DNA, 658 bp, Homo sapiens
  misc_feature: GYAE6OF02H2KXI.9.39.D06.1.454.CMB.1.raw
  modified_base (205)..(205): a, c, t, g, unknown or other
  misc_feature (205)..(205): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctggtcccagataccactggagaaatagtgatgacgcagtctccagcccacctggctgtgtctccgaggggaaancgcccaccctctcctgcagggccagtcagagtgttagagtagtagcctggcaccagacaaaacctggaccagcctccgaggctcctcatctatgatcgctactcccaccgacggacctacgtggtcgtacccacgaccgtaggttaccgaggtggggaggtcgggtacgtagggacgaacgtacgttaccacttcctaccaccacgtcgacgtactacgtctagaccgtaggtacggtaacgttgtttacgtacgttaacgtttacttagtttcgtacacggtataacggttaacgtacgggttaaccgggccgtacgttaccgtacggtttccgggaacgggtacggtaaccggtaagggtcggtaggaacgtaacgaaaacggtacgttacggtcggtaccgtacgacccgtaaccgtacgttccgtttacgtttaccttacgttaacccg

SEQ ID NO: 125081 - DNA, 764 bp, Homo sapiens
  misc_feature: GYAE6OF02HQCV5.9.39.D06.1.454.CMB.1.raw
  modified_base (205)..(205): a, c, t, g, unknown or other
  misc_feature (205)..(205): n is a, c, g, or t
  modified_base (432)..(432): a, c, t, g, unknown or other
  misc_feature (432)..(432): n is a, c, g, or t
tcagtgatacgtctcacgaccggtgctcgatttagtgacatctcgcagttctttgggggaggaactgctcagttaggcccagacggaaccatggaagccccagcgcagcttctcttcctcctgctactctgggtcccagataccactggagaaatagtgatgacgcagtctccagcccaccctggctgtgtctccgaggggaaangcccaccctctcctgccagggccagtcgagagttgttagtagtaggttagccgtggcaccagaccaaaaaccgtggaccacgccctcccgacggccttcctccactctatgatgcactcccaacacggacccagtggtcgtcccagcctacggttcaggtgggtaggtggggtacgtgggggaactagggtacgttaccgtactcccgtaccacctaacttcggaanccggttaacgttccgtcgacgttaacggggtacggttaaacgttgtttttacggcgttaagttttacgttacgtttacggttcgaagtacctaagggtttaacgttaaccggggttaacccgggtaccgttaccgttacccggttttaccggtttacccgggggaacccggggttaaacgggtaaacccgggtaaaggggtccggggttaacggtacggtttaaaccccgggtaaacgggttaacccggttaagggttaccgggacggttacccggtaacttacccggttaacgtttccggtacgttttacccggtacccgttttaccccgg

SEQ ID NO: 125082 - DNA, 704 bp, Homo sapiens
  misc_feature: GYAE6OF02JZULR.9.39.D06.1.454.CMB.1.raw
  modified_base (332)..(332): a, c, t, g, unknown or other
  misc_feature (332)..(332): n is a, c, g, or t
tcagtgatacgtctcacgaccggtgctcgatttagtgacatctcgcagttcgtttggggagaactgctcagttaggacccagacggaaccatggaagccccagcgcagcttctcttcctcctgctactcgtggtcccaagactacccagtggaagaaatagtgatgacgctagttcctccgaacgcccacccgtggccttggtcgtacctacccgaagggggtaaacgcgacccacccctctccgtgcgacggccagtcagtagtcgttagtacgtaggtacgcctggcacgagaccaaaaccgtgaccacgcctacccgacgtcctccgtntactactacgtgtatcgacactaccaaccgacggacctcgtcgtaccgtaccgacaccgtagttcgagggtcgggacggttggttccgaggtacgtagtacgtcgaacctcgtaccacgtactacgacgtactacgtcgttagaccgtaacgggttcgtaaaggtttcgtttagtaaccgtttagtttaacccgtttaagttccgacgtaagtacgttaaacggttacgtaaccgggttaccggaccgttacgttacggttaccggtttacgggaccggtaaaggaacggttaggtacggagtacgtacgaaacggttagtcggtaacgtcgtaacaccgttaccgactttacgtccgttacttaccgtccg

SEQ ID NO: 125083 - DNA, 668 bp, Homo sapiens
  misc_feature: GYAE6OF02FMIB3.9.39.D06.1.454.CMB.1.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (447)..(447): a, c, t, g, unknown or other
  misc_feature (447)..(447): n is a, c, g, or t
tcagtgatacgtctcacgaccggtgctcgatttagtgacatctcgcagttctttgggggaggaactgctcagttaggacccagacggaaccatggaagccccagcgcagctttctcttcctcctgcctactctgggtccccagataccactggagaaatagtagatgacgcagtctccagcccaccctggctgtcgtctccgaggggaaagagacccaccctctcctgcgacgggccagtcagagtgttagtaggtagtacgctggcacagacaaaaaccnggccacgcctcccgacggctaccctnatcgtatgatcgacactaccaccgacggacctacgtcggtccgtacccacggaccgtaggttaccgagggtgggaggttcggggtacgtagggaacaggtcgtttactcgtacttaccacctatacgagaccaggttacncggtacctaggtaccggtaagttagtttacgaccgttaagtttacgttagttacgttacgaattacgtaaaggttaacgttaaccggtaacgggcccgttagttaccgttcggttaccgggacgggtaacggaaccgtaagggttgggaactagtaaccgtaaacggtaacggttggtaacgggtctaaggtaccagtacgttactcggtacttcgtaccg

SEQ ID NO: 125084 - DNA, 666 bp, Homo sapiens
  misc_feature: GYAE6OF02I1KYO.9.39.D06.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctgctgtgtctccaggggaangccacccntcngcgagggccagtcagagtgtagagtagtagctgcacanacaaaactggccacncctccagctcctnatctancgatgaccatccacgacgaccacgtcggtcgtacccagacgtaggttacaggtggggaggttcggggtactagggacagtacggttacaacgttctacacctatcgagcagtctgacgtaggtacggaattacgtttgacttaagttactttagttagtacctaagacgtaagtaacgttaacgggtaaccgggtccgtaccgttacgtacggtttaccggggacgggttaaacgggaacccggtaaagggtcgggaagtaaacggttaacccgtaaaaccgggtaaccgttacgggtaacggggttacccttaacgggtaacccctaaaccggtaaccgtttaccggtttacccggtttaccctttaccgttaaccccgg

SEQ ID NO: 125085 - DNA, 645 bp, Homo sapiens
  misc_feature: GYAE6OF02FT3CB.9.39.D06.1.454.CMB.1.raw
  modified_base (373)..(373): a, c, t, g, unknown or other
  misc_feature (373)..(373): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaagagcccaccctctcctgcagggccagtcagagtgttagtaggtaggttagcctggcaccagacaaaaacctggccagccctccgaggcctcctcatctatgatgcataccaccgacggacctacgtggtcgtccccgagcctaggttcgaggtgggagttcgggtacgngggacaggtagtacctctctcaaccgtactacagcctagtactgtaccaggtaccgggtaattaggttttcgactttaaggtttacttacgtttagttccgagtacgtaagttaaggttaacggtaaaccggggtccgtacgttaccgttaccggtttcgggagggtaaccggacgtaaggggtacgacggtaactaccggtaaaaacggtggttcggtaaggtacgttaccggaccgtacttacggttcctcggtttcgtttcctaacccg

SEQ ID NO: 125086 - DNA, 623 bp, Homo sapiens
  misc_feature: GYAE6OF02F6TDO.9.39.D06.1.454.CMB.1.raw
  modified_base (429)..(429): a, c, t, g, unknown or other
  misc_feature (429)..(429): n is a, c, g, or t
tcagtgatacgtctcacgaccggtgctcgatttagtgacatctcgcagttctttgggggagaactgctcagttaggacccagacggaaccatggaagccccagcgcagcttctcttcctctgctactctggtcccagactaccactggaacgaaatagtgatggacgcagtctccagccacctggctgtgtctaccaagggaaacgcgaccctaccctctcctgacacgggacctagtccaaggcggttagttaacggtagtaacggttgcccgttggcaccagacaaaaaaccgtggaccacgcctacccgaggcctccacatactatacgatcgcactccacgaggaccacgtcggtctcccgagacctaggttcgacggtgggacgtgggtacgtacgggtacgagtacgtcacgtactcgaccancgagcagtctcgacgacggtaccggaaagttcgtttacgtacgtaagtttactagttcgtacagtacgtagtaacggtaagtaaccgggcgtaccttcgtacgtttacgggcggtaagggtaactagggtgacgaagtacgaaacgtacgtggtaccgctacggaccacgtactcgttacgtcttacgtacccg

SEQ ID NO: 125087 - DNA, 692 bp, Homo sapiens
  misc_feature: GYAE6OF02HQYVL.9.39.D06.1.454.CMB.1.raw
  modified_base (205)..(205): a, c, t, g, unknown or other
  misc_feature (205)..(205): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctcctgcagggccagtcagagtgttagtagtaggttagcctggcaccagacaaaaactggaccacgcctcccaggcctcctacactactagtagatcgaccactaccctaaccgacgtaacccgaacgttcgggtaccgtaccccgtacgaccgtaaggttaccgagggttaggggtacggttacggggtcggtacgggtaacgtaaggtacgttacctaccttaccgtaccaaccgtacgtacgaacgaccgtaagtcgtagaccgtaggtacggtaaacgttcgtttacgtacgtttaatttaacgttattacgtacgtacgtacgtaaggtaaacgttaacgggtaaaccggtccgtacgttaccgttacgttaccggggaacgggtaacggaacgtaagggtagacgtaacgtaaccggaaacgtacgtaaggtcgtacgtacgaccacgtacgttcctacgttcctactacccg

SEQ ID NO: 125088 - DNA, 660 bp, Homo sapiens
  misc_feature: GYAE6OF02IIG14.9.39.D06.1.454.CMB.1.raw
  modified_base (152)..(152): a, c, t, g, unknown or other
  misc_feature (152)..(152): n is a, c, g, or t
  modified_base (167)..(167): a, c, t, g, unknown or other
  misc_feature (167)..(167): n is a, c, g, or t
  modified_base (207)..(207): a, c, t, g, unknown or other
  misc_feature (207)..(207): n is a, c, g, or t
  modified_base (258)..(258): a, c, t, g, unknown or other
  misc_feature (258)..(258): n is a, c, g, or t
tcagtgatacgtctcacgaccggtgctcgatttagtgacatctcgcagttctttgggggagaactgctcagttaggacccagacggaaccatggaagccccagcgcagctttctcttcctcctgctactctgggtcccagataccactgganaaatagtgatcgacncagtctccagccacctggctgtgtctaccgaaggggaaancgccctaaccctctacctgccagggccagtcagagtgttagtagtggttancctagcacagacaaaactggacagcctaccagctcctcatctactgatgacatccaccacggaccacgtgtactcccagcctagtcaggtgggatcgggtcgtagggacaggtagttacaacgtcctacgaaccagtacacgactacggtcgtacgtacgaggtacggtaaacgttatttacggtacgttaacggtttttaacttaaggtttcgtaccgttaagtactaaggttaactaaggggttaacccggtcccgtactacccgttaggtttacccggggaccgggtaacgggaaacccgtaagggttaccgggacgttaacgtaaccgtaaaacggtaaccgtacggtacggtaccgtacgtacctaaccgtacttccggtacgttcttactacccgg

SEQ ID NO: 125089 - DNA, 727 bp, Homo sapiens
  misc_feature: GYAE6OF02GOF25.9.39.D06.1.454.CMB.1.raw
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctggtgtctccgagggaagacgcccacctctcctgcgacgggccagtcaagtagttggttagtaggttaggttagccgtggccaccgacgaaccaaaaaaccgtcggaccgaacgccccgtacccgacggtccttccctactacttcctaagtgaacgtcgacctaccgtacccaccggacggaccgtaacggttcggtaccgtcccgacgccgtacggttcgtagggtcggggtagttcggggtcgtacgggacgtacggtacgttaccgtacctaccgtaccacctacgttccgacgtacctacggttctacggacgtacgggtaacggtaacgtttaacgtttcgtacgttaagttttaacttagtttcgtaacgtagacgtacgttaacgttaacgggtaccggccgttacgtcgtaccggtttacgggccgggtaaagggaaccggtaagggtaggtacgtaacgtaacggtaaaccggtacgttaggtacggtccgtacgacctacgtacgttccgtacgtttccgtacgttacccg

SEQ ID NO: 125090 - DNA, 680 bp, Homo sapiens
  misc_feature: GYAE6OF02F2ECE.9.39.D06.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccgaggggaaanagccaccctntcctgcagggccaggtcagagttgttagtagtaggttagcctggcacagacaaaaacctggaccagccctacccaggcctcctcatctatnatgactactccaccgagacctacgtggtcgtaccccagcctacggttacgaggtggggagttcggggtctaggggactaggtacgttcaccgttctaccgtaactacgtacgacgtacgtaacgttcctggtacctacggttaacgggtaaactttacgtttttacggacgttttaacggttttaaccgtagtttacgtactagtacctaggttaacgtaacgggtaacgggccgtaccgttacgttaccggttccgggaaccggaacggggtaaacccgtaggggttaggacgttaacctaaccggtaaacggtaaccgttaggtccggtactacggacctaccgacgttcttacggtacctaccgttaccg

SEQ ID NO: 125091 - DNA, 682 bp, Homo sapiens
  misc_feature: GYAE6OF02I9K3B.9.39.D06.1.454.CMB.1.raw
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagtaaatagtgatgacgcagtctcagccacctgctgtgtctccgaggggaaagacgcccaccctctcctgcgacgggccaggtcaggagttgttaagtagtaggttagccgtggcacagacaaaaaccgtgaccacgcctcccgagtcctcctnatctangatgctanacccaccaggacctacgtggtcncccgagaccaggttacgaggtgggaggtcgggtacgaggggtacaaggtacgttacactcctaccactatacgacgntacgtntacggtcgtacggtacggtaagttacgtttagacgtttaacgttttataagtttacgaccgtagttaccgtaaggttacggttaaacgggtaacccgggtccgtaccgtaccgtttaacgggtttcccgggtacgggggaaacgggtaaccgtaacggggtacgggacgttaactaaccgggtaaaacggtaaccgttagggtaccggacctttacggaaccaccggttactaccgtttcgttaccgttacctaccg

SEQ ID NO: 125092 - DNA, 667 bp, Homo sapiens
  misc_feature: GYAE6OF02II1G7.9.39.D06.1.454.CMB.1.raw
  modified_base (152)..(152): a, c, t, g, unknown or other
  misc_feature (152)..(152): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactgganaaatagtgatgacgcagtctccagcccaccctggctgtgtctccgaaggggaanagcccaccctctccngcgagggccngtcagagtgttagtagtaggtcgcgtggcaccgagaccaaaaaccgtcggaccacgccctcccgacggtccttcctactactcttatcgtagtcgcactacccaccgacgacctacgtcggtcgtaccacgtcctaggtcaggtcgggagtgggtacgtggacgtagtacgttacacgttctcacctacgtcacgactacgtctcgacgtagtacggtaattgtttacgacttaacgtttacgttacgttagtaccgtagtacgtaggttaacgttaacgggtaccggtaccgtaccgttaccgttaccgggtttaccggacggggtaacggtaccgtaaggggtacgtacggtaacgtaccggaaaacggtacgttacggtaccggtcgtacgtacccgtacgttaccgttccgtacgtttcctaccgttacccg

SEQ ID NO: 125093 - DNA, 602 bp, Homo sapiens
  misc_feature: GYAE6OF02GJZDH.9.39.D06.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaacngcccaccctntcctgcgagggccagtcagagtgttagtagtaggtagcctggcaccagacaaaaaccgtggaccacgcctacccgacggcctcctcatctatgatcgacactccaaccgacggacctacgtcggtcgtcccgacgccgtacggttcgagggtgggtaggttcggggtcgtagggactaggtacgttacactcctacacctatacagtcacgtcgtgcgtaggtacggaagttagtttcgacttagtttactattcgtcagtactagttacgtaacggtaccggccgtcgtaccgtacgttcgggacggtacggtaacgtagggcgagactaacggaacggtacgtggtcggtctacgctaccgtgtcgttacgttccttataccg

SEQ ID NO: 125094 - DNA, 817 bp, Homo sapiens
  misc_feature: GYAE6OF02FU8I7.9.39.D06.1.454.CMB.1.raw
  modified_base (158)..(158): a, c, t, g, unknown or other
  misc_feature (158)..(158): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (320)..(320): a, c, t, g, unknown or other
  misc_feature (320)..(320): n is a, c, g, or t
tcagtgatacgtctcacgaccggtgctcgatttagtgacatctcgcagttctttggggagaactgctcagttaggaccccagaccggaaccatggaacgccccagcgcagcttctcttcctcctgcctactcctggttccccagactacccactgganaaaatgtgatcgaccggtccagttcctcccagcccacccgtggcttagtgtcctccgaggggaacacgccctacccctntcctgccaggccagtccagnttgtagtagtacggtacnccgtggccaccagccaacccgtgccacgcccctcccgacggtccncctccatcctatcgtactgactacctaccgacccgaacgtacccgacgttccgggttaccgtaccccgtacgtcccgtaacggttccgacggttcggggtaacgggttcggggttaccgtacgggtaaccgtacggttaccgttacctacccgttccctaccgtaacccgtacctaccgtaaccggtaccgtaaccgttccgtacggtaccgttaccgggtaaccggttaacggtttaacgtttccgtaaccgttacgttttaaccttacgtttacgtacccgtacgtaccggttaacggttaacggttaacccggttaacccggtacccggttacccgtaaccgtttaaccgggttaccggggtaaccggtaaacgggtaaccgtacggggtaacggtacgtaacgtacccggtaaaaccggtaccgtaccgggttacgaccgttaccgacccttaacccgtaccgttccgtaccgttaccttaccccgttacccg

SEQ ID NO: 125095 - DNA, 641 bp, Homo sapiens
  misc_feature: GYAE6OF02IX3O1.9.39.D06.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaatagtgatgacgcagtctccagccaccctggctgtgtctccgaggggaangccacctncctgcaggccagtcagngtcttagtagtaggttancctggcacagcaaaaccgtggaccagtcctcccaggtcctcctcatactactgactgcactccgacctacggaccacgttggtctcccgagccgaggtttccaggtcgggtacgtgggtcgtgggacaggagttccagtccacgacctatcgagctaggtctacgcgtacggttaccggaagttacgttttacaccgtttaagtttaaccttagtttaccgactacggtacctaagttaaggttaaccggtaaccggttaccggcgttaccgttaacggtttccggggaacgggtaccgggtaacgtaaggggtcgaggaactttaacgaaacgggttactgggttacggacgtcggtaccgtacctaggttacgttcggtacccttgtacccgg

SEQ ID NO: 125096 - DNA, 655 bp, Homo sapiens
  misc_feature: GYAE6OF02HN2SI.9.39.D06.1.454.CMB.1.raw
  modified_base (159)..(159): a, c, t, g, unknown or other
  misc_feature (159)..(159): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
tcagtgatacgtctcacgaccggtgctcgatttagtgacatctcgcagttctttggggagaactgctcagttaggacccagacggaaccatggaagccccagcgcagcttctcttccctctgctactctggtacccagactaccacgtggagaaatgtnatgacgcagtcctcagccaccctggctagtctacctcgagggaaancnccacctctcctgcgagggccagtcagtagtgttagagtaggtcgctggcacagacaaaaccngcacgccnccngctcnctatctacntnagcactccacgtacgacctacgtgtcacccagacgtagtcgtaggtggacgtggtcgaggaccagtagtccgaactccgacacgtactcagctagtccttagacggtaagttacgaagtttagttacgaacgtttaacgttaacgtttagtacgttaccgaacggttactaaacggttaacggtaaccgggtaacccggtaccgtaccttacggtttaccggtttacgggaaccggggtttaaaccggaacgttaacggggtacgtaaggttaccgtaaaccggaaaggtaccgttaaggtccggaacgtaccgacccgtacggtaacttcccgtttaaggtttcctaccgttaacccg

SEQ ID NO: 125097 - DNA, 591 bp, Homo sapiens
  misc_feature: GYAE6OF02F3028.9.39.D06.1.454.CMB.1.raw
  modified_base (173)..(173): a, c, t, g, unknown or other
  misc_feature (173)..(173): n is a, c, g, or t
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtcncagccaccctggctgtgtctccaaggggaaangcccacctctctgcagggccagtcagagtgttagtagtaggttanccgtggcaccagacaaaaaccgtggaccagcctcccaggcctacctcatctatgactgcctatcccacacggaccacgtggtactcccagaccgtaggtcaggtgggtagtcgggtactgggactaggtacgttcactcctacgacctagtcgagtacaggtctggactaggtacgtaagttgtttacgcgttagtttacgttagttcggtacagtactaagttaacgtacgtaacgggcctacgtacgtacggtttcgggacggaggtaaccgaggtacgagtactacggaaacgtacgtggtacgtcgtagacgtaccgtataccgtctacgtataccg

SEQ ID NO: 125098 - DNA, 591 bp, Homo sapiens
  misc_feature: GYAE6OF02GTXV7.9.39.D06.1.454.CMB.1.raw
  modified_base (209)..(209): a, c, t, g, unknown or other
  misc_feature (209)..(209): n is a, c, g, or t
  modified_base (301)..(301): a, c, t, g, unknown or other
  misc_feature (301)..(301): n is a, c, g, or t
  modified_base (541)..(541): a, c, t, g, unknown or other
  misc_feature (541)..(541): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccgagcccacccgtggctgtgtcctccgaggggaaangacccaccctctcctgcgagggccagtccagtagtgttagtagtaggtagcctggacaccagacaaaactcggccacgcctccagcctcctnactctagtgatcgctactccgacacggaccacgtcggtcgtacccgagtaccgtacggttacgaggtgggaggtggtcgtagggactagtacgtcacgtctacaccatacgagactagtctacgacgtaggtacggtaagttgtttcgacttaggtttaccttagttcgactagacttagtacgtacggtaaccggcctcgttacctacggtttcggacggtacgtacgtaggtcggtanacgtacgaaagtaccgtgtacgtcacgtacgactacgtcttgtctacgtc

SEQ ID NO: 125099 - DNA, 824 bp, Homo sapiens
  misc_feature: GYAE6OF02I4DL1.9.39.D06.1.454.CMB.1.raw
  modified_base (204)..(204): a, c, t, g, unknown or other
  misc_feature (204)..(204): n is a, c, g, or t
  modified_base (254)..(254): a, c, t, g, unknown or other
  misc_feature (254)..(254): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagtaaatagtgatgacgcagtctcagcccaccgtggctgtgtctccgagggaancgccacctctcctgacgacggccagtcgagagtagttagtagtagttacnccgtggcaccgagaaccaaaaaccgtcggaccacgccctacccgaggtcctaccctacacttacctagtcgtacgtacgcctaacctacccgaaccgaaccggtaaccctacggttcgggtacccgtaccccgacgtaccgttacggttacgtacggggttacgggtacgggttcggggttacgtacggggtaacgtacggttaacgttaccgtaccgttaccctacgtaacccgtactaccgaacgtactacgtacgtacgtacgtaacggttaacgggtaaactttaacggtttcgttaaaccgttaacgttttaaacgtaggtttaccgtaccgtaacggttaacttaaggttaacgttaaaccggggtaacccggttacccgtaccgttaccggttaacccgggtttaacggggacccgggtaaacgggtaaccggtaaacggggtacggtaaccgttaaccggttaaaccggaaaacgggttaccgtacggggttaccgtaccgttaacgggaccccttaacggttaccgttaccgtttacggttacccttacggttaacccccg

SEQ ID NO: 125100 - DNA, 834 bp, Homo sapiens
  misc_feature: GYAE6OF02HF2FS.9.39.D06.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaancgccaccctctccgtgcgagggccagtcgagagtgttagtagtaggtagcctgcacanacaaacncgcacgccnccacgctctcatctatgntcgcacaccaccacgaccacgtcgtacgtaccgcgaaaaaaaaaaaccgtcggtacgtacggtacggggtagggtcggggtcggtacgggtaacggtacggtacgttaccgtacccgttaccgtacccgtaaccgtaacgttaccgtaacggtaccgtaaccggttaccgttacggtaccggtaacgggttaaccgggttaaacgggttaacggtttttacggttacggtttaaacggtttttaaaccgtttaacgttttacggttaccggttaacggtaacggttaaacggtttaaacggttaaaccgggttaaacccggggttaacccgggtacccgtttacccggttaacccgggtttaaccggggttaaccgggggtaaaccggggtaaaccgggtaaacggggttaacggggtaacggtaacggtaaccggtaaaaaccgggtaaaccggttacgggttaaccgggtaccggttaccggtacccgtaaccgttaccgttaccggtttaccgtttaccgttacccgttaacccg

SEQ ID NO: 125101 - DNA, 801 bp, Homo sapiens
  misc_feature: GYAE6OF02HLZNL.9.39.D06.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
tcagtgatacgtctcacgaccggtgctcgatttagtgacatctcgcgagttctttgggggaggaactgctcagttacggacccagacggaaccatggaagccccagcgcagctttctcttcctcctgctactcgtcgggtcccagactaccactggaagaaatgtgatgacgcagtctcacgccaccgtggctgtcgtcctcggaaggggaancgccaccctcgtccngaccgacggcctagtcgagtagtgttagtagtaggtcncnggtacacgaacgaacctaaaaccgcggaccacgtccctaccgccggtcctcctacacttcctaagtcgtagtcgtacaactcccgaaccgtacggtaccacgtcggtccacccgacgtaccgtaggtacgagggttgggacgggttcggtcggtacggacgtacggtaacgtttaccgtaccgttcctaacctacgtacgttacaccggttacggtacgttaccggagtaacggtacgggttaacggttaacggtttacgtttaaccgggtaccttttaaagggttttaacctttacgggtttacgtaacggtaacgtacggttaacgggttaacggttaaccggggtaacccggtccgttaacgttacccggttaacggggttccggggtaaccggggtaacgggtaacggtacgggggttacgaggtaaccgttaaacgggtaaacggtaccggttagggttaaccggtacgtaaccggtacgttaacccggttacgtttaccggttaccgtttacttaacccggtttccc

SEQ ID NO: 125102 - DNA, 631 bp, Homo sapiens
  misc_feature: GYAE6OF02F94H9.9.39.D06.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctgggctgtgtctccgaggggaaacnggccaccctntcctgcagggccagtcagngtgttagagtaggttagccgtggcaccagacaaaaacctggaccagcctcccgaggctcctcatctactgatgacactccaccgacggaccacgtcggtcgtacccgagaccaggttcaggtggggtaggttcggggtctaggggactaggtagttccacgttcctaccgacctagtccgtacgactaggtcctgtcgacgtacgggtaagtacgtttacggcctaaggttttactacgtttaggtaccaagtctaagggtactacggtacgggtcctaccgttcgtacgtttcggacggtaacgggaccgtaagggtacggtagtacgtaaccaaacggtactacgggttcggtacgtcgtacacgtacgttactccggttacctcgttacccg

SEQ ID NO: 125103 - DNA, 728 bp, Homo sapiens
  misc_feature: GYAE6OF02FOB5Y.9.39.D06.1.454.CMB.1.raw
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (353)..(353): a, c, t, g, unknown or other
  misc_feature (353)..(353): n is a, c, g, or t
  modified_base (552)..(552): a, c, t, g, unknown or other
  misc_feature (552)..(552): n is a, c, g, or t
  modified_base (699)..(699): a, c, t, g, unknown or other
  misc_feature (699)..(699): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctcagccacctggctgtntctcgagggaangccacctntcctgcngggcagtcagngttgttagacgtaggtacgccgtggctaccgacgactaaaaacctcggtaccacggtaccctccccgaggtcctacccttcgattacctaagtggtacttagcctactaccgaaccgacggtaaccncggttaggtaccgtacccgaacgtccgtaacggggttctaacgggttggggtaggtacggggttcggtacgggtacgaaggtacgtttacacgttccttcaaccgtactcgaacggttcaaggttctcggcgtaagggtaccggtaaacggttagttttaccgcgtttaacgttttactaggtttcggtaacacggttntaacggttaaaccgttaaggacccgggtacgtacccgtttaggttaaccgttcgggaaccgggtacggtaaaccggttagggtaacggtggtaacgttaaccgggaaacgttccgtaagggtcccgtacgttacgtcctaaccggtnttacccggttcgtttacgtccttaacccg

SEQ ID NO: 125104 - DNA, 603 bp, Homo sapiens
  misc_feature: GYAE6OF02GHWKH.9.39.D06.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatgtgatgacgcagtctccagccaccctgctgtgtctccgaaggggaancgccaccctctcctgcgagggccagtcagngtgttagtagtaggttcgcgtggcacagacaaaccnggaccagcctccaggctcctcactctatgactcgactacgtacccaccgaacggtacctacgtacggtccgtacccgacgtccgtacggttcgagggtgggaggttgggtcgtagggacaggtcgtaactcgtacctccaactacgtcagtctacgtcgtcgacgtaggtacggtaagttacgtttacgattaacgtttactattcgatacgctagtagtacggtaccggtctcgtacgtacgtcgggcggtaacgacgggtagtacggagtaacgtacgtaacgtacggttggacggtacgtcgactaccgtagtctcggttactcgtacccg

SEQ ID NO: 125105 - DNA, 685 bp, Homo sapiens
  misc_feature: GYAE6OF02F0OSN.9.39.D06.1.454.CMB.1.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaaggggaaancgccaccctctcctgcgaggccagtcagagttcgttagtagtacggttagccgtggctaccagaccaaaaaccgtggaccagcctcccaggcctcctcatactagtcgatcgcactccaacacgaaccctacgtcggtcgtcccacgcctacggttcaaggtcgggaggtcgggtcgtacgggactaaggacgtttcgtaacctcctaccgtaacccgtacgtacaacggtcaacggttacgtgaccgtacggtaacgggtaaacgtttagttttcgaccgtttagtttaaacgttactttaggtcccgtaaggtaccttaggttaacgttaacggtaacgggtcccttacgtaccggttacgttcgggaaccggtacgggaaaccgtaggggtagtagtacgtaacggaaacggttaacgtggtacgtaccgttacggacgtaccctaggttccctaggtttcccgtactttaacccg

SEQ ID NO: 125106 - DNA, 737 bp, Homo sapiens
  misc_feature: GYAE6OF02GK1PI.9.39.D06.1.454.CMB.1.raw
  modified_base (168)..(168): a, c, t, g, unknown or other
  misc_feature (168)..(168): n is a, c, g, or t
  modified_base (207)..(207): a, c, t, g, unknown or other
  misc_feature (207)..(207): n is a, c, g, or t
  modified_base (255)..(255): a, c, t, g, unknown or other
  misc_feature (255)..(255): n is a, c, g, or t
  modified_base (425)..(425): a, c, t, g, unknown or other
  misc_feature (425)..(425): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccacgtggagaaatagtgatgacgnagtctccagccaccctggctgtgtctccgaggggaaacngcccacctctcctgcagggccagtcagtagtgttagtagtaggttacncctggcaccagacaaaaacctggaccacgccctcccgaggtcctcctacactacgtatgaacttgacctcgtaccaccgtacggacctacgtggtccgacccgacgtaccgtacggttcgagggtgggtacggttggggtccgtagggaaccgtaggtaacgggtttacnccgtttacctaccgtaaccctacgtaccgtacggtaactcggttacctaggtaccgtagggtaccggtaaaggtttacgttttacggacctttaacggtttaattgtttaacgtacgacgttctaaggttaacgttaacgggtaacccgggttccgtacgtttacccggttacgttacggggaccggaacgggtaccgtaaggggtacggtaagtaaccgttaacggaaaccgtaacggttcgggttaacggtacgtaccgtacccggaccgttaccggttaccctttaccgttaccgtttacgttaccccg

SEQ ID NO: 125107 - DNA, 739 bp, Homo sapiens
  misc_feature: GYAE6OF02F50BP.9.39.D06.1.454.CMB.1.raw
  modified_base (223)..(223): a, c, t, g, unknown or other
  misc_feature (223)..(223): n is a, c, g, or t
  modified_base (346)..(346): a, c, t, g, unknown or other
  misc_feature (346)..(346): n is a, c, g, or t
  modified_base (461)..(461): a, c, t, g, unknown or other
  misc_feature (461)..(461): n is a, c, g, or t
  modified_base (706)..(706): a, c, t, g, unknown or other
  misc_feature (706)..(706): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagactaccactggagaaatgtgactagacgcagtctacacgccaccctggctgtgtcctacggaaggggaaagacgcccaccctntaccgtgacgacgggcctagtcaaggtagttgttaaggtaaggttaggttacgccgtggacctaccaacgaacctaaaacgtcgaccgacgcccctccgacgtcctacctacatactagtcgntccgtactaccgtaccacgacggtaccctagtcgggtaccgtaccacgtacgttacggtacgtaggggtacggtacggttcgggtacgtacggactacggtcctacgaccttccnccgtaacgtacgtcctaacggacgttaccggtctaacgggtctaacgggtaccgttaagtttcgtttacgaacgtttttacggttaacttcgtttaacgacccgtttaaggtaccttaaggggttaacgttaaccggggacccgtttccgtacgttaccgttaccgggttaccggggaacggttaccggaaggtaacgggtagtaccgtaaagaccgtaaaggttaccgtaggtccgaccgttanaccgttactcgttctcgttacctccgttacccg

SEQ ID NO: 125108 - DNA, 492 bp, Homo sapiens
  misc_feature: GYAE6OF01EHLUV.33.6.A06.1.454.CMB.1.raw
  modified_base (485)..(485): a, c, t, g, unknown or other
  misc_feature (485)..(485): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatcttcccgccatctgaagtgtntgtctgg

SEQ ID NO: 125109 - DNA, 694 bp, Homo sapiens
  misc_feature: GYAE6OF01BCVQX.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctccctgcgacggccagtcagacttgttacgcgacggccggtctttcgttacgccgtacggtaccagacaacgtaaaccgtcggaccgaggtccctccgaggtcctccttcttactagtgatgactactaccgaacgacgggcccagtcggcacctcccgagccgtaggttcgaggtcgggcgggttcggtcgtacgggacgagtaccttcaccttctaccgaacctatacgacgacacgtaccgtaaggacgtccgtaaggaaacgtttacgttttcgacgtttaagttttacttaacgttcgtacgacggtacgtaacggtcggtaacgaccttaacggttcgggtttaccgttacgggtaccggtttaccggaaccggtaacgggtaaccgtaagggtaacgtaaactacgaaaacgtacgtggtacgtacgtagaccaactcgttacgttcgttaccgttctacttcccgtccccgacttacgtcgtaggtacgttgtcggttacgtcgtacggg

SEQ ID NO: 125110 - DNA, 496 bp, Homo sapiens
  misc_feature: GYAE6OF01A8N50.33.6.A06.1.454.CMB.1.raw
  modified_base (488)..(488): a, c, t, g, unknown or other
  misc_feature (488)..(488): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatactggggagacgttcggccaagggaccaaggtggaaatcaaacgaactgtggctgcaccatctgtcttcatcttcccgcatctgaagtgtgtgtactgngcgggtcg

SEQ ID NO: 125111 - DNA, 605 bp, Homo sapiens
  misc_feature: GYAE6OF01AGTAX.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccagggacagagccaccctctcctgcagggccagtcagactgttagcagcggcttcttagcctggtaccagcagaacctggccaggctccaggctcctctctatggtgcactccaccagggccacgtcggcactcccgagacgacggttcaggtcggacgaggtcgggtctacgggaacagtacttcgaactctacaccatcgacacgacgtggacgcctagaagtatttgactagtcttattactgtacgagctagtacgtacgtaggggacgtaccggttacggaccgaacgggaccgtaagggtacggaaacgtacgaaaccgtaacgtaggtacggtaccgtacgaccgaaccgtacgtcgttcgtccttaccgtacgttcccgttcccgtacctacgtcgttacggtacgttcgtacgttacgtacgtcggacggtcgggtacgg

SEQ ID NO: 125112 - DNA, 498 bp, Homo sapiens
  misc_feature: GYAE6OF01CUMFM.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacaggacttcactctcaccatcgacagactggagcctgaagtattttgcagtgtattactgtcagcagcgtagcaactggtcttggacgttcggccaagggaccaaggtggaaatcgaaacgactgtggctgcacatctgtcttcatcttcccgcctatctgaagtgtgtgtacgtgg

SEQ ID NO: 125113 - DNA, 501 bp, Homo sapiens
  misc_feature: GYAE6OF01D5QLP.33.6.A06.1.454.CMB.1.raw
  modified_base (493)..(493): a, c, t, g, unknown or other
  misc_feature (493)..(493): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgctagtctattactgtcagcagtatactggggagacgttcggaccgaagggaccgaaggtggaaagtcaaacgaactgtggctgcaccatctgtcttcatcgttcccgcatctgaagtgtgtgtatgngcgggtcg

SEQ ID NO: 125114 - DNA, 577 bp, Homo sapiens
  misc_feature: GYAE6OF01CEK9E.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttctagcctggtaccagcagaacctggccaggctccaggctcctcctctatggtgcatccaccagggccactggcatccagacagttcagtgcagtgggtctgggacagacttcgactctcaccatcgacagactggagcctgaacgtattttgactagtctaattactgttcagcaagtatacgtgggagtacggttcggaccgaagggaaccgtaaagggtggtaaaatacgtaaaacggaaccgttaggtacgggtcttaggaccaaccgtacttaccgttggttaccttcgtaacttccgttccccgtaccctacttccgttagtaaggttacgttgtacggttactggtaggtccgggtacgg

SEQ ID NO: 125115 - DNA, 502 bp, Homo sapiens
  misc_feature: GYAE6OF01APVXK.33.6.A06.1.454.CMB.1.raw
  modified_base (495)..(495): a, c, t, g, unknown or other
  misc_feature (495)..(495): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggcctagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatacgtggggagtacggttcggccgaagggaccaagggtggaaatcgaaacgaactgtaggctgcaccatctgtcttcatcttcccgcatctgaagtgtgtgtatgngcggtcg

SEQ ID NO: 125116 - DNA, 383 bp, Homo sapiens
  misc_feature: GYAE6OF01DDUII.33.6.A06.1.454.CMB.1.raw
  modified_base (379)..(383): a, c, t, g, unknown or other
  misc_feature (379)..(383): n is a, c, g, or t
tcagtacacacactcacgaccggtgctcgatttagatctactgacagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcagcagactggagcctgaagattttgcagtgtattactgtcagcagtacggtagttcatctcgacgttcggccaagggaccaaggtggaaatcaaacgaactgtggctgcaccatctgtcttcatcttcccgccatctgaagtgtgtgtactgagcgggctggcaaggcgcatagnnnnn

SEQ ID NO: 125117 - DNA, 491 bp, Homo sapiens
  misc_feature: GYAE6OF01ARJJF.33.6.A06.1.454.CMB.1.raw
  modified_base (363)..(363): a, c, t, g, unknown or other
  misc_feature (363)..(363): n is a, c, g, or t
  modified_base (469)..(470): a, c, t, g, unknown or other
  misc_feature (469)..(470): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagacacctggccaggctcccaggctcctcatccatggtgcatccaccagggccactggcatcccagacaggttcagtggcagtgggtctgggacagacttcattctcaccatcagcagactggagcctagaagtnttttgctagtgtattactgtcagtcagtacgtagttcatctccgacgttcggaccaaggaccgaaggtacggaaatacgaaacgacgtgtgctgcacatctgtctnntctcncntcanagtgtgtacg

SEQ ID NO: 125118 - DNA, 520 bp, Homo sapiens
  misc_feature: GYAE6OF01CLEVJ.33.6.A06.1.454.CMB.1.raw
  modified_base (510)..(510): a, c, t, g, unknown or other
  misc_feature (510)..(510): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgtagcagcggcttcttagcctggtaccagcagaacctggccaggctccaggctcctcctctatggtgcatccaccagggccactggcatcccagacaggttcagtggcagtgggtctgggacagacttcactctcaccatcgacagactggagcctagaagtattttgcagtctattactgtcagcagtatacgtggggagtacggttcggaccaaggggaccaagggtggaaatacgaaacgaactggtaggtctgcaccatctgtcttacgatccgttcccgctatccgtagtaagtgtgttagtactggnggtcgggtcg

SEQ ID NO: 125119 - DNA, 557 bp, Homo sapiens
  misc_feature: GYAE6OF01DH5YW.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgtagcagcggcttcttagcctggtaccagcagaacctggccaggctccaggctcctcctctatggtgcatccaccacggccactggcatcccagacaggttcagtggcagtgggtctgggacagacttcactctcaccatcgacagactggacgcctgaagtattttgacagtctattactgtcagctagtatagtgggagtacggttcggaccgaagggaccctaagggtaggaaatacgaaacgtaacgtgtaggctagccgaaccagtctgttcctactacgttcccgttaccccgcctacgttccgtagtaaggttcggttacgttacggtaccgttgggacggtcgggtaccggg

SEQ ID NO: 125120 - DNA, 536 bp, Homo sapiens
  misc_feature: GYAE6OF01DVDBU.33.6.A06.1.454.CMB.1.raw
  modified_base (361)..(361): a, c, t, g, unknown or other
  misc_feature (361)..(361): n is a, c, g, or t
  modified_base (526)..(526): a, c, t, g, unknown or other
  misc_feature (526)..(526): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctctatggtgcatccaccagggccactggcatcccagacaggttcagtggcagtgggtctgggacagacttcactctcaccatcgacagactggagcctgaagtntttgctagtctattactgtcagtcagtatacgtgggagtacggttcggaccgaagggaccgaagggtagaaacgtacgaaacggtaactggtacggtctcgacgtacctatcgtgttcttaccagttccgttcccgtctactctagtagtgtcgtaggtactggnggcgggtacg

SEQ ID NO: 125121 - DNA, 499 bp, Homo sapiens
  misc_feature: GYAE6OF01BBROW.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctctatggtgcatccaccagggccactggcatcccagacaggttcagtggcagtgggtctgggacagacttcactctcaccatcgacagactggagcctgaagattttgcagtctattactgtcagcagtatacgtggggagacgttcggccaagggaccaaggtggaaatcaaacgaactgtaggctgcaccatctgtcttcatccttcccgcatctagaagtgtgtgtatgagtcgggtcg

SEQ ID NO: 125122 - DNA, 523 bp, Homo sapiens
  misc_feature: GYAE6OF01BLZHQ.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctctatggtgcatccaccagggccactggcactcccagacaggttcagtggcaggtgggtctgggacagacttcactctcaccatcgacagactggacgcctagaagtattttgctagtctattactgtcagtcagtatacgtgggagtacggttcggaccgaagggaccgaagggtaggaaatacgaaacgaacgtggtaggtactagacacctatctgtcttcactcctcccgcatctagagtgtgtacgtagtgaggcggtacg

SEQ ID NO: 125123 - DNA, 566 bp, Homo sapiens
  misc_feature: GYAE6OF01DV0L8.33.6.A06.1.454.CMB.1.raw
  modified_base (331)..(331): a, c, t, g, unknown or other
  misc_feature (331)..(331): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacacagtctccagccaccctgtctttgtctccaggggaaagagccaccctctcctgcagggccagtcagagtgctggcagcaacttagcctggtaccaacaaaacctggccagactcccaggctcctcatctatgatgcatccaccagggccactggcatcccagccaggttcagtggcaggtgggtctgggacagacttcactcncaccatcagcagcctagacgcctagaagtattttgacttagtttattactgtctgcagtcgtagctaacgtcggacctaaccgacccgttcggacccgtaaaggggaccaaccggtacgtagggaagtaacgttaaacgaacgtggtacggctcggacctaccctatccttgttccttcctacttccgttccccgacctattaccgtagtaacggttgttacgtgttacgtaggg

SEQ ID NO: 125124 - DNA, 728 bp, Homo sapiens
  misc_feature: GYAE6OF01AGS5D.33.6.A06.1.454.CMB.1.raw
  modified_base (227)..(227): a, c, t, g, unknown or other
  misc_feature (227)..(227): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagagccaccctctcctgcagggccagtcagactgttagcagcggcttcttagcctggtaccngcagaacctggccaggctcccaggcctcctcctctatggtgcatccaccgaggccactggcacgtcccagacaggttcaggtggccaggtgggtctgggacacggacttcgactctccaccagtccgacagacgtcggagtaccctagaacggtatttttcggactacggttacttaacgtttacgtcggttactaaggtacccgttaaacggttaacgttaccgggtttagggggaacgttaccgggttttaacccggggacccggtaaacggggtaacccggtaaaaggggttacggaaaacgttaaccgtaaaaaccgggtaaccgttaggttacggggtaccgttaccggacccgttaaccccgtttcgtaccggtttaccttaccgtaaccgttacccgtttaccccggtacccgtacgtttaccggtacgggtaacggttacggttcgggttaccggttaacgtagggtaccgggtccgggggtcgttaccgggg

SEQ ID NO: 125125 - DNA, 508 bp, Homo sapiens
  misc_feature: GYAE6OF01BLTOV.33.6.A06.1.454.CMB.1.raw
  modified_base (335)..(335): a, c, t, g, unknown or other
  misc_feature (335)..(335): n is a, c, g, or t
  modified_base (460)..(460): a, c, t, g, unknown or other
  misc_feature (460)..(460): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagacacctggccaggctccaggctcctcatccatggtgcatccaccagggccactggcactcccagacaggttcagtggcaggtgggtctgggacagacttcattcncaccatcagcagactggagcctagaagtatttgctagtagtattactgtcagactaggtacggtagttcatcgtccgtacgttcggaccgaagggaccgaaggtaggaaactacaaacgaactgngctgcacctatctcgtctactctcctcccgctatctagagtgtgtacg

SEQ ID NO: 125126 - DNA, 500 bp, Homo sapiens
  misc_feature: GYAE6OF01B8N33.33.6.A06.1.454.CMB.1.raw
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctagaagtatttgctagtctattactgtcagcagtatagtgggagtacgttcggacgaagggacaaggtagaaatcgaaacgaacgtagtggctggcacatctgtcttcatcctcccgcatctagagtgtgtgtangnggnggtcg

SEQ ID NO: 125127 - DNA, 624 bp, Homo sapiens
  misc_feature: GYAE6OF01C6GV9.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgtagcagcggtcttctagcctggtaccagcagaaacctggccaggctccgaggctccctcctctatggtgctactccacgacgggccacgtggcactcccagactaggttcaggtggcgaggtcgggtcgtagggacagacttcgactctaccacctagtccgacgacgtacgtggacgccgtaggaacgttattttggacgtaggttagttaactttacgtgttacaggtacgtaggttaacggttacgttctacgttccgtaccggtacgttaccggaccgtaacgggaaccgtaagggtacgtaaacgtacgaaaaccgtagtacgtacggtctacgaccaaccgtacttcgtcgttacgttactacttcccgttacccgtactacgttacgtagttaacgttgttagtcgtacgtggtacggg

SEQ ID NO: 125128 - DNA, 808 bp, Homo sapiens
  misc_feature: GYAE6OF01DA11V.33.6.A06.1.454.CMB.1.raw
  modified_base (294)..(294): a, c, t, g, unknown or other
  misc_feature (294)..(294): n is a, c, g, or t
tcagtacacacactcacgaccggtgctcgatttagatctactgacagggaaccgagtggaaaccccagcgcagcttcgtcttcctcctgcttctctggctcccagatacccacccggagaattgtgttgacgcagtctccaggcacctgtctttgtctccgaggggacagacgccaccctctccgtgcgacgggccagtcagacgtggtagcgaggccgtcttcgtacgccgtggtaccagcaacgaaccgtcggaccaggcctacccgaggtcctcctcgactccagtggtcncacgtcccaccgcggccacgttggactactccgaagacgtggtacaggtcggactagggtcgggtacgtacgggacctacggtaccgttacgtactttcctacccgaaccgtacgttaccgacggtaccgtaacggtaccggttacggggaacctacccggttaaggtaaacggtttacggtttttacggaccgttaggtttacggttaacgtttacggttacggttaccgaacggtacgttaacgggttaaccgggtttacgttaccgtaaccgttacccggttacccggttacccgggtttaccgggaacccggtaaacggggtaacccgtaaacgggtaacggtaaaacgtaaccgaaaacggttaaccgttagggtacggtaccgttacggtaccgtaaccgtacgttaccggttacgttacccgttaccgtaccgtttccccggttaccccgtaccgttaaccgttaccggttaaacggttccggttacgttccggtaccggtacgggg

SEQ ID NO: 125129 - DNA, 553 bp, Homo sapiens
  misc_feature: GYAE6OF01EVGL8.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttctagcctggtaccatcagaaacctggccaggctcccaggcctcctcctctatggtgcatccaccagggccactggcatcccagacaggttcagtggcagtgggtctgggacagacttcactctcaccatcgacagactggagcctagaagattttgctagtctattactgtcagtcaagtatacgtggggatacggttcggaccgaagggacccgaagggtaggaaatacgaaacggaactggtagggactgacaccgtatctgttcttcacttccgttccccgacctacgttctaggtaagttggttcggttacgttacgtggtacggtcggggtaccggg

SEQ ID NO: 125130 - DNA, 547 bp, Homo sapiens
  misc_feature: GYAE6OF01CLZYV.33.6.A06.1.454.CMB.1.raw
  modified_base (538)..(538): a, c, t, g, unknown or other
  misc_feature (538)..(538): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggcagacttcactctcaccatcgacagactggagcctagaagtattttgctagtctaattactgtcagcagtatactggggagacgttacggccgaagggacctaaagggtaggaaaattacgaaaacgaaccgtggtacgggctaggacaaccatccgtagtccttctacttccgttcccgtacctacgttcctagtaagttgtcgttagtacgtaggngcgggtacg

SEQ ID NO: 125131 - DNA, 615 bp, Homo sapiens
  misc_feature: GYAE6OF01C1WET.33.6.A06.1.454.CMB.1.raw
  modified_base (261)..(261): a, c, t, g, unknown or other
  misc_feature (261)..(261): n is a, c, g, or t
  modified_base (331)..(331): a, c, t, g, unknown or other
  misc_feature (331)..(331): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgtagcagcggcttctagcctggtaccagcagaacctggccaggctccaggctcctcatccatgncatccaccgaggccacgtggcatcccagacaggttcagtggctaggtgggtctgggacagacttcattcncacatcagcagacgtggactcgtagaagtattttgactagtgttaagttacgtgtcgagtacgtaagttacggttagttacgtacgttaccgtccgtacgtttaccgggaccgtaacgggtaaccgtaaagggtaacggtaaaacgttacgaaacgtaacgttacggtacgggtctacggacctaaccgtacttccgttacggttaccttaccgttaacttccccgttaccccgtacccttaacgttccgttaacggtaaggttcggttggttcggttaaccgg

SEQ ID NO: 125132 - DNA, 523 bp, Homo sapiens
  misc_feature: GYAE6OF01A2BIB.33.6.A06.1.454.CMB.1.raw
  modified_base (492)..(492): a, c, t, g, unknown or other
  misc_feature (492)..(492): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctctatggtgcatccaccgagggcccactggcactcccagacaggttcagtggcaggtgggtctgggacagtacttcactctcaccatcgacacgacgtggacgcctagaagtatttgactagtctattactgtcagcagtactacgtgggagtacggttcggacgaagggacgtaagggtagaaagtacgaaacgtacgtagacgtactcgacacgactctgtctcatccgtccnctatctagtagtgtcgtgtangngnggtacg

SEQ ID NO: 125133 - DNA, 699 bp, Homo sapiens
  misc_feature: GYAE6OF01DEGQM.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggaaagagccaccctctcctgcagggccaatcagagtgttagcagtaactagtctggtaccaacatagacctgaccaggctcccaggctcctcatctacgatgcgtccaacagggccactggcatccccagccaggttcagtggcaggtggtctgggacagacttcactctcaccatcagccaacctagaacttgaagttatttttctaattttacttacttgtacctaacattaccaccgggacaagtcctacgggtcccttacgtcctaacccgttttcggggaccgggtaacggggtaaccctaaagggtcgggaacgtaccgtaaccgaaaacggtaaccgttgggttacggtaccgttacgggaccctaaccccgtaagtttcccgttaggtttaccctttacgtaacctttcccccgtttaccccccggtacccgtaacgttttccgttaacgggttaaaacggtttcggtttacggtttacgggtttaaacccgttggggtaacgggtcccggggggtcggttaaccggggg

SEQ ID NO: 125134 - DNA, 541 bp, Homo sapiens
  misc_feature: GYAE6OF01BW5QN.33.6.A06.1.454.CMB.1.raw
  modified_base (319)..(319): a, c, t, g, unknown or other
  misc_feature (319)..(319): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttctagcctggtaccagcagaaacctggccaggctcccaggcctcctcctctatggtgcatccaccagggccactggcatccccagacaggttcagtggcaggtgggtcngggacagacttcactctcaccatcgacagactggacgcctgaagtattttgctagttctattactgtacagtcaagtatacgtggggagtacggtttcgggaccgaaacggggaaccgaaagggtacggaaagtacgaaaacggaacgtaggtacggactgaccaccatcgtgtcttcacgttccttcccgctatctagagtgtgtgtactggcgcggtcgg

SEQ ID NO: 125135 - DNA, 514 bp, Homo sapiens
  misc_feature: GYAE6OF01CA4EP.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttctagcctggtaccagcaagaaacctggccaggctcccaggctcctcctctatggtgcatccaccagggccactggcatcccagacaggttcagtggcagtgggtctgggacagacttcactctcaccatcagcagactggagcctgaagattttgactagttgtattactgtcagtcagtacggtattcattcgtccgtacgttcggccaagggaccgaaggtgaaatcgaaacgtaacgtagtcggctgcaccatctacgtcttcattccttcccgcctatcctagaagttgtgtgtcgtgg

SEQ ID NO: 125136 - DNA, 624 bp, Homo sapiens
  misc_feature: GYAE6OF01DQPOT.33.6.A06.1.454.CMB.1.raw
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccagggacagagccaccctctcctgcagggccagtcagactgttagcagcggcttctagcctggtaccagcagaaacctggccaggctccagctcctcctctatggtncatccacgacggccacgtggacactcccagacgaggttcagtgcagtgggtctgggacagacttnactctcacctanccgaanacgacgtggacgtcctaggtaacgtagttttgactagttacttaatttacgtcggtactagtacgtaagttacgtacggtaggggtacgtaccggttacggaccgtaaacgggtaaccgaagggtagaaagtacgaaacggtacgtggtacgtacgtacgaccgtaacctagttacgtcgttactaccgtagttccccgttaccccgtacctacgttccgttacggtaaacgttcggttacggttacgttaaccgtcgggtacggtccggggtaccgg

SEQ ID NO: 125137 - DNA, 516 bp, Homo sapiens
  misc_feature: GYAE6OF01D0UG3.33.6.A06.1.454.CMB.1.raw
  modified_base (505)..(505): a, c, t, g, unknown or other
  misc_feature (505)..(505): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgtagcagcggcttctagcctggtaccagcagaacctggccaggctcccaggctcctcctctatggtgcatccaccagggccactggcatcccagacaggttcagtggcagtgggtctgggacagacttcactctcaccatcgacagactggagcctgaagtattttgctagtcttattactgtcagcagtatacgtggggagacgttcggacgaagggaccaagggtagaaatcgaaacgaactggtggctgacacctatctgttcttcattccgttcccgactactctagtaagtgtgtagtactgnggcgggtacgg

SEQ ID NO: 125138 - DNA, 547 bp, Homo sapiens
  misc_feature: GYAE6OF01ASLHU.33.6.A06.1.454.CMB.1.raw
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
tcagtacacacactcacgaccggtgctcgatttagatctactgacagggaaccgatggaaaccccagcgcagcttctcttcctcctgctactctggctcccaggataccaccggggaaattgtgttggacacagtctccagccaccctgtctttgtctccaggggaagagccaccctctcctgcagggccagtcagagtgctggcagcaacttagcctggtaccaacaaaacctggccagactcccaggctcctcatctatgatgcatccaccacgggccactggcactcccagccaggttcaggtggcaggtggtctgggacagacttcactctcaccatcagcagcctagncctgaagtatttgcttagtttattcgtgtntgctagcgtancaactcggacctaacgtcccttcggaccaagggcacggactaggaagtaacgtaaaccgacgtgtcgcctgacccactacgttcctgttaccttctactcccgttcccgcctactacgtagtaacggttcggtagttcgttacgtggtacggg

SEQ ID NO: 125139 - DNA, 560 bp, Homo sapiens
  misc_feature: GYAE6OF01D1L5A.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctctatggtgcatccaccagggccactcggcatcccagacaggttcagtggcaggtgggtctgggacagacttcactctcaccatcgacagactggacgcctagaagtattttcgactagttctaattacgtgtcagtctaagtatacgtgggacgtacggttacggaccgaagggaccgtaagggtacgaaacgtacgaaacgtaacgtggtacggtacgtacgacgtaccagttctcgttcttcgtacttaccgttcccgactagttcgtagtagtcgttgtacgttactggtcgcgggtcg

SEQ ID NO: 125140 - DNA, 502 bp, Homo sapiens
  misc_feature: GYAE6OF01A4Z9C.33.6.A06.1.454.CMB.1.raw
  modified_base (292)..(292): a, c, t, g, unknown or other
  misc_feature (292)..(292): n is a, c, g, or t
  modified_base (486)..(486): a, c, t, g, unknown or other
  misc_feature (486)..(486): n is a, c, g, or t
  modified_base (489)..(493): a, c, t, g, unknown or other
  misc_feature (489)..(493): n is a, c, g, or t
  modified_base (495)..(502): a, c, t, g, unknown or other
  misc_feature (495)..(502): n is a, c, g, or t
tcagtacacacactcacgaccggtgctcgatttagatctactgacagggaaccatggaagccccagctcagcttctcttcctcctgctactctggctcccagggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtggtctgggacagccttcactctcaccatcagcagcctagngcctagaagtattttgcttagttttattactgtcagcagcgtagcaacgtggtcttgggaccgttcggaccaagggaccgtaaggtggaaactacaaacgtactggtggctgcacatctgtcttcacttccgttcccgctacgtctagtaagtgttgtcgtacgtgaggcggtctggacgacggcgctagtagngtnnnnngnnnnnnnn

SEQ ID NO: 125141 - DNA, 597 bp, Homo sapiens
  misc_feature: GYAE6OF01EG3FX.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcatccatggtgcatccaccgagggccactggcactcccagacaggttcagtggcagtgggtctggggacagtacttcacttcgtacaccatacaggcaaggtactgggacgacctagaagtattttgacgtagttgttattacgtaggtacagtcgtaaggttacggttagttacgtacttccgtaccgtaccggttccggaccgtaacgggaaccgtaagggtacggtaaacgtaccgaaacggtaacgtcggtagccgtacggaccaccgtagtccttagttccttactacgttcccttaccccgctacgttcgtacggtaagtcggttgtggttaacgg

SEQ ID NO: 125142 - DNA, 527 bp, Homo sapiens
  misc_feature: GYAE6OF01EBQU7.33.6.A06.1.454.CMB.1.raw
  modified_base (333)..(333): a, c, t, g, unknown or other
  misc_feature (333)..(333): n is a, c, g, or t
  modified_base (517)..(517): a, c, t, g, unknown or other
  misc_feature (517)..(517): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagactcactcncaccatcgacagactggagcctgaagtattttgactagtctattactgtcagctagtatacgtagggagtacgttcggaccgaagggaccaaggtaggaaagtacgaaacgtacgtaggtacggctcgacaccatcgtgtcttcacttccgttcccgactatcgtagtagtgtgtagtacgtgnggcgggtacg

SEQ ID NO: 125143 - DNA, 565 bp, Homo sapiens
  misc_feature: GYAE6OF01EGWK7.33.6.A06.1.454.CMB.1.raw
  modified_base (355)..(355): a, c, t, g, unknown or other
  misc_feature (355)..(355): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcgcttcttagcctggtaccagcagaaacctggccaggctccaggcctcctcctctatggtgcatccaccagggccactggcatcccagacaggttcagtggcaggtgggtcgtgggacagacttcactctcacactcgacagactggacnccgtgaagtatttgctagttctattactgtcagcagtatacgtggggacgtacggttccggaccgaagggaccgaagggtacgaaacgtacgaaacgtaacgtggtacggcgtagaccgtaccgtattcgtcgttcttactacgttcccgttcccgacctacgttctaggtaaggttcgttaggtagttacgtggacggtccgggtacgg

SEQ ID NO: 125144 - DNA, 766 bp, Homo sapiens
  misc_feature: GYAE6OF01AD0KF.33.6.A06.1.454.CMB.1.raw
  modified_base (641)..(641): a, c, t, g, unknown or other
  misc_feature (641)..(641): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagttctccaggccacccgttgtctttgtctcctagggggacagacgccaccctctcctgcagggccagtcgagaggtgctggcagctaacgtagcctaggaaccaaacaaaacctggccagcctcccaggtcctcctcgatcctatagatcgcactaccgaccgagggcccacgtggacctaccgtccccgaaggtcccgtaggtttacgagggttcgggacgtagggtcggggttcgtggggtaacctacgttaccgttaccgtaaccgttacctacccgtaaaccgtacgtaccgtacggtaaccgaccggtaacccgtaaggtacccggtaccggttaaggtaacggtttactttttacgggacctttaacggtttttacttaccgttggttactacgggtactaacggtcgttaacgtaaccaccggttacggtaacccttaaccgtacccggttcccggaacgaacgggtaccctaccgggagttacggaagttaacggttaaaccncggttaggtccgacgtacgccgaaccgtaggttacccgttcgttacccgttacgtacctttccccggttacccgtaccttaggttacccgttaggttacgggttcgttagggttaccgttacggg

SEQ ID NO: 125145 - DNA, 599 bp, Homo sapiens
  misc_feature: GYAE6OF01DN37I.33.6.A06.1.454.CMB.1.raw
tcagtacacacactcacgaccggtgctcgatttagatctactgacagggaaccatggaaaccacagcgcagcttctcttcctcctgcttctctggctcccagataccaccggagaaattgtgttgacgcagtctccaggcaccctgtctttgtctccaggggacagagccaccctctcctgcagggccagtcagactgtagcagcggcttctagcctggtaccagcagaacctggccaggctcccaggctcctcctctatggtgcatccaccagggccactggcatcccagacaggttcagtggcaggtgggtctgggacagacttcactctcaccatcgacagactggacgcctagaagtattttgctagttctatttactgtacagtcaagtactacggtgggggagtaccggttacggaccgaaggggtaacccgaagggtaggaaactaaccgaaaaggtaaccgtaggtcggacttacgacctaccgtagttaccgttcggtccctttacacgtttcccgttaccccgaccttaacgttaccgttaggtaaacgttcgggtttagttcggttaacgtgggtacggtaccggggg

SEQ ID NO: 125146 - DNA, 584 bp, Homo sapiens
  misc_feature: GYAE6OF01CMLPM.33.6.A06.1.454.CMB.1.raw
  modified_base (367)..(367): a, c, t, g, unknown or other
  misc_feature (367)..(367): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcgcttcttagcctggtaccagcagacacctggccaggctccaggcctcctcactccatggtgcatccaccgagggccacgtggccagtcccagacaggttcaggtggcaggtgggtcgtagggactagacttcattcgtcactatcagcaagacgtaggacncgtagaagtagttttcgactagttagttaagttacttagtcaaggtctaggttacggtacgttactacgttccgtacccgtacggttacggaccgtaacgggaaccgtaagggtacggtaaacgtacgaaacgtaacgtcggagtacgtcgaccgaccgtactacgtacgtcttactacgttccctcccgactacttacgtagtagttgtgttacgg

SEQ ID NO: 125147 - DNA, 799 bp, Homo sapiens
  misc_feature: GYAE6OF01DLLK5.33.6.A06.1.454.CMB.1.raw
tcagtacacacactcacgaccggtgctcgatttagatctactgacgagggaaccgatggaaaccacagcgcagcttctcttcctcctgcttctctggcctcccagataccaccggagaattgtgttgacgcagtctccaggcaccctgtctttgctccaggggacagacgccaccctctcctgcgagggccaggtcagtactgttagcagccgacttcttacgctggtaccagcaagaaacctggaccaggctaccgaggcctcctcctctagtaggtcgaccgtactaccgaccgacggggccccaacgttcgggccacgttccccgaacggtacctacggtttaccgaaggttcgggaccgaacggtttcggggttacgttacggggtaaccgacggttacccgtttaccgaaccgttcctaccgtaacccgtaagttaacccggaacctaacggttaacgtcgggtaaaccgtccgttaacggtaacgttagtttttaccgacgtaggtttccttaaacgtttacgttagttaccgaacgtacgtaagttaacgttaacggtagggggtaacgttacggtttccgggaccggtaaacgggtaaccgaagggttaacggaaaacgtaccgtaaaacggtaaccggttacgttacgggtacgttaccggtaccaaccggtaacgttccgttagtaccgtttacgtaaccgtttacccttaccccggacttaccgttaccgttaaggttaacgttcggttacggttaacgtttacggtcgggtacggtttacccggggg

SEQ ID NO: 125148 - DNA, 711 bp, Homo sapiens
  misc_feature: GYAE6OF01DUHNR.33.6.A06.1.454.CMB.1.raw
  modified_base (167)..(167): a, c, t, g, unknown or other
  misc_feature (167)..(167): n is a, c, g, or t
tcagtacacacactcacgaccggtgctcgatttagatctactgacagggaaccatggaaaccccagcgcagcttctcttcctcctgctactctggctcccagataccaccggagaaattgtgttgacacagtctccagccaccctgtctttgtctccaggagaaagngccacctctcatgcagggccagtcagagtattagcatcttcttggcctggtaccaacagaaacctggccaggcctcccaggcctcctcatccagaatgctattcaacgacgggccactggcactccccagccaggttcaggtggctaggtgggtctgggacaggaccttcactctacaccgatcagcagcctagacgcctggaggtatttcgtaggtaccttaggttttacttaacgttgtactacgtaccgtacgtccggttccttaccgtaaaccgttccgggtccccgttaccccggtcggtaccccgttaacccgtttaccggggaacccgtaaacgggggtaacccaaccgggttaacgttacggggtaagttaacggtttaaccgggtaaccggtaaaccgtttcgggtaccgggtccgttaaccgggtacccgttaaacccccggttcgtttaccggttaccccgttttccgttaccctttcccccgttacccccgttaccttaacgttccccgtttagggtaacggtttaccgggg

SEQ ID NO: 125149 - DNA, 382 bp, Homo sapiens
  misc_feature: GYAE6OF01BVWOE.33.6.A06.1.454.CMB.1.raw
  modified_base (324)..(324): a, c, t, g, unknown or other
  misc_feature (324)..(324): n is a, c, g, or t
  modified_base (371)..(371): a, c, t, g, unknown or other
  misc_feature (371)..(371): n is a, c, g, or t
  modified_base (376)..(382): a, c, t, g, unknown or other
  misc_feature (376)..(382): n is a, c, g, or t
tcagtacacacactcacgaccggtgctcgatttagatctactgacagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtctgcagcgtagcaactggcctaacaccttcggaccaagggacacgactggagattaaacgactgtgctgcacatctgtctnatcttcccgcatctgaagtgtgtgtactgagcgggtctggcaggcgnatagnnnnnnn

SEQ ID NO: 125150 - DNA, 501 bp, Homo sapiens
  misc_feature: GYAE6OF01BOD61.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcgactctcaccatccgacagactggagcctgaagattttgcagtctattactgtcagcagtatactggggagacgttcggaccaagggaccaaggtggaaatcaaacgaactgtggctgcacatctgtcttcatcgttcccgccatctgaagtgtcgtgtactgagcgggtcg

SEQ ID NO: 125151 - DNA, 698 bp, Homo sapiens
  misc_feature: GYAE6OF01C1W72.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagacgccaccctctcctgcgagggccagtcagactgttagcagcgtcttcgttagcctggtaccagcaagaaccgtggccacggcctcccgaggcctccctcctctagtggtcacctactaccgaccgacgggcccacgtggccacgtcccgaagacgtaggttcgaggtcggcgtaggttcgggtcgtagggactagtacttacacttcaccaactatcgaacgtagacgtcggaacgccgtaggtaacgttacgtttcgacttacgttacttaacgtttacgtcgtacgacgtacgtaacgttacgtaacgggtacgggtacgtaccgggttaccggaccggtaacgggtaaccgtaagggtaacggtaaaaccgttaacgtaaaaccggtaacggttcggtacggtaccgtacgacctaaccgtcttaccgttacgttaccttaccgtaccttacccgttaccccgtactacgttcggttaacggtagtttacggtcggttacgttacggtacgggtcggccgggtacgg

SEQ ID NO: 125152 - DNA, 641 bp, Homo sapiens
  misc_feature: GYAE6OF01CLJ44.33.6.A06.1.454.CMB.1.raw
  modified_base (277)..(277): a, c, t, g, unknown or other
  misc_feature (277)..(277): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcacctgtctttgtctccgaggggacagagccaccctctcctgcagggccagtcagagtatagcatcttcttggcctggtaccaacagaaacctcggccaggcctcccaggcctcctcatccagaatgcattacaacgngggaccagtcggcactcccgagccgtaggttccaggtcggcgtagggtcgggtcgtggggaacctaggaaccttcgactcctaccaaccgtatcagcacgcctaggacgccgtaggacgtacttcgtgtacttagtttacttacgtgtacagtactacgtcgtactaccgacgtcggtcccgttccgtcgtacctaccgttaccggaaccgtaacgggtaccgacggttacggtaggtaacgttagttaacggaacgtaacgtcgggtacgtcgtccgtacccgtacccgttcgttacttccgtttctaccgtttccccgttcccggtaccttaacgttccgttaacggtaggttcggttacgg

SEQ ID NO: 125153 - DNA, 633 bp, Homo sapiens
  misc_feature: GYAE6OF01CII1H.33.6.A06.1.454.CMB.1.raw
  modified_base (261)..(261): a, c, t, g, unknown or other
  misc_feature (261)..(261): n is a, c, g, or t
  modified_base (370)..(370): a, c, t, g, unknown or other
  misc_feature (370)..(370): n is a, c, g, or t
tcagtacacacactcacgaccggtgctcgatttagatctactgacagggaaccatggaaaccccagcgcagcttctcttcctcctgcttctctggctccagataccaccggagaattgtgtgacgcagtctccaggcaccctgtctttgtctccgaggggacagacgccaccctctcctgcagggccagtcagactgtagcagcgtcttctagcctgtaccagcagacacgtggccaggctccaggcctctcatccatggncatccacgacggccagtcggcactacccagtacaggttacagtcggcaggtgggtctagggacagtacttcaattcctacacctagtcacggacaaggacgtgggaacncctaggtaacgtgtttacgacgttagtacgttacttaacgtacgtacgtaggtaacgtaaggttacggttaacgttcgtaaccgtcgttacccggtacggttacggaaccgggaaacgggtaaccggtaagggttaacgaaaacgttaaccgaaaaccggtaacgtagtacggacgtacgctaaccgtataccgttcgtacgttacctacgttcccttacccgaccttaacgtaccgtaaggttaacgttggtggttaaccgg

SEQ ID NO: 125154 - DNA, 568 bp, Homo sapiens
  misc_feature: GYAE6OF01D56VP.33.6.A06.1.454.CMB.1.raw
  modified_base (349)..(349): a, c, t, g, unknown or other
  misc_feature (349)..(349): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagcccaccctctcctgcagggccagtcagactgtagcagcggcttcttagcctggtaccagcagaaacctggccaggcctcccaggcctcctcctctatggtgcactccaccgagggccacgtcggcactcccagacgtaggttcgaggtggcgaggtgggtcgtgggacagtacttcactcnccaccatccgacacgacgtcggacgcgtagaagtatttgactagtcttagttactgtcagtactagtagtacgtggggagtaccggttcggacgtaagggaccgaagggtagaaactacgaaacgtagtaggtgacgtgaccactagtcgtcgtcttactagttccgtcccgtactacgttcgtcgtaagttggtctacggtactggtcgggcggtacg

SEQ ID NO: 125155 - DNA, 694 bp, Homo sapiens
  misc_feature: GYAE6OF01D615D.33.6.A06.1.454.CMB.1.raw
  modified_base (274)..(274): a, c, t, g, unknown or other
  misc_feature (274)..(274): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcacctgtctttgtctccagggacagagccaccctctcctgcagggccagtcagactgttagcagcggtcttcttacgcctggtaccagcaacgaaacctggccaggcctcccaggcctcctcctctagtcggtcncactccaccgaggcccacgtcggccactcccgagaccgtaggttccgaggtcggctacggttcgggtcctagggactacggtaccttccgacttccgtacaaccctagtaccgacgtacggtaccgtgggaacgtccgtaggtaaacgtacgttttcggacttagttaccttaacgttacgtcgtacgacgtacgtaagtaacgtacggtagggtacgtacggttaccggaccgtaaagggacccgtaagggtacggaaacgtacgaaaaccgtaacgttcggtaacgggtaccgtacgtaccgtaaccgtgttaccgtacgttaccgtttaccgtaacgtttcccggtaccccgtaccgttacttcggttaacgtaacgttcggttacgtacgttaacgtcgggacggtccggtaccgg

SEQ ID NO: 125156 - DNA, 947 bp, Homo sapiens
  misc_feature: GYAE6OF01DTJ4E.33.6.A06.1.454.CMB.1.raw
  modified_base (261)..(261): a, c, t, g, unknown or other
  misc_feature (261)..(261): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagacgccaccctctcctgcagggccagtcagactgtagcagcgcttctagcctggtaccagcagaaccgtggccaggcctccgaggcctcctcctntagtggtcgcactccacgacgggccacgtcggcactcccaagacctaggttcaggtcggacgtaggttcggggtcgtaggggaactacggtaccttaccgaccttccgtacccaacccgtacgttaccggaaactaacggtaccggtacgggaaccggtacccgttaggtaaacgtttacgttttttcgggaaccttaacggttttaacccgtttaacgttttaaccggtttaccgggttacgtaaacgggttaccgttaaacgggtttaaacggtttaaccgggggttaagggggggttaacccgggttaacccggggttttaaccccggggaaaaccccgggttaaaacgggggggtaaaccccggttaaaacgggggtttaaacgggtaaaaaccgtttaaacccgggaaaaaacccgggtttaaccggtttacggggttaaccggggtaaccggttacccggtaaccccgttaaacccgttacgtttacccggtttaacccggttttacccttaaaccccgtttaacccgttttacccccggtttaccccccggtacccgtttaaacgttttcccgggttaaacggggttaaacgggttttccggggttttaaccggtttaaaccggggtttaccgggttaacccgggggtaaccggggggttccccgggggttaaccgggg

SEQ ID NO: 125157 - DNA, 740 bp, Homo sapiens
  misc_feature: GYAE6OF01D3POD.33.6.A06.1.454.CMB.1.raw
  modified_base (634)..(634): a, c, t, g, unknown or other
  misc_feature (634)..(634): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagacgcccaccctctcctgcgagggccagtcagactgttagcagcgtacttcgttacgcctcggtaccagacaacgtaaaccgtggaccaggccctacccgacggtcccttccctcctacgtagtggtcgacctacctaccgaccggtacggcctacgtcggacctaccgtacccgaagtacgtacggttacgaggtcggacgtagggttcggtcgtaggacgtacgtacttaccgaccttcaccgaacgtacgtaccgaacgtacggacgtaggacgtacgtaaggttaacgttgtttacgacgttaacgttaccgtttaacttacgtcgtacgacgtaacgtaagttacggtacggggtacggggaactttaccgggtaccggaaacccggtaaagggtaaccggtaaaggtaacgtaaacgtaacgaaacggtacggttggtacgtaccgtacgaccctaacgttnttacgttacgttcctacgtacccgtttcccgacccgtattaacgttcggttagggttaacgttcggtaacggttacgttaacggcgggtacgggtccgggtaacgg

SEQ ID NO: 125158 - DNA, 691 bp, Homo sapiens
  misc_feature: GYAE6OF01CO2QW.33.6.A06.1.454.CMB.1.raw
  modified_base (230)..(230): a, c, t, g, unknown or other
  misc_feature (230)..(230): n is a, c, g, or t
  modified_base (445)..(445): a, c, t, g, unknown or other
  misc_feature (445)..(445): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctcgaggggacagacgccaccctctcctgcgacgggccagtcagactgtagcagcgtcttctagcctggtaaccaanagagacctggaccagacctccaggctcctcaatctatgatcgacactacccaacgagggccctaagtcggaccaacgtccccgaaggtcccctaagggttccaagggtcggacgtaagggttcggggtcgtaggggaacctaaggtacctttacaaccgttctaccaaccaatcgaaggcctaacgaccctaaggacgtacctaggtaaacgttnttttagacttaaggttttaacttacgtaggttactcggacgaagtacggtaagaccgtaaacgtcggtaccctaaaccgtaccggttaccggaccgaaacggggaacaccggtaacggtaagggtaacgtaaacgtttaaaccgacgttaggtacgggactacgacctaaccgtagtttccgtcgttacttacgtacgttaccccttacccggaccttaaactcgttaaacggacgtttggtaacg

SEQ ID NO: 125159 - DNA, 410 bp, Homo sapiens
  misc_feature: GYAE6OF01BWBPM.33.6.A06.1.454.CMB.1.raw
  modified_base (375)..(375): a, c, t, g, unknown or other
  misc_feature (375)..(375): n is a, c, g, or t
  modified_base (397)..(410): a, c, t, g, unknown or other
  misc_feature (397)..(410): n is a, c, g, or t
tcagtacacacactcacgaccggtgctcgatttagatctactgacagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagtattttgctagtctatactgtcagcagtatacgtggggatacgttacggacaagggaccgaaggtaggaaactacgaaacgactggtggctgacacgatctgtcttcattccttccgcactcgtagtaacgtgtgtgtaacgtgaggtcggntcggacgaaggtcgctaagcgnnnnnnnnnnnnnn

SEQ ID NO: 125160 - DNA, 523 bp, Homo sapiens
  misc_feature: GYAE6OF01EF3ZR.33.6.A06.1.454.CMB.1.raw
  modified_base (485)..(485): a, c, t, g, unknown or other
  misc_feature (485)..(485): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctctatggtgcatccaccaggccactggcatcccagacaggtcagtggcagtggtctgggacagactcactctcgaccatcgacagacgtggagcctagaagtattttgctagtctattactgtcagcagtatacgtgggagtacgtcggaccagggaccaggtagaactacgaaacgactagtcggacttcgacaccacttcgtcgttcgttcctacttccgttcccncctatcgtagtagtgtgtacgtagcgtagcgggtaccg

SEQ ID NO: 125161 - DNA, 719 bp, Homo sapiens
  misc_feature: GYAE6OF01D8FS7.33.6.A06.1.454.CMB.1.raw
  modified_base (706)..(706): a, c, t, g, unknown or other
  misc_feature (706)..(706): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcacctgtctttgtctccgagggacagacgcccaccctctcctgcgagggccagtcagactgttagcgagcgtcttctacgcctagtaccagacaacgtaaccgtggaccaggtccaccgacggccttcccgtacctcttagtcggtcacctactcccgaaccggtacgggccctacgtcggacctaactacccgaaggtaccgtacggttaccgaagggttcggacgtacggttcgggtacgtacgggactacggtcttaccgaccttcgtaccaccgagtaccgacgtacgtacgtacggacgtaccgtaggtaacgttgtttacgacggttactttacgttaacgttacgtagtaccgtaagtacgttaaggttaacggttacggggtacggggtaacgttaaccggggttaccggaaaccggtaaacggggaaccgtaaagggttaacgaaacgttaacgaaacgtaggttcggtacgaccgttacgaactaccgtattccgtacgttacctaccgtacttcccgtccctattacgtcgtaggttaagcgtttgacgttaccgnggtggcggtacgg

SEQ ID NO: 125162 - DNA, 860 bp, Homo sapiens
  misc_feature: GYAE6OF01E0GQT.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgagggacagacgcccaccctctcctgcacgggccagtcagactgttagcagcggtcttcgttacgcctggtaccagcacgaaaccgtggccaggcctcccgaggtccttccctcctcgtagtggtcgactactcccgaccgacggcctacgtcggccactacccgagtacgtacggtcgacggtcggcgtaggttgggtacgtaggggaacctacggtaccctttaccgaccgttaccctaccgtaacccgacgttaccggaacgtaacggtacccggtacgggaaccgttacccgttaaggtaaacgtttacgttttacggaccgttaacgttttacgtttaacgtttaccgtacggttaccgtaagggtacccgttaaaggttaacggttaacggggttacgggggtaaccggtttacccgggttaacccggggtaaaccggtaaaccgggggtaaaccggttaaacggggtaaacggtaaaaccgtaaccgggtaaaacggttaacggttaccggggtacgtaccggtaccgtaaccgttaacccgtacgtttaccgtttccgttaccctttaaccgttaccccgtttacccccggttaccccgttaaccgttacggttaccggttaacggttaaagggtttaccggtttacggttacggttaaacggttccgggggtaacgggcccggggttaacgggg

SEQ ID NO: 125163 - DNA, 787 bp, Homo sapiens
  misc_feature: GYAE6OF01EUOU0.33.6.A06.1.454.CMB.1.raw
tcagtacacacactcacgaccggtgctcgatttagatctactgacagggaaccatggaaaccccgagcgcagcttctcttcctcctgcttctctggctcccagataccaccggagaaattgtgttgacgcagtctccaggcaccctgtctttgtctccgaggggacagagcccacccttctcctgactaagggccagtcagactgttagcaggcggtcttcttaggccgtaggtaccagacaacgaaccgtggccaggcctcccgaggtcctcctcctctagtcggtcgcctactcccgaccgtacgggccctacgtggacctactcccgaggaccgtagggttcacggtaggccgtagggtcgggtcgtaggggaacctacggtaccgttccgaccgtcttacccgaacctacgttacgaacgtaggtaaccggtgggaacgtcccgtaaggtaaaggttacgtttttacggaccgttaacgtttaccgttaacgttttaccgttaggttaccgtaagggtaccgtaaacgttaacgttaacgggtaacgggggtaaccgttacccggggtttacccgggaaacccgtaaacgggggtaacccgtaagggtaaccggtaaacctaaccggtaaaaccggtacgttacggtacgggtacgtacggtacccgaacgtacgttccgtacggttacctacgtaccgttacccgttacccgtacgtacgttccgttacggttaagtttcggtacgttacgtaaccgttaggtaaccgggtcgggtaacggg

SEQ ID NO: 125164 - DNA, 515 bp, Homo sapiens
  misc_feature: GYAE6OF01COA08.33.6.A06.1.454.CMB.1.raw
  modified_base (367)..(367): a, c, t, g, unknown or other
  misc_feature (367)..(367): n is a, c, g, or t
tcagtacacacactcacgaccggtgctcgatttagatctactgacagggaaccatggaaaccacagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctctatggtgcatccaccagggccactggcactcccagacaggttcagtggcagtgggtctgggacagacttcactctcaccgatcgacagactggacgtcctagaacgtnttttgactagtgtattactgtcagtcagtacggtagttcatctccgacgttcggactaagggaccaaggtgaaagtcgaaacgtactaggtcgactcgacacactctgtcttcatccttcccgctattctagaagtgtcgtgtagtgg

SEQ ID NO: 125165 - DNA, 736 bp, Homo sapiens
  misc_feature: GYAE6OF01ECQ8K.33.6.A06.1.454.CMB.1.raw
  modified_base (681)..(681): a, c, t, g, unknown or other
  misc_feature (681)..(681): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagacgccaccctctcctgcagggccagtcagactgttagcagcggcttcttagcctggtaccagcagaaacctggccaggcctcccgaggcctcctcctctagtggtcgcactccaccgacgggccctacgtggccacgtccccgaaggtaccgtacggttcgaggtcgggcgtacgggttcgggtcgtacggggactacggtaccttaccaccttccgtaccaaccgtaactccggaacgtacggtacgtcggaacgtccgtaggtaaacgttagttttcggacttacggttacttaacgtttaccgtacgttacgaacggtacgtaacggtttaacgtacgggttacgggggtaacgttaccgggtttaccgggaacccggtaaaccggggtaacccggtaaagggttaacgggtaaaaacgtaaccgtaaaacggttaaccggttagggtacggtaccgtacgtacccaacgttacttccgtcgtttccgttacctacgttcccgttacccgtntaccgttcgtacggtaacgttggtcgttacggtacgtacggtcggtcgggtcggg

SEQ ID NO: 125166 - DNA, 788 bp, Homo sapiens
  misc_feature: GYAE6OF01B3PX5.33.6.A06.1.454.CMB.1.raw
  modified_base (166)..(166): a, c, t, g, unknown or other
  misc_feature (166)..(166): n is a, c, g, or t
tcagtacacacactcacgaccggtgctcgatttagatctactgacagggaaccatggaaaccccagcgcagcttctcttcctcctgcttctctggctcccagataccaccggagaagttgtgttgacgcagtctccaggcacctgtctttgtctccgaggggaaancgcccacctctcctgcacgggaccaatcgagtagttgttagctaagttaacgttagtctacggtaaccaacatacgacctagaaccaggcctcccgaggccttcctacattacgtaacggattcggaccgtaccaaacggacgggcctaacgtcggaccacgtaccccgagaccgtaggtttacaggtcggcagggttcgggtctacgggaactagtacttccaacttcctacaacctgtacgaagacctaaacctaggtaaacttaggaaagttacttttacgacttaagtttttaactacgttacgttcgtagccgtaaggtacgtaacgtactaacgttaccggaaccttaaaccgtaccggttaccgggaacgtaaacggggtacctaaaccggaacggtttaacggaaacggtttaaaaccgtttaaaaccggaacgtttacggggtaaccggtaccgttacgaaacccgttaaccgtaacgttttcccggttaacgtttacccttacgtaacccgttttaccccgttaccccggacttaacgtttcggttaaacggtaaaggtttcggttaacggtttagtacccggtagggacccgggtcgggtcgtaaacgggg

SEQ ID NO: 125167 - DNA, 741 bp, Homo sapiens
  misc_feature: GYAE6OF01BLK3H.33.6.A06.1.454.CMB.1.raw
tcagtacacacactcacgaccggtgctcgatttagatctactgacagggaaccatggaaaccccagcgcagcttctcttcctcctgcttctctggctccagataccaccggagaattgtgttgacgcagtctccaggcacctgtctttgtctccgaggggacagagccaccctctcctgcagggccagtcagactgttagcaggcggtctttcgttacgccgtcggtaccagacaacgaaaccgtcggaccaggcctcccgacggtcctccctacctcgttacgtggtcgctacgtcccgaaccgacgggcctacgtgcctacgtcccgaagtaccgaggttcaggtacgcgtaggtcggtacgtagggactaggtaccttcaccgttctacgacctagtacgacgacgtaccgtggacgtcgtagtaacgttactttagacgttacgttacttaacgtttacgtcgtacgtaacgtaacgttacgttaacggtaacgggtacggggttaacgtacccgggtttacgggaaaccgtaacggggtaaccgtaaacggggttacgaaaccgttaccgaaaaacgtacggttggtacgggtaaccgttcgaacccgaaccgttcgtttaccgttacgtttcccttaccggttaccgtttacccgttccccgggttaactaccggttaggtacgttaacgtttcggttcggttacggttacgttcggggaaccgtcggggtacgg

SEQ ID NO: 125168 - DNA, 750 bp, Homo sapiens
  misc_feature: GYAE6OF01DPB8O.33.6.A06.1.454.CMB.1.raw
  modified_base (269)..(269): a, c, t, g, unknown or other
  misc_feature (269)..(269): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagacgccaccctctcctgcagggccagtcagactgtagcagcggcttctagcctggtaccagcaagaacctggaccaggcctcccgaggctcctcatccatggncatcccacgaggccacgtggaccactcccaagacctagggttccaggtcggacgtaggtcgggtacctaggggactagtacctttcgaacctttcaccacagtccagcctacgtccctaggacctccgtaaggtaaacgttagttttcgacgtttaagtttacttacgtgtaccgtaagcgtaacggtacgtacgtaccgttaacggttcggttaccgtttacgggttaacccgggtttaccgggaacccggttaaaacgggggtaacccgtaaaaggggttaaccgggtaaaaacgttacccggtaaaacggttaaccggtttcggttaaccgggtaccgtttaccggaacccgttaacccgtacgtttaccggttacgtttaccgtttacccgtaaccgtttaccccgttacccccggtaccttaaacggtttccgttaacgggtaacggttttcggtcggtttcgggttaaacccggg

SEQ ID NO: 125169 - DNA, 635 bp, Homo sapiens
  misc_feature: GYAE6OF01A78JE.33.6.A06.1.454.CMB.1.raw
tcagtacacacactcacgaccggtgctcgattttagatctactgactaggggaaccagtggaaaccccgagcccgccaggtccttcgtctttcctcctgtcgttctctggctcccagatacccaaccggagaaattagtgttgacgcaggtcttccgaggcaccctgttcgttttcgtcttccaggggtacttaaggagcccacctctcctggcaggccagtcgagactggttaggcagtcggtcttacgttacggccggtcggtaccaggctacgaaaccctggccaggactcccaggtccgtacctcctcttactggtgtcactccacgacggccacgtcggccactccgacgacgaggttacgagtggactagtcgggtcgtaggacgtagtactacacgtctacaacatcgacagtactaggacgtacgtagaagtagtttggactagtcttattactgtcacgtacgaagtactacgtaggacgacggtacgacgaacggtacaagtagaactacgaacgactggtacgcgtacgacgacgatcgtatcgttactacttcccgttaccgacgtacgtacgtaggtaacgtagggttacgttacggtaagttcgggtcggtccgggtacgg

SEQ ID NO: 125170 - DNA, 742 bp, Homo sapiens
  misc_feature: GYAE6OF01EXW6A.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcgcttcttagcctggtaccagcaagaacctggccaggctcccaggcctcctcctctagtggtgcatccaccgagggcccacgtggccagtccccagaccgtaggttcaggtggcaggtcgggtcgtagggacagtacttcaaccgtctacgaccctagtcgaacacgacgtggacgtcctaggtaagtagttttcgactaaggttacttacgtttacgttcgtacgtaacggtctaaggtacgttaacgggttacggggtacggttaccgggttaccgggaacccggtaaacggggtaacccggtaaaggggtaacggtaaacgtaacccggtaaaacggtaacggttacgggtaccgggtaccgttcgggaaccctaacccgtaacgtttccgttaccggttaccgttttacccgaacgttttaccccgttaccccgtacccgttaaccgtttacccggttaggttaaaccgggtttcggtttacgggtttaaccggttaccggttacgggtaaccggggtcccggggtaaccggg

SEQ ID NO: 125171 - DNA, 792 bp, Homo sapiens
  misc_feature: GYAE6OF01AKUTG.33.6.A06.1.454.CMB.1.raw
  modified_base (199)..(199): a, c, t, g, unknown or other
  misc_feature (199)..(199): n is a, c, g, or t
tcagtacacacactcacgaccggtgctcgatttagatctactgacagggaaccatggaaaccccagcgcagcttctcttcctcctgcttctctggctcccagataccaccggagaattgtgttgacgcagtctccaggcaccctgtctttgtctccgagggacagacgccaccctctcctgcaggccagtcagctgtancagcgcttctagcctggtaccagacaagaaccgtggaccaggcctccgacggtcctcctccgtctagtcggtcgccacgtcccgaaccggacgggtccccacggtcggaccctaccgtacccccgaaggtaccgtacggtttacgacgggttacggaccgtaggggttcggggttacgtacggggtaacctaacggtcccgttaccgtaccgttccgtacctaacccgtaacgttaccggaaccgtacggtaaccggtagggtaaccgtacccgttaaagggtaaacgtttacgtttaccggaccttaacgttactttaacgtttacgtaggttaccgacggttaccgtaaggtttaacgttacgggtagggtaaccggttaacccgggtaccgggaaaccggtaacgggtaaccggtaaagggtaacgtaaacgttaaccggaaacggtaacggttcgggtaacggtaccgttacgaccgtaaccgtacgttaccgttccgttaccgttaccttaaccttccccgtacccgtacctacgttacggtagtaccgttagtaccggttacgtacggtcggtacggtcgggtacgg

SEQ ID NO: 125172 - DNA, 626 bp, Homo sapiens
  misc_feature: GYAE6OF01AMMUI.33.6.A06.1.454.CMB.1.raw
  modified_base (206)..(206): a, c, t, g, unknown or other
  misc_feature (206)..(206): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggccaccctgtctttgtctccgaggggacagagcccaccctctcctgcagggccagtcagactgtagcngcgtcttctagccgtggtaccagcaacgaacctggccaggcctccgaggtcctcctcctntagtggtcncactccacgcgggccacgtgcctactcccgagactaggttcaggtggacgtgggtcggtcgaggaccagtacctcgactccgtacacctagtccgaacncgtacgtcgacggacctagtaacgttntttacgcgtattctacttacgtcgtacgagtcgtagttacgtaggtacggggtaaccgtcggttacggaccgaaacgggtaccgtaagggtaacgtaaacggtaccgaaacgtacgtgtacggcgtacaccgtactacgtacgttctacgttcctacgttcccgttaccacgtaacgttcgtaggtagttaggttacgtacggtaagcggtacggtcggtaccgg

SEQ ID NO: 125173 - DNA, 748 bp, Homo sapiens
  misc_feature: GYAE6OF01B42WR.33.6.A06.1.454.CMB.1.raw
tcagtacacacactcacgaccggtgctcgatttagatctactgacagggaaccatggaaaccacagcgcagcttctcttcctcctgcttctctggctcccagataccaccggagaaattgtgttgacgcagtctccaggcaccctgtctttgtctccaggggacagagcccaccctctcctgcagggccagtcagactgttagcagcggtcttctagcctggtaccagcaagaacctggccaggctccgaggctccctcctctactggtgctactccaccgacgggccacgtggcacctcccacggactacggttcgaggtcggctaggtcgggtacgtaggggactacggtaccttcgacttcctaccacctagtacccgaacgaacgtaccgtaggggacgtccgtaggtaacgttacgtttttacggaccgttaacgtttaccgtttaactttaccgttacggttaccgtaacgtacgttaacggttacgttaaccgggttagggggtaaccggttacccggggtttacccgggaaccccgggtaaaccggggtaaacccggtaaacgggggttaaacggtaaacgtaaccgtaaaaccgggtaaccggttacgggttacgggaccgttaccgacccgtaccgtaacgttccgttacgtttcccgttacttaccgttcccgttaccccgaccgtacgttcgtagttaacggttgtacggttaggtacgtgggtcgggtaccgggg

SEQ ID NO: 125174 - DNA, 767 bp, Homo sapiens
  misc_feature: GYAE6OF01B6A83.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagagcccaccctctcctgcagggccagtcagactgttagcagcggtcttctagcctggtaccagcaacgaaacctggccaggcctccgaggcctcctcctctagtggtcgcactcccaccgacgggcccacgtcggcactcccgaggactacgggttcgaggtcggcgtaggtgggtcgtaggggacacggtaccttccaccttctaccaacctacgtaccgaacaacggtaccgtacgggacgtacccgttaggtaaacgttagtttttacggaccgttaggtttaccttaacgtttaccgttcggtaccgtaacggtacgtaacggttaacgttaacgggttacgggggtaacgttaccgggtttaccgggaacccggtaaacgggggtaacccgtaaaggggttaacgggtaaaaccgtaaccggaaaacgggtaacgttcgggtacgggtaccgtacggtaaccctaaccgtacttccgttacggttacccttacgtaacccgtttcccgtttacccgaccttacgttccggttacggtaaggtttcggttagggttaccgttaacgggttcgggtaacggggtcccgggtaaccggg

SEQ ID NO: 125175 - DNA, 863 bp, Homo sapiens
  misc_feature: GYAE6OF01CYHDK.33.6.A06.1.454.CMB.1.raw
  modified_base (211)..(211): a, c, t, g, unknown or other
  misc_feature (211)..(211): n is a, c, g, or t
  modified_base (287)..(287): a, c, t, g, unknown or other
  misc_feature (287)..(287): n is a, c, g, or t
  modified_base (387)..(387): a, c, t, g, unknown or other
  misc_feature (387)..(387): n is a, c, g, or t
tcagtacacacactcacgaccggtgctcgatttagatctactgacagggaaccatggaaaccacagcgcagcttctcttcctcctgcttctctggctcccagataccaccggagaaattgtgttgacacagtctccagccacccttgttctttcgtctccgaaggggaaagacgcccaccctctcctgcagggccagtcagagtgctgcancaacttcgcctaggtaaccaaacaaaacctcggaccaacgacctaccaggtcctcctacaacttccaagttcgganacctacgtacccaaccgtaacgggcctaacgtcggcctaacgtccccgaagtaccgttaggttccaaggttggccgtagggttggtccgtaggggaaacnggttaaccttctaactttccacgtaacctacgttacgacgcgtaacgtaccggtggaaccggtcgttaagtaaaaccggtttttcgtttaggtaaccttaggtttacgttaacgttttacgtacggttaacgtaacgggtaccgttaacgggtttaacggtttaaacgtttccgttaaccgtttccgggttaccccgggttaacccgggtttaacccggggtaaccgggttaaacgggtaaacccggttaaacgggggtaacggtaaaaacgttaaaccggtaaaaacccgggttaacggtttaacggaccggtttaccggaacggtacccgtaacccggttaacgtttacccggtttaccttaccggtttaccctaccgtttccccgtttaacccccgtcgttaacccgtttacggttaacggttaacggtttacggtttagggttaacgttaccgggtgggtaaaccccggggg

SEQ ID NO: 125176 - DNA, 539 bp, Homo sapiens
  misc_feature: GYAE6OF01C7B4F.33.6.A06.1.454.CMB.1.raw
  modified_base (397)..(397): a, c, t, g, unknown or other
  misc_feature (397)..(397): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaacctggccaggctccaggctcctcctctatggtgcatccacagggccactggcatcccagacaggttcagtggcagtgggtcgtgggacaggtaccttcaccgtctccgaccaatccgacacgacgtcggacgccctagaacgattttgctagtgtattactgtcngtctaggtacgtagttctatctccgtacgttcggacctaagggacctaagggtcgaaatacgaaacgtactaggtggctagcaaccatctgtcttcgtacttcttcccgccacttcgcgtaagttgtgtcgtgtggtacggg

SEQ ID NO: 125177 - DNA, 809 bp, Homo sapiens
  misc_feature: GYAE6OF01BKS2J.33.6.A06.1.454.CMB.1.raw
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagacgccaccctctcctgcgagggccagtcagactgttagcagcggtctttcttagcctggtaccagcacgtaacctggccaggcctcccgaggtcctcctcctntagtcggtncactaccgacgacggccaacgtcggccactcccgagtaccgtaggttccgaggttcggcgtagggttcgggtcgttacgggaactacggtaacctttccgaccttaccgttaccaaaccgttacgccggtaaacaacgggtaaccgtagggtaaccgttcccgttaaggtaaacggtttactttttacgggaccttaaggtttaccttaacgttttaccgttagtaaccgttacggttaacgttaacggttaacggtttaacgggttaagggggaaccggttttaacccggggttacccgggtaaacccgggtaaacggggtaaccccggttaaaagggggttaaccggtaaaaacggttaacgtaaaacccggtaaacggttcggtaacgggtaccgtacggaaccttaaccggactttaaccgttcggttacctttacgacctttcccggtaaccccgtcttaaccgtcgtttaacgaaggtttaccggttggtaccgtttacggtaccggtggggtcgggttccggg

SEQ ID NO: 125178 - DNA, 706 bp, Homo sapiens
  misc_feature: GYAE6OF01DGWX3.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagacgccaccctctcctgcagggccagtcagactgtagcagcgtcttctagcctggtaccagcagaacctggccaggcctccaggcctcctctctagtggtcgcactccaccgaggccacgtcggcactacccagactaggttcaggtcggctaggtcgggtcgtaggacacgtacttcacgttctccactactccgacacgtacgtggacgtccgtagaaggttattttgacgtagttacttaacgttacgtagttacacggtactaggttaacgttaacggtcggggtacggtaccggtttacccgggaaccggtaaacgggtaaccggtaaagggtaacggtaaacgtaaaccggaaaacggttaacgggtaacggttacgggaccgttacggacccgtaaccgtagtttaccgtttaccgttaccgtttacctccgtttacccgtacccccgtaccttaccggttaccgttaacggttaacggtttacggttacggttaacggttacggtacgggtaccgggtcccgggtaacgggg

SEQ ID NO: 125179 - DNA, 720 bp, Homo sapiens
  misc_feature: GYAE6OF01B0H7Y.33.6.A06.1.454.CMB.1.raw
  modified_base (208)..(208): a, c, t, g, unknown or other
  misc_feature (208)..(208): n is a, c, g, or t
  modified_base (273)..(273): a, c, t, g, unknown or other
  misc_feature (273)..(273): n is a, c, g, or t
tcagtacacacactcacgaccggtgctcgatttagatctactgacagggaaccatggaaaccccagcgcagcttctcttcctcctgctactctggctcccagataccaccggagaaattgtgttgacacagtctccagccaccctgtcttgtctccaggagaaagagccacctctcatgcgagggccagtcagagtattagcatcttnttggcctggtaccaacagaaacctggccaggcctcccgaggcctcctcactcccgagttgggtcnccactcccacccgaggggccccacgtcggccacgtccccgaagtaccgtacgggtttccaagggtcggaccgtagggttcgggtcgtaggggaccaggtaccgttcactttcgtaccacctagtcgaacgtcgaggtacgtacggggacgtacccggttaggtaaaagtttcgtttttacggaccgttaaggtttacgttacgtttacgttacggttacaacggtacgtaacggtacgggtttacgttcgtacgttccgttaccggtaccggttaccggacggtaacgggaacccgtaagggtaacgtaaagtaaccgaaacggtacgtcggtacggcgtaccgactaccgtagtccgttacgtttccgttaccgtacttcccgttccccgtaccgttaacgtccgttaggttacgttaggtttacggttacggtacgttaacgggg

SEQ ID NO: 125180 - DNA, 829 bp, Homo sapiens
  misc_feature: GYAE6OF01CUG6I.33.6.A06.1.454.CMB.1.raw
tcagtacacacactcacgaccggtgctcgatttagatctactgacagggaaccatggaaaccccagcgcagcttctcttcctcctgcttctctgctcccagataccacggagaaattgtgtgacgcagtctcgagcacctgtcttgtctccgagggacagacgccctacccgtctcctgccagggccagtcagactgtagcagcggtcttcgtacgcgtaggtaccagacgaacgaaaccgtggaccacggcctccgaggcctccgtcttactatgtaatcgctacacccgaaggaccggtaccaagttcggacctaaccgtccccgaacgtacccgtaaggtttaccgacgggtttcgggccgggtttcgggtacccgtggggaaccctaacgggtacctttaccggaacctttccgaccaaccgtactacgaccggtacccaacggtcccgtaaggttaccggacccgttaaaggtaaaccgtttcgttttacggtaaccgtttaagttttaaccgtttacgtaaccgggttcgtaacgggtacgtaacggtaccggtaacgttacccgtaagtttccgggtttccggttaaccgggtaaccggggtttacccggaaccgggtaaacggggttaacccctaaagggggttaaaccgggtaaaacttaaacccgggtaaaaacgtacccggttaacggtaggtacccgtacggaaccttaaccgtacgttccgttaccgtacccgttaactacccggttacccgtccgttaacccgtacgtttaccggtaagttacggtttagtacgggttgttaacccgggtacggg

SEQ ID NO: 125181 - DNA, 741 bp, Homo sapiens
  misc_feature: GYAE6OF01COBUX.33.6.A06.1.454.CMB.1.raw
  modified_base (169)..(169): a, c, t, g, unknown or other
  misc_feature (169)..(169): n is a, c, g, or t
  modified_base (185)..(185): a, c, t, g, unknown or other
  misc_feature (185)..(185): n is a, c, g, or t
  modified_base (228)..(228): a, c, t, g, unknown or other
  misc_feature (228)..(228): n is a, c, g, or t
tcagtacacacactcacgaccggtgctcgatttagatctactgacagggaaccatggaaacccagcgcagcttctcttcctcctgctactctggctcacagactaccacggagtaaattgtgttgacacagtctccggccaccctgttctttgtctccgaaggggaaanacgcccaccctctccngcgagggccagtcagagtgtacgcggtactgcctggaaccaanagacgccgtgccaggctccgagcctcctcttactatgatcgacaactaccgaaacgacgggccaacgtcggaccaacgtcccgaacgacccgtaagggtttccaagggttcggggcggttcggggttacgtacgggaactaacggtacgtttccaacttccgtaccaacgtacgtacgacgacacggtacctaaggaacgtccgtaaaggttaagttacgttttacggtaaacgttaaagttttattaaaccgttcgtaacgttaacggacgtaacgggtacgtaaacggtacccgttaaacggtttacgggtaccgtttacggggttacccggttaacgggaaccggtaaacgggaaccgtaaagggtaacggtaaacgaaccgtaaaacggtaccgtaggtacggtacacgtaccaacctagtctacgttctacgtccttaccgtcccgagacttcgtaagtaacggttgttacgttacggtacgtcggtaacgggtcggtccgtaacggg

SEQ ID NO: 125182 - DNA, 719 bp, Homo sapiens
  misc_feature: GYAE6OF01AYCZJ.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgagggacagacgccaccctctcctgcagggccagtcagactgtagcagcgtcttctagcctgtaccagcaagaaccgtggaccaggcctaccgacggtcctccctcctcgtagtcggtacgacctacgtcccgaccgtacgggccctacgtcggaccaccgtaccccgaaggtaccgtacggttaccgaggtcggacgtaggtcgggtcgtagggactagtaccttcaccgtctacaacctagtcgaatacgacgtggacgtacgtagtaacgttgtttacgactacgttacttaacttacgtcgtacgtaacgtactaacgtaagtacggtagggtacgtaccggttacgggaccggtaaacgggtaccgtaagggttaacgaaacgtaacgaaacgtacgtacggtacgtaccgtacgaaccctacgtaccgttagttaccgttccttaaccgtacctttacccgttaccccgtaccgttaaccgttccggttaacgggttaacgtttcgggttaaacgttaccgggttaaccgtagggtaccggggttcggtaaccggg

SEQ ID NO: 125183 - DNA, 790 bp, Homo sapiens
  misc_feature: GYAE6OF01DYNCP.33.6.A06.1.454.CMB.1.raw
  modified_base (315)..(315): a, c, t, g, unknown or other
  misc_feature (315)..(315): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagacgccaccctctcctgcagggccagtcagactgttagcagcggcttcttagcctggtaccagcagaacctggccaggctccaggctcctcctctactggtgcactccaccacgggccactggcatccagacagttcagtgcagtggtcngggacagacttcactctcgaccagtcgacagactggagtccgtaggaagtagttttagaccgtaggttacgttaacgtttacgttacggttacgtaacggtaccgtaacgggttaaacgggtttacgtttaacccgaacgtttacccgttaaccccgggtaaccgggtttttacccggggaaccccggtaaaaacggggggtaaaccccttaaaaggggggtttaagggaaaaaaccgtttaccggtaaaaaacccggtaaaaccggtttcggtaccggggtacttaaccgggtacccgtaaaccccttaaacgttacccgttacggtttacccgtttaaccgttaaaccgtttacccccggtttacccccggtaacccgttaaaccgtttaccggtttaaaccgggttaaacgggtttacgggtttaaccgggttttacgtttaaaccccggttggggttaaaaccccgggggg

SEQ ID NO: 125184 - DNA, 838 bp, Homo sapiens
  misc_feature: GYAE6OF01CPMEZ.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagacgcccaccctctcctgcagggccagtcagactgtagcagcggtcttcttagcctggtaccagcaagtaacctggccacggcctccgaggcctccctcctctagtggtcgctactaccgaccgacgggcccacgtcggactaccgtaccccgtagaccgtaagggttccgaaggttcggacgtacgggttacggggttccgtaggggaccctaacgggttacccgttacctaaccgttcccttacccgaacccgtaagttacccggaaccgaacggtaaccgtacggggtaaccgtacccgttaagggttaaacgttacgtttttaccggaacttacggtttacctttaaacgttttaccgtacggttacctagggtaaccgttaaggttaacgttaacggggttacggggtaacgggttaaccggggtttaacccgggaaaccggtaaacccgggggtaaccgggtaaaacgggtacgggtaaaaacccgttaacggtaaaaaccggtaacggtttcggaccgggtacctaacgggttaaccctaaccgtacggttaccgtttccgttaccgttaccttaccgttacccgtttaccccgtacgtaacgtttccgtaacggttaacggttggtaccgtttaacggtagtacggtacggggtccgggttacgg

SEQ ID NO: 125185 - DNA, 748 bp, Homo sapiens
  misc_feature: GYAE6OF01A93L9.33.6.A06.1.454.CMB.1.raw
tcagtacacacactcacgaccggtgctcgatttagatctactgacagggaaccatggaaaccccagcgcagcttctcttcctcctgcttctctggctccagataccaccggagaaattgtgttgacgcagtctccaggcaccctgttctttgtctccgaggggacagacgcccaccctctcctgcgagggccagtcagactgtagcagcgcttcttagcctggtaccaaacaaaacctggaccagacctcccgagtcctcctacatctatgatgcactccaccgacgggccacgtcgcactcccagtccgaggttccgaggtcggtacgagggttcgggtcgtacggggactacggtaccttccgtaccgttcctacctaaccctacgtaccgaacggcccgtaacgtaccgttaacggaccggttacccgtaaggttaaaacgtttaacggtttttcggtaacgttttaacggtttttaacttaccggtttacggttaccgttcggtacgtaacgggtaccggttaacgtacccgtaaccgttccgggtaaacccttaaccgtaccccggtttacggaaccggtaacgggtacctaaccggtacgtacggtaaacgttaagttaaaccggagttcggtacggacgttacgaccgtaccttacgttcgttacgttccttacgtaccctttccgttaccccgaccgttacgttcggttaagttaacggtcggttaacgtggttaccggg

SEQ ID NO: 125186 - DNA, 837 bp, Homo sapiens
  misc_feature: GYAE6OF01AWG2P.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtcttgtctccgagggacagacgccaccctctcctgcagggccagtcagtactgttagcagcggtcttcttagccgtggtaccagcaagtaaccgtggccacggcctcccgacggcctccgtcctactagtcggtcgccactaccgacgtaacgggccacgtggaccacgtcccgacgtacgtacggttcgtaggtcggcgtagggtcgggtcgtacgggaaccgtaggtaacctttcccgaaccgtttccaacccgtaaacccgttacgttaaccggaaccgtaacggtaaccggtacggggtaacccgtacccgtaaagggttaaacgttttacgttttacggaaccgttaacggtttaacctttaaggtttaaccgttacggtaaccgttaacggtaccgtaaagttacggttaacgggttacgggggtaacccgttaccgggtttaacccggaaccgggtaaaccggggaacccgggtttaaaggggtaaccggtaaaaccgtaacccggtaaaaccggtacggttacggtacgggtacccttacggaacccgtaaccgtacgttaccgtttaccggtacctttaccgtacccgtttaccccgttaccccgtacttacggttcccgttaaggtagggttttaccggtaggtttacgaaccgggttggaaccgggtcccgggttacggg

SEQ ID NO: 125187 - DNA, 818 bp, Homo sapiens
  misc_feature: GYAE6OF01CNRKO.33.6.A06.1.454.CMB.1.raw
  modified_base (461)..(461): a, c, t, g, unknown or other
  misc_feature (461)..(461): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggccaccctgttctttgtctccgagggacagacgccaccctctcctgcacgggaccaatcagagtagtagcagacaactactacgcctggtaccagacacgaccaccgtggaccgacggtcctacccgacggtccttaccctactacgtccctaagttcggtaccgactactaccccgaaccgaccgggacccctaccggttcggaccctaaccgtaccccaaaggtaccgtaaacggttccgagggtcggacggtagggttacggggtcgtaacgggccgttaaacgtaccgtttacgtaccgttacctaccgaaaccccttnaccgacggacctaaggtaccggtagggactaacccgtaggaaacttttgttacgacgttaagtactttaagtacgttacgtcggtaacgtacggtaacggtttacggtacgttccgtaccgtacccgttacccgggttacggtacccgggaagtaaccggggtaaccgaacgggttaacggtaaaaccgttacgtaaaccggttaacggtacggtaccggttaccgtacccgtaaccgtaccttaccggttaaccgtttccgttaccgtttacccgtacccggtttcccccgttaacccgtaaccggttctttaacccgggtggtttaaaacccggttgggttaaccgttaaacggg

SEQ ID NO: 125188 - DNA, 763 bp, Homo sapiens
  misc_feature: GYAE6OF01BEGJM.33.6.A06.1.454.CMB.1.raw
  modified_base (159)..(159): a, c, t, g, unknown or other
  misc_feature (159)..(159): n is a, c, g, or t
tcagtacacacactcacgaccggtgctcgatttagatctactgacagggaaccatggaaaccccagcgcagcttctcttcctcctgctactctggctccagataccaccggagaattgtgtgacacagtctccggccacctgtctttgctcgagggaanacgccaccctctcctgcacgggccagtcagtagtgttacggccggtacctacgccgtggtaaccaagagacgacccgtggcccaggccctacccgaggtcctccttcttactagtcgactcgcgtactacccgaacggacggtaccctacgtcgacctactcccgacgaccgtaggttcgacggtcgggcggtcggtcgaggacacgtacttcactccgacgactacgtcgacgcgacgcccgtaagaccggtacctaaggtaacgttgttttacgacgtttaagttttacgtaccgttcgtaacgtacggtacgtacgggtaaccgttacggtaacccgttacggtttcggttaccgttacggggttaacccggttaccgggaacccggttaaaccgggtaaccgtaaaggggtaaccgtaaaccgtaaacccggtaaaccggttacggttagggttaccggtaccgtaccggtaacccgttacgtacgtttaccgttaccgtttccgttaaccgttccttcccgtaccccgtacgttcgttacgtaaggttcgtaggttaccgttacgtacggcggtccggtaccgggttcgcggtaaacgg

SEQ ID NO: 125189 - DNA, 855 bp, Homo sapiens
  misc_feature: GYAE6OF01DLXMZ.33.6.A06.1.454.CMB.1.raw
  modified_base (220)..(220): a, c, t, g, unknown or other
  misc_feature (220)..(220): n is a, c, g, or t
tcagtacacacactcacgaccggtgctcgatttagatctactgacagggaaccatggaaaccccagcgcagcttctcttcctcctgcttctctggcctcccagactaccgaccggaagtaaatttgttttgacgcagtctccaggccaccttgtctttgtctccgaggggacagacgcccacctctcctgcgtacgggccagtcgagtacttggttacgngacgtccggtccttttccgttaacgcccgttacgggttaaccgacggaccgtaacggtaaacccgtcgggaccgtacgggtaccctacccggtacggttccctacccgttccttacgtagtcggtcgtacctaccgttacccgaaccggacggtaccctacgtacggaccctacgtacccgtaacggacgttacgggtaccgtagggtacggtacggtagggtccggtacggttacgggaacctacggtaccttacgtactacctaccgaaccgtactaaccgacgtaacggtacgtaagggtacgtacgtaggtaaacgttgtttaccggtacgttaacggttagttaaccttaggtaccgttacggtacgtaagggttaacgtttacgggttaaccttaccgtccgttaccgttaaccggttcccggttaaccggaaccgggtaacggtaacccgttaaagggtaaccgtaaacgtaaccggtaaggttaccgtcggttacggacgttaacgtacccggtactaacgttccgttaacgttcccgtacttacccgttcccgttacccgacgttacgaacggttacggaacggtttcggtaacggttacgttaacggttcggcgggtaaccgggg

SEQ ID NO: 125190 - DNA, 636 bp, Homo sapiens
  misc_feature: GYAE6OF01A7XIJ.33.6.A06.1.454.CMB.1.raw
  modified_base (423)..(423): a, c, t, g, unknown or other
  misc_feature (423)..(423): n is a, c, g, or t
  modified_base (607)..(607): a, c, t, g, unknown or other
  misc_feature (607)..(607): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctcaggcaccctgtctttgtctcgaggggacagacgcccaccctctcctgcgagggccagtcagactgttagcacggcgtcttcttagcctcggtaccagccgtaagaaccgtggaccaggcctcccgagcctccctcctgtatcggtagcctaactccgaccgacgggtcccacgtggacctacgtacccgaggtaccgtaggttacgacggttggaccgtaaggttcggggtactacggggactacgtactcgaccgtctacaccgactcgtacagtacgtagggaacncgtaggtaacgttatttcgactaacgttcgtaattcgtagtcgaagtcgtaagtacgtacgtggggaactcggttacggacgaagggaccgtaaggtaacgaacgtaacgtaacggaagttgacgtcgacgtcgaactcgtacgtgtaccttacacttcccgtccgactcgttcgtactaggtnttacggtgtacgtggcggtcggtaccggg

SEQ ID NO: 125191 - DNA, 642 bp, Homo sapiens
  misc_feature: GYAE6OF01A7ZQU.33.6.A06.1.454.CMB.1.raw
  modified_base (422)..(422): a, c, t, g, unknown or other
  misc_feature (422)..(422): n is a, c, g, or t
  modified_base (636)..(636): a, c, t, g, unknown or other
  misc_feature (636)..(636): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggaaagagccaccctctcctgcagggccaatcagagtgttagcagtaacttagtctggtaccaacatagacctgaccaggcctcccaggctcctcatctacgatgccgtaccaacgacgggccacgtcggcactcccagccaggttcagtggcgaggtgggtctgggacagactcactctcaccatcaacgacctaaaccgtacgaaacgtttagaagtttatttttactaattttttaatttaacttacgtaccaaacgtnttaacccgaaccgggcgtaacgtccgttaccggtcccttccgttacctaacggttttccggggaaccgggtaacgggaacccgtaagggtcggaacgtctaacgaaacgtacgtggtacggctcgacctaccattccgtcgtcttactaccgttcctaccccggctacgttccgtaagtacgttgtacgttgtaaccgtgggacgtccggggtntacggg

SEQ ID NO: 125192 - DNA, 753 bp, Homo sapiens
  misc_feature: GYAE6OF01EW8MY.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagcccaccctctcctgcgagggccagtcagactgttagcagcggtcttctagcctggtaccagcagaaaccgtgccaggctcccaggtcctcctcctctagtggtgcactccaccagggcccacgtggacactcccagactaggttcagtcggactaggttcgggtcgtacggggaactaggtaccttacgacctcctaccaccgtataccgacaacggtacctggaacgtaccgtagtaacgttagttttagacgttaagtttacttaatttaaccggtgttaccgagtacttaacggttaacgtaacgggtacggggtaacgttacccgggtttaccgggaaaccggtaaacggggtaacccgtaaagggttaacggaaaacgtaacgtaaaaccgtaaggttcggtacgtaccgtacgacccgtaaccgtacggttaccttacggttacctttaaccgtaccgtttacccccgttaccccgttaacgttaacccgtttcccggtttaagggtaaccgggttttcgtttacggggttaacgttaacccgggttacggggtaaaccggggccgggtttaacccggg

SEQ ID NO: 125193 - DNA, 836 bp, Homo sapiens
  misc_feature: GYAE6OF01DS4VB.33.6.A06.1.454.CMB.1.raw
tcagtacacacactcacgaccggtgctcgatttagatctactgacagggaaccatggaaaccccagcgcagcttctcttcctcctgcttctctgctccagataccaccggagaattgtgttgacgctagtctccgaggctaccctgttcttgtcctccgagggacacgacgccaccctctccgtgacgacgggcctagtcacgtacttgttacgctaggtccggtactttcgttacgtccgttacggtaccagtaccaacgtaaacccgtggccgtacggcctcccgacggtccttcccttaccgtctacggttcggtcgacctactccaaccggacgggtaccctacggtcggtaccacgttacccgaaggtaccgtacgggttaccgcgggttacggtaccgggtaacggtcggggttacggtacggggtacctaaacgttccgtttccgtacgtttacctaccgtaaccgtaacgttcgaacggtaacgtaacggtacggtacgggtacggtacccttaagggttaaaccgttttaggtttccggtaaccgttaggttaacgtttacgttaccgtacggtaactaacggtcgtaaacggtttcgtaacgtttcgacgttacccgtaccggtacgggtaacccgtaccggtaaagggtaccgtaaagggttaaccaacgttaacggtaaaccgtagtacggtcgtacgtacggtaaccctaccgtagtttcccgtacgttaccgtttacccgtacgttttccccggtccctaggtttacctacggttaacccgggtttaagttcgggtttaacgtacgggttccgtaaccgggg

SEQ ID NO: 125194 - DNA, 834 bp, Homo sapiens
  misc_feature: GYAE6OF01ETADB.33.6.A06.1.454.CMB.1.raw
tcagtacacacactcacgaccggtgctcgatttagatctactgacagggaaccatggaaaccccagcgcagcttctcttcctcctgcttctctggctccagataccacggagaattgtgtgacgcagtctccaggcaccctgttctttgtcctccgaggggacaggacgccctaccctctcctgcgacgggccagtcagacttgttagcgaggtcggtctttcttagccgtaggtaccagcgaacgtaaccgtcggccgacggcctacccgacggtcctcccgttccgtacgttacgtcggtacacctaccgtaccgaaccggtacggtaccctacgtcggacctaccgtacccgaggtaaccggttacgggttcacgggtcggccggtaagggttcgggtacgtaggggaaccaacgttccttaccgaccgttccacccgtaaacgtacgtaccgaaacgtacggaccggttaggaccggtaccgtaagggttaaccgtttaagtttccggaacttaacggttacgtttaacgtttaaccgtcggtacacggttacgtaacgttaagggtaccggttacgggaacggttaccgggttaccggtaaaccggtaacggggtaaccggtaaagggtaaccggtaaaacgtaacccgggtaaaacgacggttcgggtacggttaccgtacgtaccgttaacctcggttttacgttaccgtttaccgtttacctacccgtttaccccggttaccgtaaccggtttacgttaccgtaaggttaggttcgggtttacggttaccgtaacggtcgggttaacccgggtccggtaaaccggg

SEQ ID NO: 125195 - DNA, 613 bp, Homo sapiens
  misc_feature: GYAE6OF01B1N62.33.6.A06.1.454.CMB.1.raw
  modified_base (112)..(112): a, c, t, g, unknown or other
  misc_feature (112)..(112): n is a, c, g, or t
  modified_base (263)..(263): a, c, t, g, unknown or other
  misc_feature (263)..(263): n is a, c, g, or t
  modified_base (565)..(565): a, c, t, g, unknown or other
  misc_feature (565)..(565): n is a, c, g, or t
  modified_base (585)..(585): a, c, t, g, unknown or other
  misc_feature (585)..(585): n is a, c, g, or t
tcagtacacacactcacgaccggtgctcgatttagatctactgacagggaaccatggaaaccccagcgcagcttctcttcctcctgcttctctgctcccagataccacgganaaattgtgttgacgcagtctccaggcaccctgtctttgtctccgaggggacagagcccaaccctctcctgcgagggccagtcagactgtagcagcggtcttgtagccttggaccagcagcactggccaggctccagctctcatccagtggncagtccaacgagggcctacgtggaccacgtcccaagtaccgtagggttaccaggtgggaccgtaagggcgggttcgaggggaactaaggttaccttactaagtttcccacaaccgtaatacgagacgaacggtacgtggaacgttccgaaagtaacgttagtttcgaacgtaggttagttaactttacgtgtaccaaggtacgtaacggtttacggttaacgttacaacgttccgtaccggtacggttaggacccgaaagggaccgtaagggtacgaaactacgaaacgtacgtgacgactnacctactatcgtatcttacnctccctcccactatctagtatgtgtacg

SEQ ID NO: 125196 - DNA, 638 bp, Homo sapiens
  misc_feature: GYAE6OF01B5PP6.33.6.A06.1.454.CMB.1.raw
  modified_base (206)..(206): a, c, t, g, unknown or other
  misc_feature (206)..(206): n is a, c, g, or t
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
tcagtacacacactcacgaccggtgctcgatttagatctactgacagggaaccatggaaaccccagcgcagcttctcttcctcctgcttctcgtggctcccagactaccgaccggagaaattgtgtgacgcagtctcgagcctacctgtcttgtctaccgagggtacagacgcccacctctcctgcaggcagtcagtactgtaganagtcggtcttgttacgctagtaccgagcaacgaaccgtggaccgaggtcctaccggagccgtcctacctacgtagtcggtacgcctacgtacccgacgtaccgggcaaccggcgaccacctacccgaaggtactacggtanacggtcggagttacgggtacgggtctagggacacgtacgtnacgctaccactacgtacgacagcgnggtagcgtagtagtctttaggactagttactaacgtacgtagtccgagtactagtaagtaccggtaaggtacggtaaccggtgggaaccggtaaggtaacgaacggtaaggaaaccttaacgaacgtacgtaggtacgacttacggactacgtagtccgtattacgtactaccgtcccttaccgactatcgtagtacgttagtcgtacgtatggcggtggtacgg

SEQ ID NO: 125197 - DNA, 792 bp, Homo sapiens
  misc_feature: GYAE6OF01AJHV3.33.6.A06.1.454.CMB.1.raw
tcagtacacacactcacgaccggtgctcgatttagatctactgacagggaaccatggaaaccccagcgcagcttctcttcctcctgctactctggctcccagataccaccggagaaattgtgttgacacagtctccggccaccctgttctttgtctccgagggaagacgccaccctctccgtgcgacgggccagtcagtagttgttaggcgggtacctagcctggtaaccaacgagacgaccgtggccaggcctcccgaggtccttcctcttctagtgagtgcactccaacgacggccctacgtggaccacgtccccgacgcccgtaggtttccgaggtcgggtacgggttcggggttcgtacggggaccacggtacctttaccgaccttcctaccacctagtaccagcccgaacggtaccgtacgacgtcctaggtaacgttacgtttcgtagtttacggttttattacgttcgtacgacgtacgtaggtccgtaacgccgtttaacgtttcggttaccggtttacggggtacccggttacccgggtaaccgggtaaaacggggaccggtaaagggttaaccgggaaacttaacccggaaaacggttaacgttcgggtaacggtacccttagggacccctaaccgttacgttacccggttctttaaccgtttccgacctttttccccggttaccccgacccgtttacttaccggttaagttacgggtttaccgttaccggttacggttacggttacgggacccgggtcgggtccggtacgggtaacccggg

SEQ ID NO: 125198 - DNA, 760 bp, Homo sapiens
  misc_feature: GYAE6OF01A809P.33.6.A06.1.454.CMB.1.raw
  modified_base (116)..(116): a, c, t, g, unknown or other
  misc_feature (116)..(116): n is a, c, g, or t
  modified_base (168)..(168): a, c, t, g, unknown or other
  misc_feature (168)..(168): n is a, c, g, or t
  modified_base (231)..(231): a, c, t, g, unknown or other
  misc_feature (231)..(231): n is a, c, g, or t
tcagtacacacactcacgaccggtgctcgatttagatctactgacagggaaccatggaaaccccagcgcagcttctcgttcctcctgctactctggctcccagactaccaccgganaaattgtgttgacacagtctccggccacctgtctttgtctccgaaggggaancgccaccctctccgtgacgagggccagtcagtagtgttagcggtacctagcctggacccaagngagacctggccaggcctccaggcctcctcttctatgactcgcactaccgaacgacggccacgtcgactacgtcccagtccaggtttccagggttcggggacgggttcgggtcgtaggggactacggtacctttacctacgtcctaccaacctatacgaacgcaccggtacctaggaccgttaccgtaaggtaacgtttagttttacggaccgttttaaagttttaacgtttaccggtagttaccgtacggacccgtaacggtaccgttaaggtaaccctttaaacggttcgggttacccggtttaacggggtaccccggtttacccggggaaccggtaaaaccggggtaacccgtaaaggggttaacgtaaacgtaaccgtaaaacggtaacggtggttaccgggtaccgtaacggtacccgtacgtacctttaccggttgttacccttacggtaccttcccgtttaccccgactcgttaccgtaggtagttcgtacggttagtacgtcgggaggcggtcggtgaacgg

SEQ ID NO: 125199 - DNA, 496 bp, Homo sapiens
  misc_feature: GYAE6OF02HFYU9.33.6.A06.1.454.CMB.1.raw
  modified_base (399)..(399): a, c, t, g, unknown or other
  misc_feature (399)..(399): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacaggacttcactctcaccatcgacagactggagcctgaagattttgcagtctattactgtcagcagtatactgggganacgttcgaccaagggaccaaggtggaaatcaaacgaactgtgctgcaccatctgtcttcatcttcccgccatctgaagtgtgtgtactgagcggtcg

SEQ ID NO: 125200 - DNA, 497 bp, Homo sapiens
  misc_feature: GYAE6OF02FHRVR.33.6.A06.1.454.CMB.1.raw
  modified_base (491)..(491): a, c, t, g, unknown or other
  misc_feature (491)..(491): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatactggggagacgttcggccaagggacccaaggtggaaatcaaacgaactgtggctgcaccatctgtcttcatcttcccgccatctgaagtgtgtgtactgagngggtcg

SEQ ID NO: 125201 - DNA, 497 bp, Homo sapiens
  misc_feature: GYAE6OF02GBF2Q.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatactggggagacgttcggccaagggaccaagggtggaaatcaaacgaactgtggctgcaccatctgtcttcatcttcccgccatctgaagtgtgtgtactgagcggtcg

SEQ ID NO: 125202 - DNA, 509 bp, Homo sapiens
  misc_feature: GYAE6OF02F8CLD.33.6.A06.1.454.CMB.1.raw
  modified_base (504)..(504): a, c, t, g, unknown or other
  misc_feature (504)..(504): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacacagtctccagccaccctgtctttgtctccaggggaaagagccaccctctcctgcagggccagtcagagtgctggcagcaacttagcctggtaccaacaaaaacctggccagactcccaggctcctcctctatggtgcatccaccagggccactggcatcccagacaggttcagtggcaggtgggtctgggacagacttcactctcaccatcgacagactggagcctgaagtattttgcagtctattactgtcagcagtatacgtggggagacggttcggccaagggaccaagggtggaaatcgaaacgaactgtaggctgacacatctgtcttcatccttcccgcatctagaagtgtgtgtactgagcgggctggnaacgg

SEQ ID NO: 125203 - DNA, 496 bp, Homo sapiens
  misc_feature: GYAE6OF02GF91I.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatactggggagacgttcggccaagggaccaaggtggaaatcaaacgaactgtggctgcaccatctgtcttcatcttcccgcctatctgagtgtgtgtactgagcggtcg

SEQ ID NO: 125204 - DNA, 617 bp, Homo sapiens
  misc_feature: GYAE6OF02JBEQ1.33.6.A06.1.454.CMB.1.raw
tcagtacacacactcacgaccggtgctcgatttagatctactgacagggaaccatggaaaccccagcgcagcttctcttcctcctgcttctctggctcccagataccgaccggggaaattgtgttgacacagtctccagcccaccctgtctttgtctccgaggggaaagagccaccctctcctgcagggccagtcagagtgctggcagcaacttagcctggtaaccaaacaaaacctggccagacctcccaggcctcctcatctatgatgcatcccaccgagggcccacgtggcactcccagccaggttcaggtggcaggtgggtctgggacagacttcactctcaccatcagcagcctagacgcctagaagtattttgacttagtttattactgtcagcagtcgtagactaacgtggttcgttgggtaccgttccgggaccgtaacggggaccgtaaagggtacggaaacttacgaaaaccggtaacgttggtacggtacgttacgaccaacctagttccgttcggttcctttacgtaccgtttcccgttaccccgtacctacttccgttaggtaacggttggttacggttacggttacgtagggacggtccgggg

SEQ ID NO: 125205 - DNA, 518 bp, Homo sapiens
  misc_feature: GYAE6OF02GUWFF.33.6.A06.1.454.CMB.1.raw
tcagtacacacactcacgaccggtgctcgatttagatctactgacagggaaccatggaaaccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagacaggttcagtggcagtgggtctgggacagacttcactctcaccatcgacagactggagcctagaagattttgctagtctattactgtcagcagtatacgtggggagtacgttcggaccgaaagggacccaagggtaggaaatacgaaaacggaactggtaggctgcaccatctgtcttcatccttcccgcctactctgaagtgtgtgtactgagcgggtctggacg

SEQ ID NO: 125206 - DNA, 494 bp, Homo sapiens
  misc_feature: GYAE6OF02H71J5.33.6.A06.1.454.CMB.1.raw
  modified_base (489)..(489): a, c, t, g, unknown or other
  misc_feature (489)..(489): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtggtctgggacagacttcactctcaccatcgacagactggagcctgaagattttgcagtctattactgtcagcagtatactgggagacgttcggccaagggaccaaggtggaaatcaaacgaactagtgctgcaccatctgtcttcatctcccgccatctgaagtgtgtgtactgtagnggtcg

SEQ ID NO: 125207 - DNA, 515 bp, Homo sapiens
  misc_feature: GYAE6OF02JDTIM.33.6.A06.1.454.CMB.1.raw
  modified_base (472)..(472): a, c, t, g, unknown or other
  misc_feature (472)..(472): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacaggacttcacgtctcaccaatcgacagactgagctgagattttgcagtctattactgtcagcagtatactggggagtacggttcggaccaaggggaccaagggtaggaaattacgaaaacgaactggtaggctggctaccatctgtcttnactcgttcccgaccatctgaagtgtgtgtactggagcggtacg

SEQ ID NO: 125208 - DNA, 522 bp, Homo sapiens
  misc_feature: GYAE6OF02HQBTG.33.6.A06.1.454.CMB.1.raw
  modified_base (401)..(401): a, c, t, g, unknown or other
  misc_feature (401)..(401): n is a, c, g, or t
tcagtacacacactcacgaccggtgctcgatttagatctactgacagggaaccatggaaaccccagcgcagcttctcttcctcctgctactctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctagaagtattttgctagtctattactgtcagcagtatacgtggganacggttcggccaaagggaccaaagggtggaaatcgaaaacggtaacgtagtacggctagacaacctatcgtagtccttcattcctcccgccatcctagaagtgtgtgtacgtgagcggtcg

SEQ ID NO: 125209 - DNA, 379 bp, Homo sapiens
  misc_feature: GYAE6OF02ICNUG.33.6.A06.1.454.CMB.1.raw
  modified_base (374)..(379): a, c, t, g, unknown or other
  misc_feature (374)..(379): n is a, c, g, or t
tcagtacacacactcacgaccggtgctcgatttagatctactgacagggccagtcagactgttagcagcggcttcttagcctggtaccagcagaaacctggccaggctcccaggctcctcatccatggtgcatccaccagggccactggcatcccagacaggttcagtggcagtgggtctgggacagacttcactctcaccatcgacagactggagcctgaagattttgcagtctattactgtcagcagtatactggggagacgttcggccaaagggaccaaggtggaaatcgaaacgactgtggctgcaccatctgtcttcatcttcccgcatctgaagtgtgtgtactgagcgggctggcaaggcgcatagnnnnnn

SEQ ID NO: 125210 - DNA, 503 bp, Homo sapiens
  misc_feature: GYAE6OF02GY6CW.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatactggggagacgttcggccaagggaccaagggtggaaatcgaaacgactgtggctgcaccatctgtcttcactcttcccgacctatctgtaagtgtgtgtactggagcgggtcg

SEQ ID NO: 125211 - DNA, 516 bp, Homo sapiens
  misc_feature: GYAE6OF02IIFA3.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtgcagtggtctgggacagacttcactctcaccatcagcagcctagacgcctagaagtattttgctagtttatactgtcagcagcgtagcaactggtcttggacgttcggccgaagggaccaaggtggaaatacgaaacgaactgtacgctagcaccatctagtcttacacttccgttcccgactactctaggtaagttgtagtcgtactcgg

SEQ ID NO: 125212 - DNA, 506 bp, Homo sapiens
  misc_feature: GYAE6OF02IXHF1.33.6.A06.1.454.CMB.1.raw
  modified_base (501)..(501): a, c, t, g, unknown or other
  misc_feature (501)..(501): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagctgaagattttgcagtctaattactgtcagctagtatacgtggggagacgttcggccgaagggaccaaaggtggaaatacgaaacgaactagtggctgccacatctgtcgttcatcttcccgacctatctgaagtgtgtgtatgtagnggtcg

SEQ ID NO: 125213 - DNA, 503 bp, Homo sapiens
  misc_feature: GYAE6OF02JI2AW.33.6.A06.1.454.CMB.1.raw
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccagggggacagagccaccctctcttgtagggccagtcagagtgttagcagcaactacttagcctggtaccagcagacacctggccaggctcccaggctcctcatccatggtgcatcccaccagggccactggcatcccagacaggttcagtggcagtgggtctgggacaggacttcattcncaccatcagcagactggacncctgaagtattttgctagtgtattactgtcagcagtacggtagttcatctccgacgttcggaccgaagggaccaagggtgaaatacgaaacgaactgtggctgcacatctgtcttctatccttccgctactctgagtgtgtgtacg

SEQ ID NO: 125214 - DNA, 486 bp, Homo sapiens
  misc_feature: GYAE6OF02IFGH8.33.6.A06.1.454.CMB.1.raw
  modified_base (225)..(225): a, c, t, g, unknown or other
  misc_feature (225)..(225): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacacagtctccagccaccctgtctttgtctccaggagaaagagccaccctctcatgcagggccagtcagagtattagcatcttcttggcctggtaccaanagaaacctggccaggctcccaggctcctcatccagaatgcattcaacagggccactggcatcccagacaggttcagtggcagtgggtctgggacagacgttcattctcaccatcagcagactggagcctgagattttgcagtgtattactgtcagcagtacggtagttcattctcgacgttcggcaaggaccaaggtggaaatcgaaacgatgtagctgcacatctgtcttcatcttcccgcatctgtagtgtgtgtatgg

SEQ ID NO: 125215 - DNA, 513 bp, Homo sapiens
  misc_feature: GYAE6OF02GKQZY.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatacgtgggagacgttcggccgaagggaccgaaggtaggaaagtacgaaacgaacgtgtaggcgtgcaccatctgtcttctatccgttcccgcctactctgtagtgtcgtgtactgaggcggtcgg

SEQ ID NO: 125216 - DNA, 501 bp, Homo sapiens
  misc_feature: GYAE6OF02FXWKG.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcattctcaccatcagcagactggagcctgaagattttgctagtgtattactgtcagcagtacggtagttcattctccgtacgttcggccaaggaccgaaggtggaaatcgaaacgactgtgctgcacatctgtcttcattccttcccgctatctgtagtgtgtgtacgtacgg

SEQ ID NO: 125217 - DNA, 516 bp, Homo sapiens
  misc_feature: GYAE6OF02IYYOP.33.6.A06.1.454.CMB.1.raw
  modified_base (451)..(451): a, c, t, g, unknown or other
  misc_feature (451)..(451): n is a, c, g, or t
tcagtacacacactcacgaccggtgctcgatttagatctactgacagggaaccatggaaaccccagcgcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacagggccactggcatcccagcccaggttcagtggcaggtgggtctgggacagacttcactctcaccatcagcaacctagaacttgaatattttcattttatactgtacacatcacgcagctgcctctcactttcggcggaggaccaagggtgagctacgaaacgactgtggctgcacctntctgtctctactccttcccgctaatcgtagtaacgttgttagtacctgacggtccggtctggacg

SEQ ID NO: 125218 - DNA, 528 bp, Homo sapiens
  misc_feature: GYAE6OF02HEIPA.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctccatggtgcatccacagggccactggcatcccagacaggttcagtggcagtgggtctgggacagacttcactctcaccatcgacagactggagcctgaagattttgctagtctattactgtcagcagtatacgtggggagtacggttcggaccgaaggggacccaagggtaggaaactacgaaaacggaacgttagtggaccgtagaccaccgatctgttcttcattccttcccgcctatctagaagttgtgtgtacgtgagcgggtcgg

SEQ ID NO: 125219 - DNA, 504 bp, Homo sapiens
  misc_feature: GYAE6OF02GCRVR.33.6.A06.1.454.CMB.1.raw
tcagtacacacactcacgaccggtgctcgatttagatctactgacagggaaccatggaaaccacagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatactggggagacgttcggccaagggaccaagggtaggaaatcgaaacgaactgtggctgccacatctgtcttcattccttcccgcctatctagagttgtgtgtactggagtccggg

SEQ ID NO: 125220 - DNA, 383 bp, Homo sapiens
  misc_feature: GYAE6OF02HNHU6.33.6.A06.1.454.CMB.1.raw
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (378)..(383): a, c, t, g, unknown or other
  misc_feature (378)..(383): n is a, c, g, or t
tcagtacacacactcacgaccggtgctcgatttagatctactgacagggccagtcagactgttagcagcggcttcttagcctggtaccagcagaaacctggccaggctcccaggctcctcctctatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtctcatcttcccgcatctgaagtgtntgtactgagcgggctggcaaggcgnatagnnnnnn

SEQ ID NO: 125221 - DNA, 527 bp, Homo sapiens
  misc_feature: GYAE6OF02J0UEA.33.6.A06.1.454.CMB.1.raw
  modified_base (368)..(368): a, c, t, g, unknown or other
  misc_feature (368)..(368): n is a, c, g, or t
  modified_base (475)..(475): a, c, t, g, unknown or other
  misc_feature (475)..(475): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagcccaccctctcctgcagggccagtcagactgttagcagcggcttctagcctggtaccagcaagaaacctggccaggctccaggcctcctcctctatggtgcatccaccagggccacgtggcatccccgagacaggttcagtggcaggtgggtctgggacagacttcactctccacatcgacagactggagcctagaagtntttgctagtatactatgtcagctagtacgtagtcatcgtcgacgttcggacaacgggacaagggtagaaactacaaacgtaactggtacgtcgagacacctatcgtntcttacacttccttccgactatctagtaacgtgttagtacgtacgtgtacgg

SEQ ID NO: 125222 - DNA, 554 bp, Homo sapiens
  misc_feature: GYAE6OF02ICIFN.33.6.A06.1.454.CMB.1.raw
tcagtacacacactcacgaccggtgctcgatttagatctactgacaggggaaccatggaaaccccagcgcagcttctcttcctcctgcttctctggctcccagataccaccggagaaattgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacacgggccactggcactcccagccaggttcaggtggcaggtgggtctgggacagacttcactctcacatcagcaacctgaacttgaagttacttttacatttttactactgtacaactatacacggcagctcggtcctctctacgtttcggacggtacgggaccgaagggtcgagtctaacgaaacgtaactggtcgctagcaccgtatcgtcgtacttctattccgttccgcctatcctaggtacgtgttcgtacgtacgtaggacggtcgggtgtacggg

SEQ ID NO: 125223 - DNA, 566 bp, Homo sapiens
  misc_feature: GYAE6OF02GH3JQ.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgctagtctattactgtcagcagttatacgtggggagtacggttcggaccgaaggggaccaagggtaggaaacgtacgaaaacggaactggtacgactagacaaccattacgtagtacctttcacttcccttccccggaccctacgttaccttacggtaagttcggttacggttacggtaacgttggtacggtcgggtacgg

SEQ ID NO: 125224 - DNA, 482 bp, Homo sapiens
  misc_feature: GYAE6OF02HGLWY.33.6.A06.1.454.CMB.1.raw
  modified_base (468)..(468): a, c, t, g, unknown or other
  misc_feature (468)..(468): n is a, c, g, or t
  modified_base (470)..(482): a, c, t, g, unknown or other
  misc_feature (470)..(482): n is a, c, g, or t
tcagtacacacactcacgaccggtgctcgatttagatctactgacagggaaccatggaaaccccagcgcagcttctcttcctcctgctactctggctcccaggggaaagagccaccctctcctgcagggccagtcagagtgttagcgggtacctagcctggtaccaacagagacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtattcatctcgacgttcggaccaaagggaccaagggtaggaaatacgaaaacgactgtggctgacacatctgtcttcattcttcccgcctatctgaagttgtgtagtactgagcgggctgggacaaggcgacatagngnnnnnnnnnnnnn

SEQ ID NO: 125225 - DNA, 579 bp, Homo sapiens
  misc_feature: GYAE6OF02GSPGV.33.6.A06.1.454.CMB.1.raw
  modified_base (323)..(323): a, c, t, g, unknown or other
  misc_feature (323)..(323): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttctagcctggtaccagcagaaacctggccaggctccaggctcctcctctatggtgcatccaccagggccactggcactcccagacaggttcaggtggcagtgggtctgggacngactcactctcaccatcgacagactggacgcctagaagtattttgactagtctatttactgtacagactagtatacgtggggacgtacggttcggaccgaagggaccgaagggtacggaaatacgaaacggaacgtaggtacgggaccgtcgaccacgtacttcgtacgtcttacgtcctttacccgtcccgtacctactacgtaacggttacgtacggttacggttacgttacggtcgggtacggacggtaccgg

SEQ ID NO: 125226 - DNA, 624 bp, Homo sapiens
  misc_feature: GYAE6OF02GV09H.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggcctcccaggcctcctcctctatggtgcactcccaccgacgggcccacgtcggaccactcccgaagaccgaggttcaggtcggcaggtcgggtcgtgggacagtacttcactctacacctatcgacagacgtggacgccgtagaacgtagttttcgactagtactattactgtcagtcagtatacgtgggagtacgttcggacgtaagggaccgaaggtagaaagtacgaaacgacgttaggtacggcgtacggacctaaccgtagttaccgtcggttaccttacgtaaccgtttccccgttccccggtacctacgttaccgttaacggtaacggttcggttacggttaccggttaacgtacgggtacggtccgggtaccgg

SEQ ID NO: 125227 - DNA, 559 bp, Homo sapiens
  misc_feature: GYAE6OF02I70EF.33.6.A06.1.454.CMB.1.raw
  modified_base (260)..(260): a, c, t, g, unknown or other
  misc_feature (260)..(260): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
tcagtacacacactcacgaccggtgctcgatttagatctactgacagggaaccatggaaaccccagcgcagcttctcttcctcctgcttctctggctcccagatacccaccggagaaattgtgttgacgcagtctccaggcaccctgtctttgtctccaggggacagagccaccctctcctgcagggccagtcagactgttagcagcggcttcttagcctggtaccagcagaaacctggccaggcctccaggctcctccnctatggtgcatccaccaggccactggcatcccgagacaggttcagtggcaggtgggtctggacagacttcactctcacatcgangatggagctgaatatttgntagtctattactgtcagcgtagcgttagaccaacgttggttactttaggacgttcggaccgaacggggaaccgaaggtacggaaactacgaaaacgtaacgtggtcgacctgaccgaccaagtacgtgttaccttctaacttaccgttccccgtactacgttactaggtaacggttgtcggtttacgtacgtacgg

SEQ ID NO: 125228 - DNA, 499 bp, Homo sapiens
  misc_feature: GYAE6OF02GWY20.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgctagtctattactgtcagcagcgtagcaactggtcttggacgttcggccaagggaccaaggtggaaatcgaaacgaactgtggctgacaccatctgtcttcactcttcccgcctatctgagtgtgtgtatcgg

SEQ ID NO: 125229 - DNA, 511 bp, Homo sapiens
  misc_feature: GYAE6OF02G0A0M.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggctcctcctctatggtgcatccaccagggccactggcatcccagacaggttcagtggcagtgggtctgggacagacttcactctcaccatcgacagactggagcctgaagtattttgcagtctattactgtcagcagtatacgtggggagtacggttcggaccgaagggaccgaagggtggaaactcgaaacgaacgtgtggctgacacattctgttctcatccttcccgcctatctagagtgtgtgtacgtgaggcggtcg

SEQ ID NO: 125230 - DNA, 560 bp, Homo sapiens
  misc_feature: GYAE6OF02I73PD.33.6.A06.1.454.CMB.1.raw
  modified_base (266)..(266): a, c, t, g, unknown or other
  misc_feature (266)..(266): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (503)..(503): a, c, t, g, unknown or other
  misc_feature (503)..(503): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcgcttcttagcctggtaccagcagacacctggccaggcctccaggctcctcatccatggtncatccaccaggccactggcactcccagacaggttcagtggacaggtgggtctggggacagacttcattctcaccatcagtacagactggacncctgaagtntttgctagttagtattacgtgtacagtctaggtacggttagttcgattccgtccgtaccgttcggaccgaagggacctaagggtacggaaacgtaccgaaacgtaacgtggtacggctagaccaccgtattccgtntttaccttactaccttcccgttcccgacctacgttcgtaggtagttcgtgttaacgg

SEQ ID NO: 125231 - DNA, 500 bp, Homo sapiens
  misc_feature: GYAE6OF02F3HIF.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatactggggagacggttcggccaagggaccaagggtggaaatcaaacgaactagtggctgcaccatctgtcttcatcttcccgcactctgaagtctgtgtactgtagcggtcg

SEQ ID NO: 125232 - DNA, 601 bp, Homo sapiens
  misc_feature: GYAE6OF02GY7AM.33.6.A06.1.454.CMB.1.raw
  modified_base (379)..(379): a, c, t, g, unknown or other
  misc_feature (379)..(379): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggcctcccaggcctcctcctctagtggtgcatcccaccgagggccacgtggccactcccagaccaggttcaggtcggctaggtgggtctgggacagtacttcactctcactatcagcacgcctagcgtcctagaagtnttttgctaagtttattactgtctgcagcgtacgcaacgtcggtacctaactaccgttcggaccgtaaacgggccaacggtacgtacggaacgtaaacgttaaaccgaacgttggtacggcttacgacctaaccgtacttcttacggtcctttacgaacctttccccgttaccccgtaccttaacttccgtaggtaacggttggttacggttacgttaaccgg

SEQ ID NO: 125233 - DNA, 574 bp, Homo sapiens
  misc_feature: GYAE6OF02IZRT3.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcgcttcttagcctggtaccagcagaacctggccaggcctcccgaggcctcctcctctatggtgcatccaccgagggccacgtggcatcccagacgaggttcaggtcggcaggtgggtctgggacagacttcactctcaccatccgacagtactgggaacgccgtagtaagtagttttcgactagttcttattactgtcagactagtatacggtggggagtacggttcggacgaacggggaccaagggtacggaaatacgaaacgtaacgtgtacggctagaccactactccgtgttaccttctacttcccgttacccgtacctaactccgttaggtaacgttgtcgttagtacgtgggacgcgggtcgg

SEQ ID NO: 125234 - DNA, 515 bp, Homo sapiens
  misc_feature: GYAE6OF02FR8OG.33.6.A06.1.454.CMB.1.raw
  modified_base (277)..(277): a, c, t, g, unknown or other
  misc_feature (277)..(277): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagagtgttagcgggtacctagcctggtacccaacagagacctggcccaggcctcccaggcctcctcttctatgatgcatccaacngggccatggcatcccagccaggtcagtggcggtgggtctgggacagacttcactctcaccatcagcagcctagacgcctgaagtattttgctagtttatactgtcagcagcgtagcaacgtggtcttggtacgttcggccgaaagggaccaagggtggaaattcgaaacgactgnggctgcaccatcntctcatccttcccgctatcgtagaagttgtagtgtactggacgtcgggcg

SEQ ID NO: 125235 - DNA, 536 bp, Homo sapiens
  misc_feature: GYAE6OF02FWE4H.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcaggtgggtctgggcagacttcactctcaccatcgacagactggagcctgagattttgcagtctattactgtcagtcagtatacgtggggagtaccggttcggaccgaagggacccgaaagggtggaaatacgaaaacgaacgtggtacggctgaccgaccattactgtcttacactccgttcccgcctatcctgtaagtgttacgtcgttagtcggacgtgggtaccg

SEQ ID NO: 125236 - DNA, 556 bp, Homo sapiens
  misc_feature: GYAE6OF02FEKIP.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttctagcctggtaccagcagaacctggccaggcctcccaggctcctcctctatggtgcatccaccagggccactggcatcccagacaggttcagtggcagtgggtctgggacaggacttcactctcaccatcgacagacgtggacgcctgaagtattttgcagtctatactgtcagcagtactacgtggggagtacggttcggaccgaaagggacccgaaagggtaggaaaactacgaaaacgaacgtggtacggcgtacgaccaacctacttcgtacgttctttacacttccgttcccgctactcgtagtaagttggttcgttagtacgtcggacggtcggtacgg

SEQ ID NO: 125237 - DNA, 589 bp, Homo sapiens
  misc_feature: GYAE6OF02H699L.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcaagaaacctggccaggctcccaggcctcctccctctatggtgcactcccaccagggccacgtggcactcccagactaggttcagtcggcaggtgggtcgtgggacagtactcactcctcacatcgacagtacgtggacgcctagaagtattttgctagtcttattactgtcagctagtatacgtgggagtacgttcggacgaacgggaccaagggtaggaaactacgaaaacgaacgtgtacggctaggaccaacctagtccgttgttccttacgtacctttacccgttccccggaccttacgtcccgttagtaacggttcggttacgttaggttaccgttagggaccggtcgggtaccgg

SEQ ID NO: 125238 - DNA, 556 bp, Homo sapiens
  misc_feature: GYAE6OF02HGJN2.33.6.A06.1.454.CMB.1.raw
  modified_base (353)..(353): a, c, t, g, unknown or other
  misc_feature (353)..(353): n is a, c, g, or t
tcagtacacacactcacgaccggtgctcgatttagatctactgacagggaaccatggaaaccccagcgcagcttctcttcctcctgcttctctggctcccagataccaccggagaaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatgtgcatccaccaggccactggcatcccagacaggttcagtgcagtggtcgtgggacaggacttcactctcaccatcgacagactggacncctgaagtattttgctagtactattactgtcagcagcgtagactaacgtggttcttggtacgttcggaccgtaagggaaccgtaagggtaggtaaacgtacgtaaaacgaacgtgtaggcctagaccaccatctgttccttctacttccgtccccgtaccacgttcctacggtaagttcggttacgtttacgtacgttacggg

SEQ ID NO: 125239 - DNA, 631 bp, Homo sapiens
  misc_feature: GYAE6OF02HNG9Y.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggcctccaggcctcctcctctatggtgcactccaccgaggggccacgtggccactccccagacgaggttcaggtcggcaggtgggtctgggacagtaccttcactcctacacctatacgagtacgacgtaggacgtcgtagtaagttagtttgcgtagttacttattacgtcgtacgagtacgtagtacgtacgggtagggacgttacggttaccggacggaacgggaacgaagggtaacgaaacgtaacgaaacggtacgtgggtacgacgtacgaccaaccgtacgttccgttacgttccttaccgactttccccgtcccgtaccttacgttaccgtaggtaggttcggttacgttacggttaccggtgggtaccgggtccgggtcgg

SEQ ID NO: 125240 - DNA, 732 bp, Homo sapiens
  misc_feature: GYAE6OF02JXIEW.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtcttgtctccaggggacagagccaccctctcctgcagggccagtcagactgttagcagcgcttcttagcctggtaccagcaacgaacctggccaggcctcccaggcctccctcctctagtggtcgacactcccaccgacgggccctacgtcggaccacgtccccgaagaccgtacggtttaccgaggtcggaccgtaggttcggggtcgtacggggaactacggtacctttaccgaaccgttccgtaccgacccgtataccgaacggtaccaacggtcccttaaggaccgtacccgttaaggtaaacgttacgtttttcggacctttaaggttttactttaaccggttggttacccaaggtacccgtaaggtaccggttaacgaccgtaaccggttcggttaccgtttacgggtaaccggtttccgggaaccggtaaacgggtaccgtaagggtacgtaaacgtaacgtaaacgtacgtggtacgtactacgactaccgtatccgttagttaccgttacgtaccttaccggttaccccgtactagttaccgttaggaacggtttcgtcggttacgtacggtacggg

SEQ ID NO: 125241 - DNA, 513 bp, Homo sapiens
  misc_feature: GYAE6OF02GFRU8.33.6.A06.1.454.CMB.1.raw
  modified_base (402)..(402): a, c, t, g, unknown or other
  misc_feature (402)..(402): n is a, c, g, or t
  modified_base (460)..(460): a, c, t, g, unknown or other
  misc_feature (460)..(460): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtgcatccaccagggccactggcatcccagacaggttcagtggcagtgggtctgggacagacttcactctcaccatcgacagactggagcctagaagtattttgcagtctaattactgtcagcagtatacgtggggancgttcgcaagggaccaagggtgaaatcaaagaactgtggactgcacatctgtcttacnctcgttcccgctactctagtaagttgtggttacgtacgtcggtagcgggtacg

SEQ ID NO: 125242 - DNA, 608 bp, Homo sapiens
  misc_feature: GYAE6OF02JAC0V.33.6.A06.1.454.CMB.1.raw
tcagtacacacactcacgaccggtgctcgatttagatctactgacagggaaccagtggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctccaggcctcctcctctatggtgcatccaccagggccactggcatcccagacaggttccagtgcagtgggtctgggacaggactcactcgtcaccatccgacacgactggacgcctagaagtattttgctagtctattactgtcagcagtatacgtggggatacggttcggccgtaagggaccgaaagggtacggaaacgtaccgaaaacggtaacgttacggtacgggtacctacggtaccaacccgtaagtaccgttacgttaccgtttacgtacgttcccgtttaccccgaccttacgttacccgttaggtaacgtttggttacgttacggttaccgttacggagggtccgggttaccgg

SEQ ID NO: 125243 - DNA, 549 bp, Homo sapiens
  misc_feature: GYAE6OF02FJADK.33.6.A06.1.454.CMB.1.raw
  modified_base (402)..(402): a, c, t, g, unknown or other
  misc_feature (402)..(402): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcaggccagtcagactgtagcagcggcttctacgcctggtaccagcacgaacctggccaggcctcccaggcctcctcctctatcggtgcactcccaccgacgggcccacgtcgcactcccagacaggttcagtcggcgacgtggtcgtgggaccacggtacttcgactctcaccatccgactagactggacgcctagaacgtattttcgctagtctatcgtntacacgcagtatacgtgggacgtacgttacgaccgaacggaccaaggtcgaaatacgaaacgtacgtgtagctagtccacatctacgtcttacactccgttcccgcactcgtacgacgttgtcgtagtacgtcgtaggtcgggtacg

SEQ ID NO: 125244 - DNA, 667 bp, Homo sapiens
  misc_feature: GYAE6OF02HZ5R2.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccagggacagagccaccctctcctgcagggccagtcagactgttagcagcggcttcttagcctggtaccagcacgaaacctggaccaggctcccaggctcctcatctatgatgcatccaccgagggcccacgtcggccactccccgagccaggttcaggtcggcaggtgggtcgtacgggacacgtacttcacgttctacaccactcagcagcctagacgcctagaagttagtttagtctaagttttaatttacgttacgttacgttgtacgtacgtacgtacgtacgtaacgtacgtaccgttaacccgtaacccgtacctaccgggggggggggggaactaaccgtaaccgtaaccgtacggtaacgtaacgttaaacgtaaccgttacggtacggtacgtacgtaccgtaacccgtaccgtacgttaccgttaccgttaccgttaccgttacccgttacccccgttacccgtaccgttaaccggttacggtacggttacggtttaccgg

SEQ ID NO: 125245 - DNA, 627 bp, Homo sapiens
  misc_feature: GYAE6OF02F2P1K.33.6.A06.1.454.CMB.1.raw
  modified_base (329)..(329): a, c, t, g, unknown or other
  misc_feature (329)..(329): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcaagaacctggccaggcctccaggctcctcatccatggtgcatccgaccagggcccacgtggcactccccagacgacggttcgagtggcaggtcgggttcgngggaacagtacttcactttcctccaaccctatccgagccaagaccgttgggacgtccgtagaacgtagttttgacgtagtagttacttagtgtacgagtcgtagtacggtagttcactcgttccgtacgttccgaccgaacgggactaagggtagaaacgtacgaaacgaaccgttgtacggcttaggaccctaacgtcttacggttacgttacgtaccttaacgttccccgtttaccccggtaccctacggtttaccgttaacggttacggttacggtttacggtacgtttaaccgg

SEQ ID NO: 125246 - DNA, 686 bp, Homo sapiens
  misc_feature: GYAE6OF02HFAWX.33.6.A06.1.454.CMB.1.raw
  modified_base (338)..(338): a, c, t, g, unknown or other
  misc_feature (338)..(338): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctcggtaccagacaagaaacctggccaggctcccaggctcctcctctagtggtcgcactcccaccgacgggccacgtcggcactcccacgacgtacggttcaggtcggacgaggtgggtcngggactagaccttcacctctaccaccgtataccgactacggacgtcggacggacccgtaaagttacttttacgacgtagttacttacgttactgttcagtactagtagtacggtgggtacgtacggttacggaaccgtaacgggaccgtaagggtacggtaaacgtaccgaaaccgtaacgttacgggtacggtacgtacggtaacccaaccgttaacgtaccgttacggtccctttaccgaccgtttaccgttacccccggtccttaacgttcccgtaaggttaaccggttcggtttacggttacggtaccgttacgggtacgggtccgggtacggttaacccgggg

SEQ ID NO: 125247 - DNA, 649 bp, Homo sapiens
  misc_feature: GYAE6OF02IGPMS.33.6.A06.1.454.CMB.1.raw
tcagtacacacactcacgaccggtgctcgatttagatctactgacagggaaccatggaagccccagctcagcttctcttcctcctgctactctggctcccagataccaccgggaaattgtgttgacacagtctccagccaccctgtctttgtctccgaggggaaagagccaccctctcctgcagggccagtcagagtgctggcagcaacttagcctggtaccaaacaaaaacctggaccagacctcccaggctcctcatctatgatgcatccaccgagggcccacgtcggacatccccagtcccgaggttcaggtggcaggttgggtcgtaggggactacggtaccttcgactctaccaacctatcagcacgtccgtaagacgtacctaggtaaacgttacgttttacgacgttaagtttttacttagttacgtctacggtctagtcgtaacgactaacgtaccggaccttaaccgtaccgttaccggaaccgaacgggtacaacggtaacgtgggaaacgtaacgtttaaaaccgacgttacgtacgtacgtcgaaccaccttagtccgttacgttccttacctaccttcccgttaccccaccgttacgttacgaggttaacggtggttacggttacgtacgtacggg

SEQ ID NO: 125248 - DNA, 635 bp, Homo sapiens
  misc_feature: GYAE6OF02JFSRA.33.6.A06.1.454.CMB.1.raw
tcagtacacacactcacgaccggtgctcgatttagatctactgacagggaacccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaacctggccaggctcccaggctcctcctctatggtgcatccaccacgggccacgtggcactcccagacgaggttcagtggcaggtgggtcgtgggacagactcactctcaccatcgacagactaggagccgtagtaacgtattttcgactagtactattacgtgtcgagtacagtacgttacgtggggtacgtacggttaccggacgaacgggaccgaaagggtaggaaacttacgaaacgaacgttaggtcggacgtcgtaccaaccgtaacgttaccgttacgttacccgtttacctaccgttacccgtttccccggtaccttaacgttaccgttacggttaaggttacggtttacggttaccggtttaaccgttacgggtaccgggtcccggggtacccgg

SEQ ID NO: 125249 - DNA, 574 bp, Homo sapiens
  misc_feature: GYAE6OF02GZIJ0.33.6.A06.1.454.CMB.1.raw
  modified_base (527)..(527): a, c, t, g, unknown or other
  misc_feature (527)..(527): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggcctcctcctctatggtgcatccaccaggccactggcatcccagacaggttcagtggcaggttgggtctgggacagacgttcactctcaaccattccgactaagactggacgccctgaacgtatttttcgcagtcttaattctgtcagccgtaatacgtagtggggtagacggtttcggaccggaaacgggaccgaagggttagaaagtaccgaaaacgtaaacgttggtaggcctggaccacgtatccgttagtaccttacgtacttcccgtcccncctaacgtcgttacgtaggttctgttacgtagtcgaggtacggtccg

SEQ ID NO: 125250 - DNA, 764 bp, Homo sapiens
  misc_feature: GYAE6OF02IA5N8.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctcaggcaccctgtctttgtctccgaggggacagagccaccctctcctgcagggccagtcagactgttagcagcgtcttcttagccgtggtaccagacaagaaaccgtcggccaggcctcccgaggccttcctcctctacgtggtcgacacgtacccaaccgacgggccacgtcggacaccgtaccccaggtaccgtacggttcgacggttcggacgtagggtcgggtcgtagggaaccgtagtaccttacgaccttaccgtacctaactacgtaccgaacgtaaggtacgtaggacgtacctaggtaacgttagttttacgacgttacgttacttaacgtttaccgtagtacgtaacgtacgttaacggttaacggttaacgggttacggggtaacggttaccgggttaccgggtaaccggtaaacgggtaaccgtaaagggtaacggtaaaacgttaaccggaaaacggtaacggtacggtacggtaccgttacgaccgtaaccgtacgttccgttacgttaccttaccgttaacctttcccggttaccctaccgttacgttaccgttaacggttacggttacggttacggttaccgttaacggtcgggtaaccgggtcgggtaaccggg

SEQ ID NO: 125251 - DNA, 722 bp, Homo sapiens
  misc_feature: GYAE6OF02FF31O.33.6.A06.1.454.CMB.1.raw
  modified_base (286)..(286): a, c, t, g, unknown or other
  misc_feature (286)..(286): n is a, c, g, or t
  modified_base (312)..(312): a, c, t, g, unknown or other
  misc_feature (312)..(312): n is a, c, g, or t
tcagtacacacactcacgaccggtgctcgatttagatctactgacagggaaccatggaacccagcgcagcttctcttcctcctgcttctctggctcccagataccaccggagaaattgtgttgacgcagtctcaggcaccctgtctttgtctccgagggacagacgcccaccctctcctgcgagggcccaaggtccaggtacctgttagcagcggtcttcttacgccttggaccaggcaagaaccgtggaccaggtcctccgaggccttcctcctctagtcggtcncactccgacgacggccacgtcgcacnccagactggttcagtggacgaggtcgggttcgaggacctacgtacttctaccgctactacccgagttaccgacgtaacggtacgtggaaccgtccgttaaggaacgttactttttcggacctaacggtttacttaacgtacgttggtaccgtagtaccgtaacggttacgtaccgggtcggggtaaccgttcgggttaaccggaccggtaaacgggaccgaaagggttaacgtaaactaacggtaaaccggtaacgttcgggtacgtacgtacgtaccgtaacccgttacgttaccgttaccgttaccttaccgaaccgtttacccgttaccccggaacttacgttaccggtaggttaacggttcggttacgttaccggtacgtaccgggaggggttacccggtaccggg

SEQ ID NO: 125252 - DNA, 618 bp, Homo sapiens
  misc_feature: GYAE6OF02FT0YB.33.6.A06.1.454.CMB.1.raw
  modified_base (269)..(269): a, c, t, g, unknown or other
  misc_feature (269)..(269): n is a, c, g, or t
tcagtacacacactcacgaccggtgctcgatttagatctactgacaggggaaccatggaaacccagcgcagcttctcttcctcctgcttctctcggctcccagataccaccggagaaattgtgttgacgcagtctcaggcacctgtcttgtctccagggacagagccaccctctcctgcagggccaagtcagactgtagcagcggcttctagcctggtaccagcaacgaacctggaccaggcctccgaggcctcctcctctagtcggtnctactccaccgacggccacgtgcactccgagacgacggttacacgtcggacgaggttgggtcgtgggacaggtacttcactctaccactatcgacacgacgtggacgctagagtatttcgactagtactagtacgtgtcagctagtacgtacggtacgggacgtacggttcgaccgaaggtaccgaaggtacgtaaacgtacgaaacggtaacgttagtacggtactacgacgtacgaacgttccgttacgttccgttacgtacgtttacccgttcccgtaccgtacgtaccgttacgtaacggttcgggttacggttacggttaaccgtcggtacggtcgggtaccgg

SEQ ID NO: 125253 - DNA, 567 bp, Homo sapiens
  misc_feature: GYAE6OF02GAAAQ.33.6.A06.1.454.CMB.1.raw
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggcctcccgaggctcctcctctatggtgcatccaccgagggccacgtggccactcccgaagacacggttcaggtggcaggtgggtctgggacagacttcactctacacatcganagactggacnctagaatntttgctagtttatactgtctgcagtcgtagactaacgtcgtaccttaactaccgttacggaccgaaacgggtaccaacggtacgtaggaagtaattaaaccggaactggtacgctacgactaccattcgtcgtacgttcactttccgtacccgacctagttcgtacgtaacggttgttcggtacgtacgtcggg

SEQ ID NO: 125254 - DNA, 646 bp, Homo sapiens
  misc_feature: GYAE6OF02H2M95.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcaagaaacctggaccaggctcccaggcctcctcttctatgatgcatccaacgacgggccacgtggccactcccgagcctaggttccaggtgggcgggtgggtcgtgggacaggacttcgactctcaccatcagcagcctagacgtcctagtaagtagtttttgactttagttttactttacgtagttcacggtactaaggtaccgtaagtacccgtaagttggtttaccgttagggtaccggtttaccggaccggtaaaggggtaacccgtaaggggtaacggtaaaagttacccgtaaaacggtaacgttcggtacggaccgtaggaccctaaccgtatcccgttagttccctttaacaccgttccttaaccccggactacgttcgttacggtacgttggtcgttacgtacgtacggg

SEQ ID NO: 125255 - DNA, 704 bp, Homo sapiens
  misc_feature: GYAE6OF02I4FLU.33.6.A06.1.454.CMB.1.raw
tcagtacacacactcacgaccggtgctcgatttagatctactgacagggaaccatggaaaccccagcgcagcttctcttcctctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggcctccaggcctcctcctctatggtgctactccaccgagggccacgtggccactcccagactaggttcagtggcaggtcgggtcgtgggacgtacgtacttcactctcaccgtatcgaacgacgacgtggacgtccgtagaagttacgtttacgacgtagtacttaacttacgtcgttacgacgtacgtaacgtaacgttaacgggtagggggtaacgtaccgggttacggaacccggtaaacggggaaccgtaaagggggttaacggtaaaacgttaacccggtaaaacggttaaccgttaggggttacgggtaacgttaccggtacctaaaccgtacgttaccgttaccgttactttacggtaacctttccccggttaaccccgtaaccttaacgttccgtacgggtttaaggttcggttacgttacgggttaacgttcgggtacgggtacgggttaccgg

SEQ ID NO: 125256 - DNA, 613 bp, Homo sapiens
  misc_feature: GYAE6OF02IZJNJ.33.6.A06.1.454.CMB.1.raw
  modified_base (267)..(267): a, c, t, g, unknown or other
  misc_feature (267)..(267): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaaacctggccaggctcccaggctcctcctctatggtncatccaccgagggccacgtggccactcccagaccgtaggttcaggtcggcgagtcgggtcgtgggacagtacttcacgtctccaccagtccgacagacgtcgacgtcctagaaacgtattttcgactacgtcttagttactagtcagtcgtaagtacgtacgtggggtaacgtaccgggttcgaaccggaaggggtaaccgtaagggtaacgaaacgtaacgaaacgtaacgtggtacggtcgtcgacctaccgtacgttcgtacgttccttactacttcccgttccccgacgttacgtcgtacgtagttcgttacgttacgtacggtacgtacgggtcggtacgg

SEQ ID NO: 125257 - DNA, 513 bp, Homo sapiens
  misc_feature: GYAE6OF02I8E60.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcagaacctggccagctccaggctcctctctatggtgcatccaccagggccactggcatcccagacaggttcagtggcagtgggtctgggacaggacttcactctcaccatcgacagactggagcctgaagattttgcagtctattactgtcagctagtatacgtgggagacggttcggccaagggaccaaggtgaaatacgaaacgaactgtaggcgtgaccacatctagtcttacatccgttcccgcctatcctagtaagtgtgtagtacgtgtacgcggtacgg

SEQ ID NO: 125258 - DNA, 781 bp, Homo sapiens
  misc_feature: GYAE6OF02GHOVY.33.6.A06.1.454.CMB.1.raw
  modified_base (205)..(205): a, c, t, g, unknown or other
  misc_feature (205)..(205): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaaggggacagagccaccctctcctgcagggccagtcagatcccgttancagcgcttctagcctgtaccagcagaacctgccaggcctcccaggcctcctcctctagtggtcgctactcccgaccgacgggcctacgtcggaccacgtccccgagaccgtaggttcaggtggcgtaggtcgggtcgtagggacaaggtacttcgacctcttaccgacctatccggaacacggtacgtgggacgtacccgttaggtaaacgttacgttttcgacgtaacggttacttaacgtttacgtacgttaccacggtaccgtaacgttaacgttaaccgggtagggggtaacggttaaccggtttaccgggaacccggtaaacggggtaacccgtaaaggggtaacggtaaacggtaaccgtaaaacgggtaaccgttagggtacgggtacgtacggttaccctaaaccgttacgttaccgtttaacgttaccgttttaccgtaccggttaccccgtttaaccccgtaacccggttaacccgtttaccggttaacgggttaaccggtttacggtttaacgggtttaaccgtttaaccgggtacgggttacccgggtccggggttaacccggg

SEQ ID NO: 125259 - DNA, 716 bp, Homo sapiens
  misc_feature: GYAE6OF02FV4FH.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgtagcagcggcttctagcctggtaccagcagaaacctggccaggcctccaggctcctcctctatggtgcatccaccgagggccacgtcggcctactccccgaagacctacgggtttaccaggtcggctaggtcgggtctacggggacaggtacttcactcgtaccacctaatcaacgacctaaacctaggtaaaccttggaaacgttactttttacaactttttaactactcggtaacctaaactacgtacctaacggtctaacgtcgtacggtcccttaccgttacgtaccgtttccgggaccgggtaacgggtaacccgtaaagggttcggaacgtccgtaaaccgtaaaaccggtaaccgttcgggtaccgggtaccttacggtaccctaaccgttaacgttccgttaccggttacctttaccgttaccgttacccgtttaccccggtacccttaacgttccggttaacggtaacggtttcggtttacggtacgtttaaccggtggttaaccgggg

SEQ ID NO: 125260 - DNA, 596 bp, Homo sapiens
  misc_feature: GYAE6OF02I5AOJ.33.6.A06.1.454.CMB.1.raw
  modified_base (308)..(308): a, c, t, g, unknown or other
  misc_feature (308)..(308): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttcttagcctggtaccagcacgaaacctggccaggctcccaggtcctcctcctctactggtgcatccaccagggccactgcactccagacaggttcagnggcaggtggtctgggacagacttcgactctcacatccgacagactggacgcctgaagtattttgctaagttcttaatttacgtgtacagtactagttataacgtcggggacgtacggttcggaccgaaaggggtaccgaaagggtggtaaactacgaaaaccgtacgtcggtacggtacgtgacctaacgactacgttacgttcttacgacgttacccttcccggcctaacttccgttaacggtacgttcggttacgttcggttaactcgggtaggtcgggtaccggg

SEQ ID NO: 125261 - DNA, 636 bp, Homo sapiens
  misc_feature: GYAE6OF02G9HHA.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagagtgttagcgggtacctagcctggtaccaacagagacctggccaggctcccaggctcctcttctatgatgcatccaacacgggccactggcatcccagccaggttcaggtggcggtgggtctgggacagacttcactctcaccatcagcacgacctagacgccgtagaagttattttcgacttagttttaacttactcgtacagtcgtaggacgtagactaacgtcggttcgttacgggtaccgtttcggaccgtaacggggaccgtaagggtacgtaaacgtacgaaaaccggtaacgttgggtacgtcgtacgaccctaacgtacgttaccgttacgttaccttacctactttccccgttcccgtaccttaacgtccgttacggtaacgtttacggtttaccggtttacgtacgggtacgggtccgggtacgtaccgggg

SEQ ID NO: 125262 - DNA, 524 bp, Homo sapiens
  misc_feature: GYAE6OF02H7CC1.33.6.A06.1.454.CMB.1.raw
  modified_base (229)..(229): a, c, t, g, unknown or other
  misc_feature (229)..(229): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (498)..(524): a, c, t, g, unknown or other
  misc_feature (498)..(524): n is a, c, g, or t
tcagtacacacactcacgaccggtgctcgatttagatctactgacagggccagtcagactgttagcagcggcttcttagcctggtaccagcagaaacctggccaggctcccaggctcctcatccatggtgcatcccaccagggccactggcatcccagacaggttcagtggcaggtggtctgggtacagacttcactctccacatcgacagacgtggagcctgaagttnttttgcgtagtctattaccgtgttacagactagtactacggtgggggacgtaccggttaccggcccgaaaggggaacccgtaaggggtagggtaaaactaacgaaaacggtaaaccttgggtacgggtaccttacggaccaaccgtattacgttcgttaccgttcctaacgtcccttaccccgacctatcgttaggtagtgttgtagtacgtggacggcggtcgtaggaccgtaagggcctacgataggntagcgtancgtgcntacgnnnnnnnnnnnnnnnnnnnnnnnnnnn

SEQ ID NO: 125263 - DNA, 682 bp, Homo sapiens
  misc_feature: GYAE6OF02IWJVC.33.6.A06.1.454.CMB.1.raw
tcagtacacacactcacgaccggtgctcgatttagatctactgacagggaaccatggaaaccccagcgcagcttctcttcctcctgcttctctggctcccagataccaccggggaaattgtgttgacacagtctccagccaccctgtctttgtctccagggaaagagccaccctctcctgcagggccagtcagagtgctggcagcaacttagcctaggtaaccaaacaaaaccgtggaccagacctcccaggcctcctacatcctatgatcgcactcccaacgacggccactggcactcccagcctaggttcagtcgcaggtcggtcgtagggacagtacttcgaccttcgacaaccgatcgacagtcgtaggactccgtagaagttacgtttcggactagtttacttagtttacgtcggtactaacgtactaggttacgttaacggtacggggtacgttaaccgggttccggaaccggaaacggggtaaccgtaaagggtaacggtaaaacttaccggaaaaccggttaagtcggttacggacctacggaaccgtaaccgtagttacccggtacgttaccgtaccgttaacgtccccgttaccggaccttaacgttcgtaacggtaacgttcgttacgttacggtaccgtcggtacgggtaccggtacgtccgggtaacgg

SEQ ID NO: 125264 - DNA, 690 bp, Homo sapiens
  misc_feature: GYAE6OF02GEO3Y.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggaaaggccaccctctcttgtaggccagtcagagtgttagcagcaactacttagcctggtaccagcagacacctggccaggcctcccaggcctcctcatccagtggtgcactccaccgagggccactggccactcccaagacctacggttcaggtcggacgtaggttcgggtcgttaggggacgtagtaccgtttcaacgtttcctaccaacctattccgaagcgaaggtaccgtgggaacgtcccgttaggaaacgttagttttcgacgtaaggttgttaactttacgtgtacgtagtacgtaggttacggttagttactacgttccgttccggtacggttccggaccgtaacgggtacccgtaaagggttaaggtaaaacgttaaaccggaacgtacggttacggacgttacgtacctaaccgtaacgtcgttacgttaccttacgtacgttcccgttacccgtccgtaacttaccgtaggttaaccggttcggttacggttacgtacggttacggacggtaccgggg

SEQ ID NO: 125265 - DNA, 603 bp, Homo sapiens
  misc_feature: GYAE6OF02IM4N4.33.6.A06.1.454.CMB.1.raw
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (570)..(570): a, c, t, g, unknown or other
  misc_feature (570)..(570): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagagccaccctctccctgcagggccagtcagactgttagcagcggcttcttagcctggtaccagcaagaaacctgggcccaggcctcccgaggtcctcctcctctagtcggtgcactccaccgacgggccacgtggcactccgagacgtaggtcagtcggcgaggtggtcgtggacagtacttcnctctaccacataccgacgacgtacgtcggacgtccgtagtaagtnttttcgcgtagtgttacttacgtcgtanacgntaacggtacggttattactcgttcgttcggtaccggtttccggaccggtaacggaccgtaagggtaaggtaaactacgaaacgtaacgtggtacggcgtcgaccacgtactcgtcgttacttctacttcctcccgtatccgtntacgtacgttcgtggttagttacgtggtaccgg

SEQ ID NO: 125266 - DNA, 815 bp, Homo sapiens
  misc_feature: GYAE6OF02HLQPQ.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccagggacagagccaccctctcctgcagggccagtcagactgttagcagcggtcttctagcctggtaccagcaacgaacctggccacggcctcccgaggcctccctcctctagtggtgctactccaccgacgggcctacgtggccacgtccccgaagtaccgtaggttaccgaggtcggacgtaggttcgggtcgtacgggaactacggtacttaccgtaccttccgtaccaaccgtacgtaccgaacgtagaccgtaggacgtacgtaaggtaacgttagttttcgacgttacgttactttaacttacgttcgtacgtacgtacgtaacgttaacgttacgggtacgggggtacgtaacccgggtttaccgggaaccggtaaaccggggtaaaccgttaaacggggtaaacggtaaaccgttaaaccggtaaaacccgggtaacggttacgggtacgggttaaccggttacggtaacccgtaacccgttacgtttaccgtttaccggtttaccgtttacccgttacccgtttaccccggttaacccccggttaacccgtacgtttaacccggttaacggttaaccgggttttcggttaacccgggtttacggttaaccgggtttaaccggggttacccgggtacccggggttaaccggg

SEQ ID NO: 125267 - DNA, 685 bp, Homo sapiens
  misc_feature: GYAE6OF02GIPZ3.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagcccaccctctcctgcagggccagtcagactgttagcagcggcttcgttagcctggtaccagcaacgaaacctggccaggcctccgaggcctcctcctctatggtgcactcccaccgagggccacgtggccactcccgagccaggttcaggtggctaggtggtcgtgggacagtacttcactctacaccatcgagtcacgtaccgtaagacgtacctaggtaacgttcgttttacggacgtttaagttttacttacgttcgttcgtacggtacgtaggttaccgggttagttacctaacgttcccgttaccggttaccggttaccggaccggtaaacggggtaccgtaaaggggttacggaaaactaaccggaaacggtacgttacggtacgggtactacggaccctaacgtacgttcgttacgttaccgttacgtaacctttcccgttaccccgtacttaacgttccgtacggttaacggttggttacggttacggttaccgtagggtaacccgggg

SEQ ID NO: 125268 - DNA, 572 bp, Homo sapiens
  misc_feature: GYAE6OF02H6C16.33.6.A06.1.454.CMB.1.raw
  modified_base (398)..(398): a, c, t, g, unknown or other
  misc_feature (398)..(398): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (484)..(484): a, c, t, g, unknown or other
  misc_feature (484)..(484): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctcaggggacagagccacctctcctgcagggccagtcagactgttagcagcggcttcttagcctggtaccagcaagaaacctggccaggctcccaggcctcctcctctatcggtgacatccaccgagggccacgtcggacactcccagtaccgtaggttcaggtcggacgagggttcgggtcgtagggactaggtaccttctacctctaccgaacctataccgacaagacgtggacgctagaatntttcgactagtctagtctgcagcagtataggngggtanacggttcgacgaagggacaaggtagaaacttcgaaagtacgtgtacgntgcctacattacgtgttcttagactttccgtacccgactacgtcgtagtacgttcggttacggtcgttaacggtggaccggtggtacg

SEQ ID NO: 125269 - DNA, 475 bp, Homo sapiens
  misc_feature: GYAE6OF02JH9PP.33.6.A06.1.454.CMB.1.raw
  modified_base (262)..(262): a, c, t, g, unknown or other
  misc_feature (262)..(262): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (439)..(475): a, c, t, g, unknown or other
  misc_feature (439)..(475): n is a, c, g, or t
tcagtacacacactcacgaccggtgctcgatttagatctactgacagggccagtcagactgttagcagcggcttcttagcctggtaccagcagaaacctggccaggctcccaggctcctcctctatggtgcatccaccagggccactggcatcccagacaggttcagtggcagtgggtctgggacagactttcactctcaccatcgacagactggagcctgaagatttgcagtctattactgtcagcagtatacgtgggganaccgttcggccgaagggacctaagggtaggaaactacgaaaacgaaccgtggtcgggctggaccacctatccgtagttccttcgtaacttccttccccgactactccgtagtaacggttgtggttagtacgtggtacggcgggtcgtgggacgaacgggcgacagtagnagtcnagnnnnnnnnnnnnnnnnnnnnnnnnnnnnnnnnnnnnn

SEQ ID NO: 125270 - DNA, 636 bp, Homo sapiens
  misc_feature: GYAE6OF02IVJ0K.33.6.A06.1.454.CMB.1.raw
  modified_base (248)..(248): a, c, t, g, unknown or other
  misc_feature (248)..(248): n is a, c, g, or t
  modified_base (544)..(544): a, c, t, g, unknown or other
  misc_feature (544)..(544): n is a, c, g, or t
  modified_base (555)..(555): a, c, t, g, unknown or other
  misc_feature (555)..(555): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcgagggccagtcagactgttagcagcggtcttcttacgcctggtaccagcagaacctggccaggccncccaggcctcctcctctatggtgcactcccacccgacgggccacgtcggacctactcccgaggacctacgggttacaggtacggcgtagggttcgggtacgtgggacaggtaccttcaccttctaccaacccacgtacgaacgacgtactacgggacgtccgtagtaacggttattttcgacttaggttcttaacttacgtcgttacgacgtactaagtacgtacggtagggtacggtacggttacgaccggaaacgggacgtaagggacggaaacgtacgaaacgtagtgtacgngtcgaccacgnttcgtcgtccttacgacttcccgtaccgtacctagtctacggtagttcgtacggttagtacgtagggaccggtcggtacgg

SEQ ID NO: 125271 - DNA, 745 bp, Homo sapiens
  misc_feature: GYAE6OF02GGSD6.33.6.A06.1.454.CMB.1.raw
  modified_base (640)..(640): a, c, t, g, unknown or other
  misc_feature (640)..(640): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtcctccgagggacagacgccaccctctccgtgacgacgggccagtcgagtacttgtacgcaggcggtctttcgtagccgtcggtaccagcaacgaaaccgtcggaccgacggcctaccgacggtcctccctcctactaggtcggtcgccgtactccccgaccggacgggccctacgtcggactacctcccgagaacgtacgggttcgaggtcggacgtagggtcgggttacgtacgggactacggtaccttccgaccttaccgtaccaccgtagtaccggacacggtaacgtgggaaccgtaccgttaaggaaacgttttacgtttcgaacgttacgttactttaacgtttaccgtagtacgtacgacttaaggttacgttaccgggaggggttacttaccgggtacggtaaaccggaaacggggtaaccgttaaagggtaacggtaaactaacggaaacgtacggttcggaggtaccgtacggaacnccgttagtacgttacgttaccttcgtaccgtttacccgtccgtaccgttacttacgtagtaacggtttcgttagtacggtacggtacgggtacgtacgggtacgg

SEQ ID NO: 125272 - DNA, 734 bp, Homo sapiens
  misc_feature: GYAE6OF02FQ94D.33.6.A06.1.454.CMB.1.raw
  modified_base (264)..(264): a, c, t, g, unknown or other
  misc_feature (264)..(264): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggccacctgtctttgtctccgaggggaccagagcccaccctctcctgcagggccagtcagactgttagcagcggcttcttagcctgtaccagcagaacctggacaggctccgaggtcctcctccgtntacgtggtcgacctacgtcccgaccgaggggcccaacgttggggacctacgtaccccgaagtaaccggacggtttccgaggttacgggactaaggttcggggtcgtagggggtacctaacgtaccgtttcgaccttccgtaccgaaccctacgttaccgacctacggacgttacgggacgtcccgtaggaaagttcgttttacggcgttaacgttcgtaatttaccgtgtaccgacgtacgtaacgtacgttaccgttagggggaccttacgggttacggaccgaaacgggtaaccgaagggttacgaaactacggtaaaccgaaccgttggtaccgtagtacgacgtaaccgtacttaccggttcgtaccgttacgacgtttcccggttacccgactaccggttaccttaacggttaaggttcgttaacggttaccggttacggtacggtaccgggtacggtaaccggg

SEQ ID NO: 125273 - DNA, 714 bp, Homo sapiens
  misc_feature: GYAE6OF02I0ZOG.33.6.A06.1.454.CMB.1.raw
tcagtacacacactcacgaccggtgctcgatttagatctactgacagggaaccatggaagcccagctcagcttctcttcctcctgctactctggctcccagataccaccgggaaattgtgttgacacagtctccagccaccctgtctttgtcttccagggaaagagccaccctctcctgctagggccagtcagagtgctggcagcaacttagcctggtaccaacaaaaacctggaccaggctcccaggactcctctctaatggtgcatccacctaggccacgtgacactccagacaggttcaggtagccagtgggtctggggactacggacttcgaactctacacctagttcgaactacggactttcgggaacgtacccggtaaagaacgtttttgaccgtaggttacctatttaaccgttgtacctaagtaccgtaagttacgttacgtagggtacgtaccggtttacgggacccgtaacgggaacccgttaaagggtacggtaaacgttaccgtaaaaccggtaaggtaggtacgggtaccgttaggaccgtaaccgacgtttacgtcgtttaaccgttaccgttaacgttcccggtttacccgaccgtttacgttaacccgttcggtaaacgtttcggttaacgttacggtttaccgttacggtaccggttaccgggtaaccgttaccgggtaccgtaacggttaacccgg

SEQ ID NO: 125274 - DNA, 796 bp, Homo sapiens
  misc_feature: GYAE6OF02H39D4.33.6.A06.1.454.CMB.1.raw
tcagtacacacactcacgaccggtgctcgatttagatctactgacagggaaccatggaaaccccagcgcagcttctcttcctcctgcttctctggcctcccagataccaccggagtaaattgtgttgacgcagtctccaggccacctgttctttgtcctccgagggacagacgcccaccctctcctgcgacgggccagtcagtagttgttacgcagcaacttactagcctaggtaccagacagtaccaccgtggacccgtaggcctccgacggtcctcctacactccgagtggtcacctactcccgaaccggacgggaccctacggtcggaccctaccgtacccgaagtacggtacggttacacgggtcgggacgtacgggtcgggttaccgtacggggacctaagttccttactaccgttcctaccgtaactactacggaacgaccgtacggtaacgttacgggaccgtaccgtaagggtttaaggtttacgttttacggacgtttagtttaacgtttaagtttaccgttacggttacgacggtacgtaacggttaccggtacgtaaccgttacggttacggttccgggtttccggggtaccggttaccgggaacccggtaaacggggtaaccggtaaagggtaacgtaaacgttaaccgtaaaaccgggttacgtacgggtaacgtcgtaccgaccgttaacgtcgttaccgtttccggttaccttaccgtcccgtttacccggtacccgttacttaaccggttacggttaacggtttacggttcggttaccgg

SEQ ID NO: 125275 - DNA, 642 bp, Homo sapiens
  misc_feature: GYAE6OF02IQPCF.33.6.A06.1.454.CMB.1.raw
  modified_base (164)..(164): a, c, t, g, unknown or other
  misc_feature (164)..(164): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
tcagtacacacactcacgaccggtgctcgatttagatctactgacaggggaaccatggaaaccccagcgcagcttctcttcctcctgcttctctggctcccagataccaccggagaaattgtgttgacgcagtctcaggcacctgtctttgctccagggacagngccacctctcctgcagggccagtcaggactgttagcagcggcttcgtacgcctggtaccagcagaaacctggaccaggctccgaggcctctcgatctaagtgactgactatccacgacggccagtggacactccaggcctagtcagtgcaggtggtcnggacagacgttnacgtctcaacatcacgtcanccgtagacgtacctagaaacgtacttttaggaactttaaagtttacgttactggtacgacggtagtaaccggtacgttaacgaaccgtaaacggtttcggtacgttacgggaacccggtttaccggaaccggttaacgggaaacccgtaaggggtaaccgtaaacgtaacgaaaaccgtacgttacggtaggtaccctagaacccgtacgtaacggtcttaacggttacttaccgtacttacccgttaccgacctaccggttcgtaacggtaacgttgggtagttcgg

SEQ ID NO: 125276 - DNA, 746 bp, Homo sapiens
  misc_feature: GYAE6OF02ICYKL.33.6.A06.1.454.CMB.1.raw
  modified_base (431)..(431): a, c, t, g, unknown or other
  misc_feature (431)..(431): n is a, c, g, or t
tcagtacacacactcacgaccggtgctcgatttagatctactgacagggaaccatggaaaccccagcgcagcttctcttcctcctgcttctctggctcccagactaccaccggaagaattgtgttgacgcagtctccagcacctgtctttgtctccgaggggacagacgcccacccttctccgtgcgagggccagtcagactgttagcaggccgtcttgtagcctggtaccagcaacgaaccgtggcccaggcctacccgaggtccttccgtcttacttatgtatcgactacgtaccaacgacggaccacgtcggactaccgtaccccgaagtcccgtaaggtttccgacggttacgggtcggggttcggttaccggtaggggtaacctaacgggttaccttttcgtaacgtttccgtacctaaacccgtnttcgaacggtcctaaggtaccggttagggactcccgttaggtaaaacggttttcttttacggaccgttaaggtttacgtttaacgttaacgtcggttacgaacggtcgttaacgggttacggtaactttcgaccgtttacccgtaccgggttacgttcccggaaccgggtaagggtaaccgaagggttaaccggtaaacaccgtaaaacggtccgttaggtaccggtactacgggtaccactattccgttacttacctcggtacttaccgttcgaccgtctagtacgttaggtaacgtcggtttacgacgttacg

SEQ ID NO: 125277 - DNA, 856 bp, Homo sapiens
  misc_feature: GYAE6OF02FQ99Y.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcacccttgtccttttgtctccgaggggacagagcccaccctctcctgcagggccaagtcagactgttagcagcggtcttcttacgcctggtaccagcacgaaccgtggccaggcctccaggctcctcctctagtggtcgcacgtccgaccgacgggtccacgtcgccactccaagactaggttacaggtcgcgtaggtcgggtcgtacgggacacgtaccttaccacgtcctacaccacgtacgacgtaacgaccgtggagccgtagtaacgtagttttcgacgttaaggttacgttaacgttaacgttcgttacgacgtaccgtaacggtttaccggttacgttaccgtacgttacccgttaccggttaccggttacccgggtaacccgtaaacggggtaaacccgtaaacggggttaaacggtaaaccgttaaacccgtaaaaaacccgggtaacgtttacgggttaacgggttacccgtaacggtaacccgtaaacccgtttaaccggttacccgtttaccgttttacccttaacccggtttaaacccgttttaccccccggtttaaccccccgggttaaccccgtttaaacccggtttaacccccggggttttaaacggggttaaaacccggggtttttaacccgggttttacccggggtttaaaccccgggtttttaacccgggttaacccgggggtttaaaccccgggggg

SEQ ID NO: 125278 - DNA, 744 bp, Homo sapiens
  misc_feature: GYAE6OF02IGI4F.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacacagtctccggccaccctgtctttgtctccaggggaaagagccaccctctcctgcagggccagtcagagtgttagcgggtactagcctggtaccaacagagacctggccaggcctcccgaggctcctcttctatgatgcactaccaacgacgggccacgtcggactacctaccccgacgtaccgtacggtttacgagggtcgggtcggggttacgggttcggtacgggacgtacgtaccttcgtacctccgtacacctactacgacgcgtacgtaccgtaagcgtccgtaggacgttcttcgtacgtacgtttacgtttaacgtttcgtacgtacgacgtacgacggttaccgtacttaccgtaacgtccgggtaccccttacggttacccggtaccctttacccgggtttacgaacccgggtaaaccggtaaccgtacgggttaacgttacgggaaacgttaggttacgaaccggttacgttgggtacggtctaccggtccttaccgttccgttaccgtttcccgttactccgtttaccccgacccgttaacccgtacgtttaccgtacggttacggtttcggttacggtttaccggttacggtacgggtaccggg

SEQ ID NO: 125279 - DNA, 815 bp, Homo sapiens
  misc_feature: GYAE6OF02ILTHF.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttaacgcagtctccaggccacctgtcttgtcctccgaggggacagacgaccctaccctctcctgacgacgggccagtcagtactggttacgcacggcggtctttacgttacgccgttacgggtaccagaccaacggtaaaccctcgggacccaacgggcctacccgacggtcccttacccttcccgtacgttagtcgggtacgtacctacctacccgaacccggacgggtccaaccgtcggaacctaaccgttcccgaacgtaaccggtacggtttaccaagggtccggacgtagggttcgggtacgtacggaacgtacgtacgtaccactcctaccaaccagtacgacagtaccgtggacctcgtagaagttacgttcgacgttaagtacttagttaccgtagtacgtaagaccgttagtacggttaccgggtaggggtaaccgtacgggttaaccgggtaaccgtaacggggtaaaccgtaacgggtaaacgtaaacgtaaaccgaaacggttaacgtacgggttacgtaccgtacggtacccgtaaccgttagtcccggttaacgttccgtttaccgaccgtttaacccgttaccccggaacccgttacgttaacgggttaccgtaaggtttacggttaccggttacgttaacccggtaaggtcccgggtaccgggtaacggtaccgggg

SEQ ID NO: 125280 - DNA, 734 bp, Homo sapiens
  misc_feature: GYAE6OF02JL9RT.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctcaggcaccctgtctttgtctccaggggacagagccaccctctcctgcagggccagtcagactgttagcagcgtctcttagcctgtaccagctagaaacctggaccaggcctcccgaggctccctcctctacgtggtcgcacctacccaccgtaacggccctactggaccacgtcccagacgtacgttcgagtcggcgtaggtcggtcgtcgggactagtacgttctactacgtcacgtaacgtccgacgtaacgacgtcggactaccgttacggtaaacgttagttttcgacgtttacgttacgtttaacgtttacgtcgtttaaccgacggtacgtaacggttaagttaccggtggggtaacgtaaccgggtttacggaaccggtaacgggtaccggaaacgggttaaaggaaaccgtaacggaaaccggtaacggtttacggtaccggtacgttaccgggtaacaccggttaaacgttccgtacgggtttccttacccgttaggtttaccccctttacccgtaaccgttcgttaaccgtaacgttaacggttcgtttacggtaccgttacgggtaaccttcgggggtaccgtaaccgg

SEQ ID NO: 125281 - DNA, 788 bp, Homo sapiens
  misc_feature: GYAE6OF02HIVNI.33.6.A06.1.454.CMB.1.raw
  modified_base (187)..(187): a, c, t, g, unknown or other
  misc_feature (187)..(187): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
tcagtacacacactcacgaccggtgctcgatttagatctactgacagggaaccatggaaaccccagcgcagcttctcttcctcctgctttctctggctcccagataccaccggagtaaattgtgttagacgcagtctccaggccaccctgtctttgtctccgagggacagagccaccctctcctgcngggccagtcagagtgctggcagacctaattagcctaggtaaccaaaactaaaacctggacctagaccctccgaggcctccnctactctatgatacncacctccgaaccgacggacctacgtacggacctactacccagacccgtaggttaccagtcggacgtggtcgggtacttcgggaactaacggtactttacacggttcctaccgaccaagtacgagcaacgtccgtaagacgaccgttaagaagttgttttacgactttaagttttactaaccgtgttacgtacgacaacggtacgtaagtaacctaaccggttaaccggtaaccctttaaaccgacccgtttcccggggaaaacgaagggtaaaccccgtagtaaccgggtaggttaaacccgtaaaaacgggttttaaacccgtaaacgtttacgggacgttaaacccgtccggtaaacccgtacccttacgtttacccgtttacgtttccgttttaaacccggtacccgttttaccccccggttaacccgtaacccggtttaacgtaacccgtttaagggggtttaacgtttaacccgggtttcggttaaccggttaacccggg

SEQ ID NO: 125282 - DNA, 680 bp, Homo sapiens
  misc_feature: GYAE6OF02FY06K.33.6.A06.1.454.CMB.1.raw
  modified_base (276)..(276): a, c, t, g, unknown or other
  misc_feature (276)..(276): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccgaggggacagagccaccctctcctgcagggccagtccagactgttagcagcggcttctagcctggtaccaggcaagaaacctggaccaggcctccgacggcctcctcctctagtcggtnacctactcccgaccgacgggccacgtcggacactcccgagactaggttcgaggtggacgtaggtcgggtctagggacacggtacttacgtaacgtcctaccgaactacgtaccggaacgtaaggaccggttggaacgtcccgttaaggtaaacggtttacgttttaccgggacgttacggtttaccttaaacgtttacgtacggttacgacggacgtacggtacgtacgtaaccgtacgttcgggttcgttacgggtacggttaccggaccgaaacggggtacgtaaagggtaacggaaactaacgaaacgtacggtgtaggcgtagccaccgtattacgttcgtacttcctacgttcgtacccgtactagttacgtacggttagtgtacgtcggtagtccggg

SEQ ID NO: 125283 - DNA, 627 bp, Homo sapiens
  misc_feature: GYAE6OF02FLSX6.33.6.A06.1.454.CMB.1.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgtagcagcggcttcttagcctggtaccagcaacgtaaacctggaccaggcctcccgacggcctccctcctctatggtcgcactccaaccgagggcccacgtggcactccagacagtcagtggcaggtggtcgtgggacagtacttnactctacacactcganacgacnggagacctagaacggttattttcgacgtacgttacttaactttacgttagtacacggtacgtaagttacgttacggtaggggtacgtacgggtttacggaccgtaacgggaacgtaagggttacggaaagttaccgaaaacggtaacgtaggtagtacgtacgtacctaacgtacgttcgtacgttccttacgtacttacccgtcccgtcctacgttcgtagttagttcggttacgtacgttacgtcggtacgggcggtcgg

SEQ ID NO: 125284 - DNA, 704 bp, Homo sapiens
  misc_feature: GYAE6OF02IUJYN.33.6.A06.1.454.CMB.1.raw
  modified_base (116)..(116): a, c, t, g, unknown or other
  misc_feature (116)..(116): n is a, c, g, or t
  modified_base (315)..(315): a, c, t, g, unknown or other
  misc_feature (315)..(315): n is a, c, g, or t
  modified_base (673)..(673): a, c, t, g, unknown or other
  misc_feature (673)..(673): n is a, c, g, or t
tcagtacacacactcacgaccggtgctcgatttagatctactgacagggaaccatggaaaccccagcgcagcttctcttcctcctgcttctctggcctcccagataccaccggganaaatttgtgttgacgcagtctccaggccacccttgtctttcgtctaccgaggggacagacgcccaccctctcctagcgagggccagtacgaagtacttgttagcaggcggtctttacgtagcctacggtaccagactaacggaacctggacccaggtccgtaccccgtaggccttaccgttccttactacgtcgggtanacctacgtacccgtaaccggaacgggaccctacgtcggtactaccgtaccgacgtaacgtacggttagaggtcggacgagggttcggacggtagggactacgtacttaccgacttacgtacacgtaacgtacgaactacgtaccggaggtaccacgttagaacgtttagtttcacggttacgttacttaacgttactcgttaacgacgtacgttaagtacgtaacggtacggggtaactacgggtacgaacgaacggaacgttaaggtacgaaagtacgtaaacgagtgacgtacacgtccaacgtagttcctacgttctaccttattcccgtaactacgtattaccgtagtaggttntaacggttactacggaggtccggaggtacgg

SEQ ID NO: 125285 - DNA, 805 bp, Homo sapiens
  misc_feature: GYAE6OF02IXZTT.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtctccaggcacctgtctttgctccgagggacagagccaccctctcctgcaggccagtcagactgtagcagcgtcttcttagcctggtaccaacagacgacctggccaaggcctacccgaggtcctacctcttacgtatcgaagttcggactactacccgaaacgacgggtacccacgttgggacctacgttaccccaacggccgtaaccgggttccgaaggtttccggggtaccgggttaggggttccggttaacggggtaccgtaacggttaaccgttacgacccgttcgttcccgaaaccctaacgttaccgtaacgtaccgtaccggtacctacggaagtaccccgttaggttaaaaccggttacgttttacgtacgtttaacgttttaacggtttaccgtacggttcgtaacggtcgtaacggtacgttaaccggtaacctaaccggtttacggttaccgtttacgggttaacgggtttaccggtaacccgtaaacgggggtaaacccgtaagggtaagggtaaaaccgttaacggaaaaccggtaaagggttcgtacgggtacgtacgactaccgtacgttacgttcgtttaccttccgaacgttcccgttacccgtaccttacggttacttacgggtaagttcgttcggttacgttaacgttacgggg

SEQ ID NO: 125286 - DNA, 671 bp, Homo sapiens
  misc_feature: GYAE6OF02JB1YN.33.6.A06.1.454.CMB.1.raw
  modified_base (255)..(255): a, c, t, g, unknown or other
  misc_feature (255)..(255): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctcaggcacctgtctttgtctccagggaaagagccaccctctcctgcagggccagtcagagtgctggcagcaacttagcctggtaaccaaacaaaaacctggccacgacctcccaggcctccncactctatgatcgcactccaaccgacgggccacgtggcctactacccacgcccgtacggtttccgaggttggctaagggttcggggtcgtacgggacaaggtaccgttctaccgtccgtccaaccgatccgaacgctacgccgtaagcgccgtaagaattatttcgactttaggttttactacgttgttcgtagtcgagttacgtacgtactaacgtcgtacctaaacgttcccgttaccgggaaaccgtaaacggggtacctaacggacgtaagggtaacgtaaacgttaaaaccgtcgttagggttacgacgtaccgtaaccgaccctgttaccgttcgttaccgttaccttaccgttcccttaacccgccttaacgttcgttagtaccggttgtacggttctacggttacggg

SEQ ID NO: 125287 - DNA, 602 bp, Homo sapiens
  misc_feature: GYAE6OF02GF6IX.33.6.A06.1.454.CMB.1.raw
  modified_base (553)..(553): a, c, t, g, unknown or other
  misc_feature (553)..(553): n is a, c, g, or t
tcagtacacacactcacgaccggtgctcgatttagatctactgacagggaaccatggaaaccccagcgcagcttctcttcctcctgcttctctggctcccagataccaccggagaaattgtgttgacgcagtctccaggcaccctgtctttgtctccaggggacagagccaccctctcctgcagggccagtcagactgttagcagcggcttctagcctggtaccagcagaaacctggccaggcctccaggctcctcctctagtggtgcactccaccgagggccacgtggccactcccagacgtaggttcaggtggacgtaggtgggtcgtgggactacggtaccttcacgttctaccaccacgtcgaacgacgtacgtaggacgccgtaggaagtagttttcgactagtcttattacgtgtacacgtactacgtactacggtacgggtacgtacggttcggaccgaacgggtaccgaagggtagaaactaacgaaacgtacgtcgtaggtacctgaccaactagtacgtcgttactactacgttccgtacccncgtactcgtacgtagttcgttcgtcgttacgtcggtacggtcgggtacg

SEQ ID NO: 125288 - DNA, 1048 bp, Homo sapiens
  misc_feature: GYAE6OF02IM6CC.33.6.A06.1.454.CMB.1.raw
tcagtacacacactcacgaccggtgctcgatttagatctactgacagggaaccatggaaaccccagcgcagcttctcttcctcctgcttctctggctccagataccaccggagaaattgtgttgacgcagtctccgaggcacctgtctttgtctcgaggggacagacgcccaccctctcctgcgagggccagtcagactgtaacgcgagcggtctttacgttacggccgttggtaacctagaccgtaaacggtaaaacccgtcgggacccgtaacgggccttaccccgaacgggtcccttacccttaccccgttacgttaacggttacgggttaaccggtaccctaaccgttaacccccggaaacccgggtaaaccggggtaccctaaaccgggttaccgggaccctaacccgttaacccccgaaacgggttaaccggttaacgggttaccggtaaacgggttacggggtaccgggtaaacgggttcggggttaccggtacggggtaaaaccgttacgggtaaccttttaccgaccgtttaccgtaacccgtaacccgtaacgttaacccgaaacggtaacgtaaccgttacgggaaccgtaaccgttaaggttaaaacgtttaccgttttacggaaccgttaacggtttaaccgtttaaacgtttaacccggtgtttaccggaaacgttacgttaaacggttaaacggtaaccggggtttacgggggtaaacgttaaaccggggtttacccgggaaacccgggtaaaaaccggggggtaaccgtaaaacgggggtttaaaacgggaaaaacccgtttaaacccgggaaaaacgggttaaaccggttcgggtaacggggtaacccttaacgggaaacccgttaacccgtaagttaaacccgtttacggttaaccctttaacccgttaaggttttaccccccggtaacccgttaaacccgtaacggttaccggtttaaacggtaacgggttttccggttaccggttaccgggttaacggtaccggggttacggggacccgggttaacgg

SEQ ID NO: 125289 - DNA, 686 bp, Homo sapiens
  misc_feature: GYAE6OF02F76MV.33.6.A06.1.454.CMB.1.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
  modified_base (358)..(358): a, c, t, g, unknown or other
  misc_feature (358)..(358): n is a, c, g, or t
tcagtacacacactcacgaccggtgctcgatttagatctactgacagggaaccatggaaccccagccgcagcttctcttcctcctgcttctctggctcccagataccaccggagaaattgtgttcgacgcagtctccaggcaccctgtctttgtctcgagggactagacgccaccctctcctgcgacgggcctagtcagaccttgtagcagcgtcttactacgcctggtaccagcacgaacctggcccaggcctccgaggccttcctctctagtgtcnccactccgacacgggccacgtggactacnccgagacgtacggtacnggacggctaggtcggtcgtaggctagcttcgacnctacacgtataccgactagctcggactacctaagtactaggtttcacgttacgttccttaagttactacggtactacggtactaggtaacgtacggtacggggacgttaacccgggttcgaaccgggttaaacggtacgttaaacgggacgtaaaccggtaaccgtaaaccggtaacgttacggtaccggtaacgtacgtaaacccgagttacgtttaacgttcgttaccgtttacctaccggtttacccgtaccgtcgttaaccggtgtaaccggtttacgggtacggttacgttcggtaacggttcgggtacgttcggggtaccgg

SEQ ID NO: 125290 - DNA, 754 bp, Homo sapiens
  misc_feature: GYAE6OF02JAWM0.33.6.A06.1.454.CMB.1.raw
  modified_base (140)..(140): a, c, t, g, unknown or other
  misc_feature (140)..(140): n is a, c, g, or t
  modified_base (348)..(348): a, c, t, g, unknown or other
  misc_feature (348)..(348): n is a, c, g, or t
  modified_base (744)..(744): a, c, t, g, unknown or other
  misc_feature (744)..(744): n is a, c, g, or t
tcagtacacacactcacgaccggtgctcgatttagatctactgacagggaaccatggaaaccccagcgcagcttctcttcctcctgcttctctggctcccagataccaccggagaagttgtgttgacgcagtctcaggcnccctgtctttgtctccgagggaaagagcccaccctctcctgcgacgggccagtcagagtcgctcggcacggactaacgttacgccgtacgggtaacccaaaacctaaaaaccgtcgggacccacggacctccccgacggcctacctcactctatgatcgacactccaccgacgggtccacgtcggcactcccacgccgtacggttcgnggtcggcgtaggtcgggtcggtcgggaccgtagtaccttccaccgtcctacgaccactcgacgtaccgtacgaccgtaacggacgacctaggtaagttacgttttcgacgtttaacgtttatttacgtcgttacgtcgtccggtagtaccggtacgtaccgtaaccgtaccggtaaccgttaaccgtacccggttaaccggtaccggaaccgggtaccgaaccggtacggtacggtaacggtaaacgttaaaccggtaacggttaccggacgggtccgtaccggtaccgtaaccgtaccgttccgtttacgttacctttaacccgttcccgttacccgttaccccggtaccttaccgttacgtttaccggtagttccggtttagtttacccgggtnttacccgggg

SEQ ID NO: 125291 - DNA, 685 bp, Homo sapiens
  misc_feature: GYAE6OF02GB8AC.33.6.A06.1.454.CMB.1.raw
tcagtacacacactcacgaccggtgctcgatttagatctactgacagggaaccatggaaaccccagcgcagcttctcttcctcctgcttctctggctcccagataccaccggagaaattgtgttgacgcagtcctccaggccaccctgtctttgtctccgagggacagacgcccaccctctcctgcgagggccagtcagactgttagcagcggtcttcttagcctggtaccagacaacgtaaacctggaccgaggccctacccgacggccttccctcctctagtggtcgactactcccaccgacgggccacgcggccacctccgagtaccgtaggttacgaggtggacgtaggtcgggtacgtagggacagtacttacaccgtactaccgtacctacgtaccgacgacgtacgtcgggacgtacgtagtaagttacgtttcgcgtagttcttacgttacgtgtacgagtacgtaacgttagtacggtagggtacgtacggtacggaccgtaaggtacgaagggtacgtaaacgtaaccgaaacggtacgtacggtcggtaaccgtccgtacctaaaccgttcgttacgttaccgttccttaccttacgttcccgttacccgtacttacggttacgttacggttacgttaggttacggttacgtacggtcgtacgggtcggtacgg

SEQ ID NO: 125292 - DNA, 144 bp, Homo sapiens
  misc_feature: GYAE6OF01ALX9Y.42.13.B02.1.454.CMB.1.raw
  modified_base (104)..(104): a, c, t, g, unknown or other
  misc_feature (104)..(104): n is a, c, g, or t
  modified_base (124)..(144): a, c, t, g, unknown or other
  misc_feature (124)..(144): n is a, c, g, or t
tcagtgacgtatgtcacgaccggtgctcgattagtctagcgacttccgcggctggcaaggcgcatagctgcctggtcaaggctacttccacatacgtcactgancggctggcaaggcgcatagnnnnnnnnnnnnnnnnnnnnn

SEQ ID NO: 125293 - DNA, 155 bp, Homo sapiens
  misc_feature: GYAE6OF01CQQTY.42.13.B02.1.454.CMB.1.raw
  modified_base (128)..(155): a, c, t, g, unknown or other
  misc_feature (128)..(155): n is a, c, g, or t
tcagtgacgtatgtcacgaccggtgctcgatttagtctagcgacttccgcgggctggcaaggcgccatagctgcctggtcaaggactacttccacatacgtcactgagcggctggcaaggcgcatagnnnnnnnnnnnnnnnnnnnnnnnnnnnn

SEQ ID NO: 125294 - DNA, 146 bp, Homo sapiens
  misc_feature: GYAE6OF01C111T.42.13.B02.1.454.CMB.1.raw
  modified_base (128)..(146): a, c, t, g, unknown or other
  misc_feature (128)..(146): n is a, c, g, or t
tcagtgacgtatgtcacgaccggtgctcgatttagtctagcgacttccgcgggctggacaaggcgcatagctgcctggtcaaggactacttccacatacgtcactgagcggctggcaaggcgcatagnnnnnnnnnnnnnnnnnnn

SEQ ID NO: 125295 - DNA, 149 bp, Homo sapiens
  misc_feature: GYAE6OF02JBOOO.42.13.B02.1.454.CMB.1.raw
  modified_base (128)..(149): a, c, t, g, unknown or other
  misc_feature (128)..(149): n is a, c, g, or t
tcagtgacgtatgtcacgaccggtgctcgatttagtctagcgacttccgcgggctggcaaggcgcatagctgcctggtcaaggactacttccacatacgtcactgagcgggctggcaaggcgcatagnnnnnnnnnnnnnnnnnnnnnn

SEQ ID NO: 125296 - DNA, 136 bp, Homo sapiens
  misc_feature: GYAE6OF02FJKXW.42.13.B02.1.454.CMB.1.raw
  modified_base (128)..(136): a, c, t, g, unknown or other
  misc_feature (128)..(136): n is a, c, g, or t
tcagtgacgtatgtcacgaccggtgctcgatttagtctagcgacttccgcgggctggcaaggcgcatagctgcctggtcaaggactacttccacatacgtcactgagcgggctggcaaggcgcatagnnnnnnnnn

SEQ ID NO: 125297 - DNA, 127 bp, Homo sapiens
  misc_feature: GYAE6OF02FGWXX.42.13.B02.1.454.CMB.1.raw
  modified_base (127)..(127): a, c, t, g, unknown or other
  misc_feature (127)..(127): n is a, c, g, or t
tcagtgacgtatgtcacgaccggtgctcgatttagtctagcgacttccgcgggctggcaaggcgcatatctgcctggtcaaggactacttccacatacgtcactgagcggctggcaaggcgcatagn

SEQ ID NO: 125298 - DNA, 135 bp, Homo sapiens
  misc_feature: GYAE6OF02F29Q3.42.13.B02.1.454.CMB.1.raw
  modified_base (128)..(135): a, c, t, g, unknown or other
  misc_feature (128)..(135): n is a, c, g, or t
tcagtgacgtatgtcacgaccggtgctcgatttagtctagcgacttccgcgggctggcaaggcgcatagctgcctggtcaaggactacttccacatacgtcactgagcgggctggcaaggcgcatagnnnnnnnn

SEQ ID NO: 125299 - DNA, 320 bp, Homo sapiens
  misc_feature: GYAE6OF01BL30Z.9.26.C04.1.454.CMB.1.raw
  modified_base (308)..(320): a, c, t, g, unknown or other
  misc_feature (308)..(320): n is a, c, g, or t
tcagtgatacgtctcacgaccggtgctcgatttagtctagcgactttgggttgggggggtgagggatgagaacctatgaacattctgtaggggccactgtctcctccaactctgcctccctcaccatctctggactgcaggctgacgacgaggctgactactactgtcagtcttatgacaccaccaatcctttgggtgttcggcggagggaccaagttgaccgtcctcggtcagcccaaggctgccccctggtcactctgttcccacctcctcagacgtatcactgagcggctggcaaggcgcatagnnnnnnnnnnnnn

SEQ ID NO: 125300 - DNA, 324 bp, Homo sapiens
  misc_feature: GYAE6OF01ANAVJ.9.26.C04.1.454.CMB.1.raw
  modified_base (313)..(313): a, c, t, g, unknown or other
  misc_feature (313)..(313): n is a, c, g, or t
  modified_base (318)..(324): a, c, t, g, unknown or other
  misc_feature (318)..(324): n is a, c, g, or t
tcagtgatacgtctcacgaccggtgctcgatttagtctagcgactttgggtttggggggggtgagggatgagaacctatgaacattctgtagggccactgtctcctccaactctgcctccctcaccatctctggactgcaggctgacgacgaggctgactactactgtcagtcttatgacaccaccaatctttgggtgttcggcggagggaccaagttgaccgtcctcggtcagcccaaggctcgccccctggtcactctcgttccccaccctcctcgagacgtatcctactggacgcgggctggacaggtcnaatgnnnnnnn

SEQ ID NO: 125301 - DNA, 320 bp, Homo sapiens
  misc_feature: GYAE6OF01C6AHG.9.26.C04.1.454.CMB.1.raw
  modified_base (313)..(320): a, c, t, g, unknown or other
  misc_feature (313)..(320): n is a, c, g, or t
tcagtgatacgtctcacgaccggtgctcgatttagtctagcgactttgggtttgggggggggtgagggatgagaacctatgaacattctgtagggccactgtctcctccaactctgcctccctcaccatctctggactgcaggctgacgacgaggctgactactactgtcagtcttatgacaccaccaatcgtttgggtgttcggcggagggaccaagttcgaccgtcctcggtcagcccaaggctcgcccctggtcactctcgttcccacctcctcagacgtatcactgagcggctggcaaggcgcatacgnnnnnnnn

SEQ ID NO: 125302 - DNA, 333 bp, Homo sapiens
  misc_feature: GYAE6OF02IPG34.9.26.C04.1.454.CMB.1.raw
  modified_base (318)..(318): a, c, t, g, unknown or other
  misc_feature (318)..(318): n is a, c, g, or t
  modified_base (324)..(333): a, c, t, g, unknown or other
  misc_feature (324)..(333): n is a, c, g, or t
tcagtgatacgtctcacgaccggtgctcgatttagtctagcgactttgggtttgggggggggggtgagggatgagaacctatgaacattctgtaggggccactgtctcctccaactctgcctccctcaccatctctggactgcaggctgacgacgaggctgactactactgtcagtcttatgacaccaccaatctttggtgttcggcggagggaccaagttgaccgttcctcggtcacgcccaaggctcgcccccctcggtcactctcgtccccgccctccgtcagacgtactcaacgtgacggcggctggcaaggcncatagnnnnnnnnnn

SEQ ID NO: 125303 - DNA, 749 bp, Homo sapiens
  misc_feature: GYAE6OF01BBMXH.10.23.C01.1.454.CMB.1.raw
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtattttcctttggcttatttaaaggtgtccagtgtgaagtgcagtctggtggagtcggtgggggaggtcttggtacaggcctggcgacggtccctgacgactcctcctgtcgcacgtcctcgtggtacttcagtctttgattgaatgtcgtacctaggtcggtacggtcggggtacccggactaacggttccggaaggggtaacgggtccgtgggtacggtcgggtcctacggtaaggttagttaggtagtttacgggaagtttacggtcgggttaacctagtttcgtaccgttagtcggtaccgtacgttcggttaggtacgggaacgggtcccgttaattacccgacgtaacgtcccgaacgacgaacgggacccgaaccggaccgagggtaccctaccgttacccgtacgttaaccttacccgtaaccgtaaaagtacggtaaacgttacggtacgtacgggtaacgaccgtacggaaacccgggtaccgtacccgggttaccgttaaggtttaacgttaacggtagggttaaacggtaacggggtaacgggtacggtttacgggttaacgggttaaccttaaacgg

SEQ ID NO: 125304 - DNA, 596 bp, Homo sapiens
  misc_feature: GYAE6OF01D3AF8.10.23.C01.1.454.CMB.1.raw
  modified_base (494)..(494): a, c, t, g, unknown or other
  misc_feature (494)..(494): n is a, c, g, or t
  modified_base (522)..(522): a, c, t, g, unknown or other
  misc_feature (522)..(522): n is a, c, g, or t
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtatttttccttttggcttattttaaaaggtgtccagtgtgagtgcagctgggtggagtcgtgggggagcttggtacagcctggcaggtccctgacgactctcctgtcgcacgcctcgtggattcagtctttgatagaatatgcctagtcgggacgtggggtccggacgtaaggttcccggaaggggtaacgggtccgtagggtacggttggggtctacggtagggttattggtagtttagggaaagttggtcggtacctagttcgaccgtagtcgcggtactcgtggtaggacgggtcctattccactataccacgagacgacgaccgcgaggcncctccgtagtactctacgtaatcgaacngtcagacacgtgacggacacggtcttagtcttacgtaggtaaggtaagggaggtacgtacgtacggttataacg

SEQ ID NO: 125305 - DNA, 570 bp, Homo sapiens
  misc_feature: GYAE6OF01CI7WK.10.23.C01.1.454.CMB.1.raw
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (313)..(313): a, c, t, g, unknown or other
  misc_feature (313)..(313): n is a, c, g, or t
  modified_base (461)..(461): a, c, t, g, unknown or other
  misc_feature (461)..(461): n is a, c, g, or t
  modified_base (492)..(492): a, c, t, g, unknown or other
  misc_feature (492)..(492): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaggtgtccagtgtgaagtgcagctgggtggagtcgtggggggagcttggtacagcctggcaggtccctgagactctcctgtncagcctntggattcagtctttgatgaatatgccagtggacgtgggtcccgnaagttccgagggacggcctgggagtgggtctcgaggtattgagttggaataggtgtacctagttcgcctagtcggacggacttcgtggtaggaacgggccgtattccgacctactccaaccgaaggaacgaccgacgaccgagggacnccgtccctgtactacctacctaaatcgaacngtcgtagacgaccaggacgacgccggtccttagtacttacgtgttaggtaaggagggtagtacgtagggttactaacg

SEQ ID NO: 125306 - DNA, 684 bp, Homo sapiens
  misc_feature: GYAE6OF01BV4L6.10.23.C01.1.454.CMB.1.raw
  modified_base (294)..(294): a, c, t, g, unknown or other
  misc_feature (294)..(294): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaggtgtccagtgtgaagtgcagctggtggagtcgtgggggagcttggtacagcctggcaggtccctgagactctcctgtcgcagcctctggacttcagtctttgatgaatagngccagtggacgtcggggtccggacgtaaggttccggaaggggaacgggtccgtgggtaggtgggtctacgtaggttattggagtttaggaattggtaggtaccagttcgccttagtcggacggtactcgttggtacggaacgggtcccgtaatttcccgaacctactacccgaaccgtaaggaaccgaaccggaccggaccggaagggtacgtacccttcccgtaagtacttacccgtaacctaaagttacgaaaccgtaggttaccgtaaggaaccggtacccgttaagggaaccggtacccgtaaccgggttcctttacggttaaacgtttcgtagggttaggttaaacggggagggttaacgttcggttaacggggtttctaaaacg

SEQ ID NO: 125307 - DNA, 746 bp, Homo sapiens
  misc_feature: GYAE6OF01AYCZG.10.23.C01.1.454.CMB.1.raw
  modified_base (297)..(297): a, c, t, g, unknown or other
  misc_feature (297)..(297): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtgggggagtcgttggtacagcctggcacggtcctgagactctcctgtcgcgagtcctcgtggtattcgagtctttgatgtaatntgccagtcggacgtgggtccgactaacggttccgaggggtaacggtccgtagggtacggttcggggtacgtcggtaagggtttacgttaggtaacggtttagggaaaagtttacgggttacgggttaacccgtaagttttccggaccgtttagtacgggtaccgggtacgtttccgttaggggtagggaaccggggtacccgttactttacccgaaccgtacttaacccgaaccgaggaaaccggtaaccggacccggaccggacgggaacctccccgttacccgttacgtacttacccgtaacgtaaagtaccggaaacttcgtacgtacggaacctaaccggtggaaacggtacccgtaccggttacctttaggttaacgtttaccgtaggttaacggtaacggggaggggttaaccggtttcggtaaagggttttaccctaaaagg

SEQ ID NO: 125308 - DNA, 696 bp, Homo sapiens
  misc_feature: GYAE6OF01D4OLJ.10.23.C01.1.454.CMB.1.raw
  modified_base (273)..(273): a, c, t, g, unknown or other
  misc_feature (273)..(273): n is a, c, g, or t
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctgggtggagtcgtgggggagtcttggtacagcctggcaggtccctgagactctcctgtcgcagcctntggattcagtctttgatagaatagtcgacctagtcgggaccgttcggggtacccggactaaaggttcccggaagggggtaacgggtccgtaggggtaggtcgggggttcctacggtaagggttacgttggtaaggttttagggaaagtttacgggttacgggttaaaccctagtttcggacccgttaaggtcgggaccgggtacttccggtagggtacgggtaacggggtcctaagttaccaaccgtactaccgaaccgaggaaccggaccggaccgaccgagggactccctccgtagtactccaactaaagtcgaactagtctaggacgtacctaggaccggtaccgtccgggtctttagttaacgttacgtaggttaaggtaaacgggtagggttagttacggttaagggttacttaaacg

SEQ ID NO: 125309 - DNA, 801 bp, Homo sapiens
  misc_feature: GYAE6OF01DPJCG.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttcctttggtacttaattttaaaggtgtacagtgtagtaagtgcagcgtggtggagtcggtgggggagtcgttggtacacgcgtggcgacggtcctagacgacctcctccgttggtcgcctacgtcccttgtggtaactttcgagttccgttttagagttagtaaattcgtcgacccgtaggttacgggtaccggttcggggtacccgggagtaaaccgggttacccggaaagggggaaccggtccggtagggtacgggttggggtccgtacggtaagtttagttaggtagtttagggtaaagttacggttcggtaacttagttccggtaaccgtagttacggccggttaacgttcgttcgggtaacgggtacgggtacccggttaagtttacccaaaccgtacgttaacccgaaccggtaacggaccgtaacccgggaacccggtaccggaacgggtaccgtacccgttacccgttaagttaaccgttaccttaaaccgtaaacgtacggtaaaccgtcgttacgagtaaccggacctaggaaccggtaccgtaccggttacccgtttagttaacgttaccggttggtaaggttaacgggtacgggtacgtttaacgttcgggtttaaccttaaagg

SEQ ID NO: 125310 - DNA, 761 bp, Homo sapiens
  misc_feature: GYAE6OF01D6ZUZ.10.23.C01.1.454.CMB.1.raw
  modified_base (268)..(268): a, c, t, g, unknown or other
  misc_feature (268)..(268): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttcctttggcttatttaaaggtgtccagtgtgaagtgcagcgtggtggagtcgtgggggagtcgttggtacagccgtggcaggtccctgacgactctcctgtgcngtcctgtggtattcgagtctttagattagaaattgtcgaccgtaggtggggtaacggtcggggtacccggacgttaaacgggtttcccggaaaggggtaaccggggtccgttaggggaacggttcggggttactacggtaagggtttagttaggtaagtttagggtaaacgttacggttacgggtaacctagtttcgacccgttaaggttcggaccgggttacttaccggttagggtacgggaaccggggtacccttaacgtttacccgaaccctaacgtacccgaaccggtaaggaaccggaaccggacccggtaccggaacgggactacccttcccggtagttaaccgtacctaacccgtaaagtacgaacgtacggtctacggtaaccgacgttcgggaacggtacccgtaccggttactttagttaaccgtttacggtaggtaacggttaaagggacggttacggttacggttaagggtttacttaaag

SEQ ID NO: 125311 - DNA, 685 bp, Homo sapiens
  misc_feature: GYAE6OF01E2OB2.10.23.C01.1.454.CMB.1.raw
  modified_base (293)..(293): a, c, t, g, unknown or other
  misc_feature (293)..(293): n is a, c, g, or t
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtattttcctttggctattttaaaggtgtccagtgtgaagtgcagctggtggagtcgtgggggagcttgggtacagcctggcaggtccctgacgactctcctgtgcagcctctggattcagtctttgattgaatntgacctagtggacgtggggtccgataacgttccgaggggacggtcctagggaggtggtactcgtagggtattggagtttagggaataggtcggtaccagtttcgccttagtcggcggtactcgttggacggaacgggtcctaattccaacctatacccgaccgaggaacggaccgaccgccgaagggaccgtccttacccgttgtaactccctaaccgtaaaattccggtaaactacggttaccgtacggtaacggtaccccgttagggaaccgggtaacccggaaccgggtttaccctttaaggtttaccgtttaaacggttgggttaacgggttaaaacggggtacggggttaaggtttacccgggttaaaggggtttaccttaaaacgg

SEQ ID NO: 125312 - DNA, 812 bp, Homo sapiens
  misc_feature: GYAE6OF01ECVKG.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttcctttggcttaattttaaaggtgtccagtgtgaagtgcagcgtgggtggagtcgtgggggagtcgttggtacagccgtggcaggtccctgacgacctctcctgtcgcacgtcctcgtggattcgagttctttagattagaatagtcgtacctaggtcgggaccgttcggggtcccggacgttaaacggttcccggaaggggtaacgggtcccgtaggggtacggttcggggttacctacggtaagggttattagggtaagtttaacggggtaaattagggttaccggttaacccgtagtttccggaccctttaaggtccgggtaccggttaaccgttcggttacgggtaacgggtaaccgggttacccgttaactttacccgaacccgtacttacccgaaccgaagggaaccggaacccggtaaccggacccgtaacgggaaccttccccgttacccgttaacgttaacctaccgtaaacccgtaaagttaccggtaaaccgtacggttaccgtacggaaacgtaacccgtacgggaaccggtaccggtaacccggttacgtttaacggttaacttaccggttagggttaacggttaaagggtaacgggttaaccgggttacggttaacggggtttacttaaaacgg

SEQ ID NO: 125313 - DNA, 721 bp, Homo sapiens
  misc_feature: GYAE6OF01APVTN.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctgaattttcctttggctattttaaaggtgtccagtgtgaagtgcagctggtggagtcgtgggggagcttggtacagcctggcaggtccctgagactctcctgtgcagcctcgtggattcagtctttgatgaatatcgccagtggacgtggggtccggactaacggttccgaggggaacggtccgtgggaggttcggggtcctcgtagggttattggagtttagggaattaggtcggttaaccctagtttcgaccttagtcggacggtacttcgtaggtacggaacggggtccgtaagttaccacctaactcccgaaccgtaaggaccggaacccggaccgacccggtaacgggaccgtccccgttaccccgttagttaacccttacccgtaaacccgtaaaacgttccggaaacttacgggttacctacggaaccggtaccgtacgggaacgggtaaccctacccggggttccttttaggttaaccgtttacggttacgggttaaacgggttaaacggggaggggttaacgtttaccgggttaaacggggttttaccttaaaacgg

SEQ ID NO: 125314 - DNA, 691 bp, Homo sapiens
  misc_feature: GYAE6OF01E0OCV.10.23.C01.1.454.CMB.1.raw
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtggggggaggcttggtacagcctggcaggtccctgacgactctcctgtcgcacgccctcgtgggatttcagtcttttggattagaactagtcgacctagtggacgtcgggtccggactaacggttccgaaggggtaacggtccgtagggacgggttggtcctacgtaggttagttagaggtttaaggaataagggttcggtaacctagtttcgtaccctagtcggaccggtactcgttaggtacgggtaacgggaccgtatacccgtacctagtacccgtaccgaaggacggaacccggaccggacccgaagggacccgtccgttacccgtcgtaactacccgtaacctaaagtaacgaaccgtactacgtacgaccgacgtacggaacggaccgtaccggttaccgttagttaaccgttagtacggttaggtaaacgggtacgggaacgggtttcgttaacgggttacttaaacg

SEQ ID NO: 125315 - DNA, 711 bp, Homo sapiens
  misc_feature: GYAE6OF01CQS35.10.23.C01.1.454.CMB.1.raw
  modified_base (242)..(242): a, c, t, g, unknown or other
  misc_feature (242)..(242): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaattttaaaggtgtccagttgtgaagtgcagcgtgggtggagttcggtggggggagtcgttggtacnggtccgtgggccgacggtccccgtagacgtaccttctccgtggtacgccacggtcccttcgttggtactttccgagttactttaggattaggtaaattacgtcgacctaggtcggtaccggttcgggggtacccgacgtaacggttaccgggaacggggtacgggtccggtagggtacgggttcgggtaccgtacggtaaggggtttacttaggtagtttaggtaattacgggttacgttaacctagtttcgaccttaggtcggtccggtaactcggtaggtacgggaacgggtcctaagttccaacgtactaccgacgtaaggaacgaccgacgccgaaggcctccgtctagtactacctaacgtaagtccgaactacgtctacggacctacgcggaacggacccgtacggtctttaagtagttacgtaggttaagtagggagttacggtacggttagttacctaaag

SEQ ID NO: 125316 - DNA, 853 bp, Homo sapiens
  misc_feature: GYAE6OF01DI3A1.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaggtgtccagtgtgagtgcagctggtggtagtcgtgggggagtcgttggtacagcccgtgggctacggtccctagacgtacctctccgtgtcgcacgtcctcgtaggtactttcacgtctttagattagaattatcggacctagtcgggacggttcggggtcccgtacgtaacggttccggaaggggtacggtccgtgggtagtggggttcctacgtagggttagttgtaagtttaggtaagtaagggtttacgtacgtagttcgacgtttagtgggtaccgtacttcggtaggtaacgggtaaccgggtaccgttacttaccgaacccgtaatacccgaacccgtaaggaccggaacccgtaccggacccgtaacgggtaaccgtcccgttacccgttaacggttaaccttaccccgttaaacccgtaaaacgttaccggaaacccgtttacggttacccgtaacggggtaaaccccgttaaccggttaccggggtaaaccggtaaccccgggttaaaccccgggtttaacccggtttttaaacggttttaaacccgtttttaaaccggggttacgggtttaaacgggggtttaaaacccgggggaaggggtttacccgggtttaaaccggggttttaaaccgggggttttaaccctttaaaaaaccggg

SEQ ID NO: 125317 - DNA, 810 bp, Homo sapiens
  misc_feature: GYAE6OF01D4B8B.10.23.C01.1.454.CMB.1.raw
  modified_base (190)..(190): a, c, t, g, unknown or other
  misc_feature (190)..(190): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggatttttccttttggcttaattttaaaaggtntccagtgtgaagtgcagctgggtggagtcgtgggggagtcttgggtacagcctggcaggtcccngagactctctgtgcagtcctntggacttcagtcttagatgtaatntcgcctagtcggtacgtcggggtccggactaacggttccggaacggggaacgggtcccgttagggtagggttacggggtcttacggtaagggtttacgttggtaagtttagggtaaagttaggtacgggttaccccttaagttcggacccgttagtcgggtaccgggtactttcggtacggtaacggggtaacgggtacccgtaacgttcccgaaccgtaaccgtaccgtaacccgaacggaaccgggaaaccggtacccgggacccggtaacgggtaaccggtcccgttaccccgttcgggttaaccttccccggtaaacccgttaaacgttacggaaacccttagggttacccgttagggaaccgtaaaccggtaccgggaaacgggtaaccccggtacccgggttacccgtttaacgggtttacctttaacccggtttagggttaacgggttaaacgggtacggggtaacggttttacccggttaaaggggtttacccttaaaacggg

SEQ ID NO: 125318 - DNA, 743 bp, Homo sapiens
  misc_feature: GYAE6OF01ENKGS.10.23.C01.1.454.CMB.1.raw
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (536)..(536): a, c, t, g, unknown or other
  misc_feature (536)..(536): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttcctttggtcttaattttaaaaggtgtccagtgtgaagtgcagctggtggagtcgtgggggagcttggtacagcctggcaggtcctganactctcctgngcagcctcgtggacttcagtctttgatgaatactgccaagtggacgtggggtccgctaacggttccgaggggaacggtccgtagggacggttagggtcctaggtaggttattggaagtttaggaaacgttaggtacggttaaccagtttcgaccgttaagtcgggtcggtaacttcgtaggtaaggaacgggtacccggtaattccgaaccctacgtaccgaacccgtaacgggaacggtaacccggaacggtaccccggaaggggtaacccncccgtttaccccgttagttaaccttacccgtaacccgtaaaaagttcggaaacgttacggttaccgagggtaaccgtaacccggttagggaaacgggtaaccccgtaaccggggtttcccgttaaggtttaactttaaccggttagggttaacggttaaacggggtaggggtaaccgttacgggtttaaagggttaccttaaaaacg

SEQ ID NO: 125319 - DNA, 866 bp, Homo sapiens
  misc_feature: GYAE6OF01CPTPI.10.23.C01.1.454.CMB.1.raw
tcagcatagtagtgcacgaccggtgctcgatttagtacacgtgattagggattggggagctctgggagaggacgccccagccctgagacttcccaggtcgttcccattcagtgatcagcactagaacacagaggactcacagtggagttggactgagtctggtatttttccgtttaggtactttaagttttaaaaggtgttaccgtaggttgtaggtaaggtgccaggtcgttgggtaggtaggttcggtggggggtaggtcgttgggtaacgtcggtccgtcgggaccgaccggttacccgtaggacgtccttccgtcccgtgtcggaccacgtccgtcgttcggtacttacgtacgtccgtttagagttacgtaattacgtacgtccgtagtacggtaccggtacgggtcccgtaacggtaaacggttaccggaaggggtaaccggtcgggtacgggtagggttcggttacggttacgtaaggtttatagggttaatacgggtaaagttggtaacggttacctagttaccggtaccgttagtacggtccgtacttaggtacgggtagggaaccggtaccgttactaccggtaaccacttaaccgaaccggtaacggaaccgtaccgtaaccggacccggtaagggaacccttcccgttaacccgttaacgttaaccgtaccccgttaaaacgaaccgttaacgtaaaccttccgggcgtaaacccggaggtacccgtaaccgggtaacgggaaccgttaccgggtaacccttttaggtaaaccccgttttaggggacccgttaaaggggttaaaccggacgggttttaaaggttacccggtaaacgggttttaacttaaagggg

SEQ ID NO: 125320 - DNA, 788 bp, Homo sapiens
  misc_feature: GYAE6OF01BKWLV.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggcttaatttaaaggtgtccagtgtgaagtgcagcgtggtggagtcggtgggggaggtcgttggtacaggccgtggccgtacgggtccctggagtacctcctccgtgtcgcacgcctcgtggtacttcgagttctttgattagaatgtcgcctagtcggtacgtcggggtaccgacgtaacggttcccggaaggggaacggtccggtagggtacggttcggggtacctacggtagggttagttaggtagtttacgggtaaagttacggttacggtaaccttagttacggaccgttaggtcggtccggtaacgttcggttagggtaacgggtaaccggggtacccttacgttaccgaaccgtacgtacccgaaccggaaggtaaccggaacccggtaccggacccgtaacgggtaccgtaccccttaccccggttagtaacccgttaccctaaaccgtaaacgtaccgaaaccgttagtaccgtacggtaccgtaacggtacggaaaccggtaccggtacggtttacccgttaggttaaacgttaccggttagggttaacgggtaaacgggttacgggttaaccgggttaacgggtttaaccggtttaccttaaaaacgg

SEQ ID NO: 125321 - DNA, 807 bp, Homo sapiens
  misc_feature: GYAE6OF01AX4Y1.10.23.C01.1.454.CMB.1.raw
tcagcatagtagtgcacgaccggtgctcgatttagtacacgtgattagggattggggagctctgggagaggagcccccagcccctgagattcccaggtgtttccattcagtgatcagcactgaacacagaggactcaccagtggagttgggactgagcgtggtatttttccttttggacttaattttaaaaggtgtccagtgtgaagtgcagcgtggtggagtcgtgggggagtcgttggtacacgtccgtgggctacggtccctaggacgtaccgttccgtccgttggtcgccgtacgtcccgttacgttaggttaaccttcgtaacggttccgtttaggtaattacggtaaacgtttagtaccgtacccgtaaggttacggggtacccggttaccgggggtacccggtaaccggttaaacggttacccggggaaacgggggtaacgggtccggttagggtacggttccgggtacgttacgtagggtttattaggtaacggttaggtaagttacggttacggttacttcgttacgttacgtaggtcggtaccggttcgtacggttaggaacgggtaacggtcccgttaacttacccgaacgtaccacccgaacgtacggtaaccggaacccgtcgaaccggtacggtacccgtccgtttacccttagtaaccgtaccctaaaccgtaatacggtaacctaggtacgacggtaccaacggtggaaaccggtacgtaccggttacgtagtttccgtacgtgggtaaacggttagggagttaccggtacgtttaagggttcctaaaagg

SEQ ID NO: 125322 - DNA, 687 bp, Homo sapiens
  misc_feature: GYAE6OF01AS46P.10.23.C01.1.454.CMB.1.raw
  modified_base (389)..(389): a, c, t, g, unknown or other
  misc_feature (389)..(389): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagcgtggtattttcctttggacttatttaaaagtgtcagtgtagagtgcagcgtggtggagtggtgggggacggtgttggtacagcccgtggccgtacggtcccgtgaaggtcctccgttcctggtcgaccgtccgtccttcggtacggtatttaccgtagtctttggtaatagaactagtcgaccgtagtcggtacgtcgggtccgacgtaacggtccggaagggacggcgtaggnggtcggtcgtagtagtacgttgtagtaggtaagtaggtcgtactaggtctcgtagtcggcgtactgtaggtacggtacggtacctagtcccaacgactacccaacgacgacgtaccgaccgccggtaacgccgtccgtccctgtacctaccgtaacccgtagtaacgaaccgttagtaccgtaacgtaccggtaacgtacgggaagtaccccggtcgttccgttaacggttaacgttacggtagggttaaacggtaagggtaccggttaagggtttaacggttggttaaaccgttaag

SEQ ID NO: 125323 - DNA, 743 bp, Homo sapiens
  misc_feature: GYAE6OF01DJVRX.10.23.C01.1.454.CMB.1.raw
tcagcatagtagtgcacgaccggtgctcgatttagtacacgtgattagggattgggggagctctgggagaggagccccagccctgagacttcccaggtgtttccattcagtgatcagcactgaacacagaggactccacagtgggagttgggaactggaagtcgttggttacttttttccgttttggtactttaaagtttttaaaaggtgttcctaggttgttaggaagttgacaggtcgttagggtgggtaggttcggtggggggtagttcgtttacggacacggtcccgtggccgtacggttcccaggactcctctccgtgtacgccgacgttccctgttaggtacttccgagttctttagattagtaatgtcgacgtagtacggtacgtccggggtacgaacgttacgtacgggagggacggtcgtgggagtcggtctagtagttataggtagttagtaagtggttacgtactagtcggtactggtcggtaccgtagttcggtaggtaacgggacggtaccgtacttaccaactaacgtacccaacgacgaacggtaaccgaccggacgacggtacctccgtaccgtaataccgtacctaaaccgtaagacgttaactacggtcgaacggtaaccgtacgagggtaacccgaacccggtttacgttaccgtttagttaacgttacggttaggtaaacgggtagggtagggttacgtttaacggttacgttaacgttaaag

SEQ ID NO: 125324 - DNA, 528 bp, Homo sapiens
  misc_feature: GYAE6OF02I6B5H.10.23.C01.1.454.CMB.1.raw
  modified_base (420)..(420): a, c, t, g, unknown or other
  misc_feature (420)..(420): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttcctttggctatttaaaggtgtccagtgtgaagtgcagctggtggagtctgggggaggcttggtacagcctggcaggtccctgagactctcctgtgcagcctctggattcagctttgatgaatatgccatggactgggtccgcaagttccagggaggcctggagtgggtctcaggtattgatttggaattagtggtaccattgcctatgcgactctgtgaagggccgattcacatcaccagagacgacgccgaggacnccgtccctgtactcctaccaaatcgaacagtctggagacctggacggtaccgacggtccttaggtacttacgtggtagtaaggtagggagtacgtagggtttctaacg

SEQ ID NO: 125325 - DNA, 717 bp, Homo sapiens
  misc_feature: GYAE6OF02H7NTJ.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggaggcttggtacagcctggcaggtccctgacgactctcctggtgcagcctcgtggtattcagtctttgatgaattatgccagtggacgtcgggtcccggactaacggttcccgaggggaacgggccgtaggggaggttcggggtctacgtaggttattggagtttagggaagttaggtcgggttaacctagtttcggaccttagtcgggtcggtacttcgttaggtaggaacggggtcccgtaagtttacaaccctaacgtaccgaacccgtaaggaaccggaaccggaaccggaccgaacgggaccggtcccgttaccccgttacggttaaccttcccgttaacccgaaaagttacgaaaccgtaacggttcgtaacggaaccggtaccgtagggaaccgggaccgtaccgggttacccgtttaggttaacgtttaacgtgggttacggtaaagggtaggggttaacggttacggttacgggtttacctaaacgg

SEQ ID NO: 125326 - DNA, 571 bp, Homo sapiens
  misc_feature: GYAE6OF02I97AL.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcagtctttgatgaatatgccatgggacgtcggggtccggcgaacgttccgaggggaacgggccgtgggacggtgggtctcgaggtagttgagtttggaagttgtggtaccagttcgccttagtgcggtactcgtggtaggaacgggccgtattcaccactccaccgagacgaccgacgccgaggacgcctccctagtactacctaccaaatacgaactagtacgtagacgaccgtgacggacgacggtccttagtacttacgtgtagtaaggtaggtagtacgtaggttactaacg

SEQ ID NO: 125327 - DNA, 668 bp, Homo sapiens
  misc_feature: GYAE6OF02ISUWG.10.23.C01.1.454.CMB.1.raw
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttcctttggcttattttaaaaggtgtccagtgtgaagtgcagctggtggagtcggtggggaggtgttcggtacngccgtgcggtcgtccgtagacgtctctcgttgcncgagtccttcgtggacttcgagtttcgttagagtagtaatgtcgacctagtcggtacgttcggggacccgtagttaaccggtaccggaggggacgtccggtaggtcggtcggtactcgaggtttattacggtagtaggaaagttcggtacggtaactgtcggtacttagtacggcgtactgttggtaaggacggtcgtacttacgacgtactacgacgtaacggacggtaccgacggaccgtaaggagacccgttctacggtactaccgtaacaaagtaccgaatcgttcaacggtacgtaccgacgtaacggaccgtacgggttacctttacgttaacgttacgttagttaacgggaaggtaacgggtaacgttacgggtttacggttaccttaaagg

SEQ ID NO: 125328 - DNA, 568 bp, Homo sapiens
  misc_feature: GYAE6OF02JAP1X.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttgggtacagcctggcaggtccctgagactctcctgtgcagcctctggattcagtctttgatgaatatgccatggacgtggggtccggcaagttccgaaggggaacggcctgggaggtgggtctacgagggttattggattggaataggtggtaccagttcgccttagtcgcggtactcgtggtggaagggccgtattccaccatccaccagagacgacgccgacggacgcctccgtgtactcctacctaaactagaaccagtctagacgtaccgtgacggaccgaacggtccttagtaacttacgtggttagtaaggagggtaggtcgttagggttactaacg

SEQ ID NO: 125329 - DNA, 819 bp, Homo sapiens
  misc_feature: GYAE6OF02HDVNX.10.23.C01.1.454.CMB.1.raw
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggatttttccttttggcttattttaaaaggtgtccagtgtgaagtgcagctggtggagtcgtggggggaggcttggtacagcctggcaggtccctgagacctctcctgtgcacgcctctggattcagtctttgatgaatatcgcctagtcggacgtggggtccggctaaggttccgaagggggaacgggtccgtgggagggttgggtctacggagggttagttggaagtttggaaagtttaggtacgggttaaccctagtttcggacccgttaagttcggtaccgggtaccttcgttagggttacgggtaaacgggggtcccggtaacgtttacccgaacccgtaacgttacccaacccgtaagggaaaccggtaacccgggtaacccggacccgggaagggtaccgtaccccgttacccccggttagggtttaacccttacccgttaaccctaaaacggtttacggaaaacccgttaacgggtttaccgtaacgggtaaccggtaacccgttagggtaaaccgggtaacccggtaacccggggtttacccgtttttaagggtttaaccgttttaacccggtttagggtttaaacgggttaaacggggttaacggggggtacggtttaacgggttaacgggggttttttaaccctaaaacgg

SEQ ID NO: 125330 - DNA, 669 bp, Homo sapiens
  misc_feature: GYAE6OF02H3FXV.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcagtcttttgatgaatatgccagtggactgggtccgcaagttccgaggggagggcctgggagtgggtctcgagggttattggatttagggaacttaggtcggttaacccatttcggacccttaagtcggaccgggtacttcgttggtacgggtaaacggggcccgtaattccgaaccctatacccgaacctaaggaacggtaccgaaccggcccgaagggacgcccttacccgtagttacctaccgttaccaaagtacgaaaccgtaggtacctacggaacgtacccgttcgggaacgggtaccgtaacccgggtccttttaggttaactttaccgttagggttacggttaaacgggacggggtagttacccggttaggggttttacctaaacg

SEQ ID NO: 125331 - DNA, 457 bp, Homo sapiens
  misc_feature: GYAE6OF02H6MB1.10.23.C01.1.454.CMB.1.raw
  modified_base (432)..(432): a, c, t, g, unknown or other
  misc_feature (432)..(432): n is a, c, g, or t
  modified_base (434)..(457): a, c, t, g, unknown or other
  misc_feature (434)..(457): n is a, c, g, or t
tcagcatagtagtgcacgaccggtgctcgatttagtacacgtgattagggattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaagggcccatcggtcttccccctggccgccctgcctccaggacgccaccctccgagagccacacggcggcccgtggggctcgccgtggtacgaacggtactaccttcccaacttactatcgctggagccgggcgtgggacgaacgggccgacagtagngnnnnnnnnnnnnnnnnnnnnnnnn

SEQ ID NO: 125332 - DNA, 843 bp, Homo sapiens
  misc_feature: GYAE6OF02IHCG1.10.23.C01.1.454.CMB.1.raw
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtatttttcctttggcttaatttaaaaggtgtccagtgtgaagtgcagctggtggagtcgtgggggagtcgttgggtacagccgtggcacggtccctgagactctcctgtcgcacgccctgtggtacttcagtcttgatgaatatcgctaagtcggacgttggggtaccccgacgtaacggttacccgaaggggggtaacggccgttaggggtacggttcgggggtacccttacgggaaggggttttacgtttaggaaagttttaggggaaaacgtttagggttaccggggttaaccttaacgtttcggttaacccctttaaggttccgggtacccggggtaaccgtttccggtttaagggtaacggggtaaccgggggtaccccttaacgttaacccaacccgtaaacggttacccgaaaccccgtaaacgggtaccggaaacccggtaacccgggacccgtaacggggtaaccgtaccccgttaccccggttgttaacccgttacccgttaaaccgtaaaacgttaaccggaaaccgttacgtttacccggtagtaaacccggtaccgtacgggaacggtacccggtaacgggtttccctttagggttaacctttaccggttagggtaacgggttaagggaggggttaacggtttaccgggttacggttttaaccgtaaacgg

SEQ ID NO: 125333 - DNA, 422 bp, Homo sapiens
  misc_feature: GYAE6OF02F0S9P.10.23.C01.1.454.CMB.1.raw
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (418)..(422): a, c, t, g, unknown or other
  misc_feature (418)..(422): n is a, c, g, or t
tcagcatagtagtgcacgaccggtgctcgatttagtacacgtgattagggattggaatagtggtaccattgcctatgtggactctgtgaagggccgattcaccatcaccagagacgacgccaggagctccctgtatctccaaatgaacagtctgagacctgaggacacggccttgtattactgtgtaagagggagtcgagggtttcaactattatagtagtggttatgactacgtggggccagggaaccctggtccaccgtctcctcagcctccaccaagggccccatccggtccttcccccctggccgcccctgcctccgaggacgccacctccgagagcacgacgccggccctgggctcgcctggtcaaggtactaccttcccactactatgctgacgcggctggcaggcncangnnnnn

SEQ ID NO: 125334 - DNA, 638 bp, Homo sapiens
  misc_feature: GYAE6OF02H09MV.10.23.C01.1.454.CMB.1.raw
  modified_base (272)..(272): a, c, t, g, unknown or other
  misc_feature (272)..(272): n is a, c, g, or t
  modified_base (520)..(520): a, c, t, g, unknown or other
  misc_feature (520)..(520): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggggaggcttggtacagcctggcaggtccctgagactctcctgtgcagccttcnggattcagtctttgatgaattatgccagtggacttggggtccggctaaggttcccgaaggggaacgggcctgggagtgggtctcgtaggttatgagttggaagtgtcgggtactattcggacctagtcggacgtcttgtgtagggaacgggtccgtacttcgaaccagtccgaacctaggaacgaccggaaccgaccgtagggacgtcccttcccgtgttaactaccgttacccaaagtcgtaaaccncgttactacggacggtaccctagggaccgggtaaccgaccgggttaccctttaggtaacttttacgtaggttacgttaaagggagggtaacgtttacggttagggtttacttaaacgg

SEQ ID NO: 125335 - DNA, 786 bp, Homo sapiens
  misc_feature: GYAE6OF02JXKGM.10.23.C01.1.454.CMB.1.raw
tcagcatagtagtgcacgaccggtgctcgatttagtacacgtgattagggagttggggagctctgggagaggagccccagccctgagattcccaggtgtttccattcagtgatcagcactgaacacagaggactcaccatggagttgggactgagtcgtggtactttttcctttggcttaagttttaaaaggtcgtccaggttgtaggtaagttgacagtcgttgggtagggtacggtcggtaggggggagtcgtttaggaccaggtcccgtggccggacggttcccctaggacggtaccttccgtccgttggcgtccacggtcccttagtggtacttcaggtctttagattacggaattagtcgtacctaggtacgggtcgttcggggtacccgtagtaaccggttacggaacgggggtacggtccggttgggaagggtttccgggtaccttagggtaacgggtttagtttggtaaagggtttaggtaaaacgtttgggtccggttaacgttagttcggtaccgttagtcggttaccggtcttcggtagggtacgggaccgggttacctacgttcgaacccgtataccgaaccgtaaggtccaacccgggtacaaccgggtacggaccgttcccgttacccgttaagtaccttaccccgttaacgtaaaagtcccgtaaacgcgtttacgacggtaactaccggaggtaccgacgtacccgggttacttaagttacgtagtgtaacgggtaaggtcggttacgtaccggttaggttaaccttagg

SEQ ID NO: 125336 - DNA, 709 bp, Homo sapiens
  misc_feature: GYAE6OF02H56KK.10.23.C01.1.454.CMB.1.raw
  modified_base (279)..(279): a, c, t, g, unknown or other
  misc_feature (279)..(279): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggatttttccttttggcttaattttaaaaggtgtccagtgtgaagtgcagctgggtggtagtcgtggggggaggtctttgggtacagccgttggcgacggtcccgtgacgacttctcctgtcncacgcctcgtggacttcagtctttgatagaatatcgacctagtcggacgtcgggacccgtacgtaacggttcggaaggggtaacgggccgtgggtacggtggggttacctacggtaggttagtttggaacgtttgggaaagttagggttcgtacctagtttcgaccctagtcggtacggtacttcgttaggtacgggacgggtacctagttaccaccgtactaccaccggtaagaaccggaacggaccgaccgtaggacgtccttacccgttagtaaccttacctaacctaaagttaccggaaacttaccggttactacgggaacttaccggtacgggaacgtaccggtaacggttacccgttttaggttaactttaccgtagggttagtaacgggtggggttaacttacggttacgggtttataaaccg

SEQ ID NO: 125337 - DNA, 703 bp, Homo sapiens
  misc_feature: GYAE6OF02G0TDI.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggtcgttggtacagcctggcaggtccctgagtactctcctgtcgcagcctcgtggacttcacgtctttgattgaaattactgccctagtcgggacgtcggggtccggcgtaacggttccgaaggggaacgggtccgtggggaggtcggggtctacgtaggttacttaggtagtttagggaagttaggttacggtacctagtttcggtaccgttagtcggaccggtacgttcgtggtacgggaacggggtccgtagttaccaccgtactaccgaaccgtaacggaacgaccggacccggacccgaacgggaccgtaccgtccccgttagttacctaccttaacccgaaacgttacggaaaccgtacgtccgttaacgacgaacccgttaggacggaacccgtaaccggtctttacggttaactttacgttaggttacggtaagggtacgggtaacggttacggttacgggtttactaacg

SEQ ID NO: 125338 - DNA, 653 bp, Homo sapiens
  misc_feature: GYAE6OF02JLIPF.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagcgtggtattttccttttggcttattttaaaaggtgtccagtgtgaagtgcagctggtggagtcgtgggggagcgttggtacagccgtggcacggtccctgacgtcctcgtcctgtgcacgtcctcgtgtatcagtctttgattagaattgtcgccgtagtcggacgttcggggtccggacgtaaggttccgaggggaacgggtccgttgggagtcggggtcctagtaggttagttgtagttaggaagtggttacggtaacttgttcgccgttagtcggtacggtacttcgtaggtacggaacgggtccgtattccgactacgtaccaccgaggaacggaccgacgaccgacgggacgtcccgtccgtacgtactaccgtacctaaagtacgaacgtacgtacgttacgacgtacgtacgacggtacgtaccggtacgtttacgttacgttacgttagttacggtaacggtacgggtacgtacgttacgggttactaacg

SEQ ID NO: 125339 - DNA, 650 bp, Homo sapiens
  misc_feature: GYAE6OF02IZ1IM.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttggactgagctggtattttcctttggcttatttaaaggtgtccagtgtagagtgcagctggtggagtcgtgggggaggtcgttggtacagccgtggcgacggtccctgacgactcctccgtgtgcacgtcctctggattcagtcttgactgtaatagtcgaccagtcggaccgtcggggtacccgacgtaacggttccggaaggggtacggtcccgtagggtaggtcgggttactacggaggtttagttgtagtttggtaaagttaggtacgtaccgtagtttcgtaccgttacgtcggacggtcttcggtaggtacggtaacgggtccgttaattcccgaccgtaacgtacctaaccgtagacggaccgtaccgccgtaaggacctccgtcccttagtactaccaactaacgtagaactcgtcgtacgacgtaccgtagacggtacgtcgttaccgttagtaacgttgtaaggtagtaggtaggtacgtcggtaacgttgtaacg

SEQ ID NO: 125340 - DNA, 732 bp, Homo sapiens
  misc_feature: GYAE6OF02HAD4M.10.23.C01.1.454.CMB.1.raw
tcagcatagtagtgcacgaccggtgctcgatttagtacacgtgattagggattgggggagctctgggagagggagccccagccctgagattcccaggtgttccattcagtgatcagcactgaacacagaggactcaccatggagttgggactgagctggtattttccgtttggtcttaatttaaaaggtgtcctagtgtgaagtgcagtcgtggtggagtcgtggggggagtcgttggtacgacgtccgtggacgtacggtccctggacgacctcctccgtgtcgcgacgtcctgtggtacttcaggttctttgagtacgtaattagtcggtactagtcgggtacgtcggggtccgacgtaacggtccggaagggggaacgggtccgtaggggtacggtcggtccgtacgtaggttacgtaggtaagtttaggaagtttcggtacggtaacctagttcggtaccttagtccggtacgtaacttcgtagggtacgggaacgggtcccgtaattaccccgaaccgtacgtacccaacggaacggtaccggaaacccgaaccggcggaacgggtaccttcccttaccggttgtaaccttccctaaacgttaaaacgcgtaaaccgttacgtccttaacgggacctaaccgtaggggaccgtaaaccggttcgttacgttaataccgttaacggtgggttaacgagggcggttaacgttacggttacgttactaag

SEQ ID NO: 125341 - DNA, 707 bp, Homo sapiens
  misc_feature: GYAE6OF02H5J5B.10.23.C01.1.454.CMB.1.raw
tcagcatagtagtgcacgaccggtgctcgatttagtacacgtgattagggattggggagctctgggagaggagccccagccctgagattccccaggtgtttccattcagtgatcagcactgaacacagaggactcacccagtggagtttgggactgagcgtggtatttttccgtttggcttaattttaaaaggtgtccagtgtgagtgcgagcgtggtggtagtcggtgggggagtcgttggtacagccgtaggcgtacgtcccgtgacgtactcctccgttgtgcgacgcctcgtgtagttcgtacgtcgttttgagtagtaacttacgtcgtactagtacgggcggttcgggcccgtaacgtaacggttcccggaaggggtaacggtcccggtaggggtcggtacggtccgttaacgtaggtttacgtaggttagtttaaggaacggttacggtacgtaaccgtagttacggtacttaagggtccgtaccggtactcgtttacggacgggtaacgggtccgtaacgttcaaccctcgtaccacgtacgacgaaccgccgacggacgtcgcccgtaccgtgtacctacaacgtaaagtacgtaacgtcgtacgtagaccgtacgtaggacggaacccggtcggttacgttacgttaagttcgtaggttaaaggtacgggaaggttcgtaacggttagttactaaag

SEQ ID NO: 125342 - DNA, 712 bp, Homo sapiens
  misc_feature: GYAE6OF02IP8PI.10.23.C01.1.454.CMB.1.raw
tcagcatagtagtgcacgaccggtgctcgatttagtacacgtgattagggattggggagctctggggagaggagccccagccctgagattcccaggtgtttccattcagtgatcagcactgaacacagacggactcaccatggagttgggactgagctggtacttttcctttggcttattttaaaacggtgtccagtgtgaagtgcgagctgggtggagtcgtgggggagtcttgggtacagccgtggcaggtccctgacgtactctcctgtgcagcctctggacttcacgtctttgattagaattgtcgtcctagtcggtacgttcgggggtacccggtacgtaaacgggttccggaaggggtaacgggtccgtagggtacgggttcgggtaccgtacggtaaggggttagttacggtaggtttaacgggtaaagttaggttacgggttaaccgtacgttacggtaccgttagtcggtaccggtacgttcggtagggtacgggtaacggggtcctaagtttcccgaacctataacccgaacgtaggaacgtaccgaccgacgtagacctctcccgtagttacctccgtaactaacgtacggaactacggttcgtacgaacgttacctagggacccggtaccaccgggttctttagtaaccgttgtaggtaaggtaagggtcgggttacgtacggtttacggttacctaacg

SEQ ID NO: 125343 - DNA, 870 bp, Homo sapiens
  misc_feature: GYAE6OF02GZSL8.10.23.C01.1.454.CMB.1.raw
tcagcatagtagtgcacgaccggtgctcgatttagtacacgtgattagggattggggagctctgggagaggagccccgagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggaggtcgttgggtacagccgtggcaggtccctggagacctctcctgtcgcacgcctcgtggattcagtctttgatgtaatatgcctagtcggacgttcggggtccggactaacgttccggaaggggtaacgggtccgtagggacggtgggtactacggtaagggttacgttaggtacgtttagggtaacgttaagggttacggttaaccttaggtttacgtacccgtttaaggttcgggtaccgggtaccgttacgggttacggttaacggggtaaacggggtcccggttaacgtttacccgaaacccggttaaccttaacccggaaacccggtaacggggtaaaccggtaaaccccggggtaaacccggacccccgggtaaacgggggtaacccggttaccccgtttaacccccggtttagtttaaaccccgtttacccgttaaacccgtaaaaacgttaaccggtaaaaccgtaacggtttacccggtaacgggtaacccggtaaccggttacggggaaaccgggtaacccggttaacccgggttaaccggttttaacggtttaaccgttttacgttaggtttaacgggttaaacgggtaaggggttaaccggtttacgggtttaacggggtttacttaaaaccgg

SEQ ID NO: 125344 - DNA, 817 bp, Homo sapiens
  misc_feature: GYAE6OF02I7ZCQ.10.23.C01.1.454.CMB.1.raw
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtatttttccgttttggcttaattttaaaaggtgtccagtgtgaagtgcagctggtggagtcgtgggggagtcgttggtacagccgtggctacggtccctagacggtacctcgttcctaggtcgacacggtccttcgtggtacttcgagttcctttaggattaggtaaacttacgtccggacctaggttacgggaccggtttcgggggtaccccgtacgtaaaccggtttcccggaaacggggggaacgggtcccggtaaggggtacgggtttacggggtaccgttagggtaaacgggtttagtttaggtaaggttttacggaaaaggttttacggtacgggtaaacccgtttagtttaccggtaacccgtttaggtacggtacggttaccttacggttaggtacggggaacgggtccgttaatacccgaacctacgtaaccaacggtaacggacgaacccggaccgtacggacggtacgtacccgttaccgtagttacctacgtaaacccgtaaatacggtaaaccttacggtacgttaagaaccggtaccgtagggaaaccgaccggttaccggttactttaacgttaagttaaccggttaggttaagggttaacgggtaacggttacggttacggtttaacgggttactttaaacg

SEQ ID NO: 125345 - DNA, 880 bp, Homo sapiens
  misc_feature: GYAE6OF02GA1FA.10.23.C01.1.454.CMB.1.raw
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctgggtattttccgttttggctagttttaaaaggtgtccagtgtgagtgcgagctggtggagtcgtgggggagcgttaggtacaggcctaggctagggttcccctggacgacctcgtccgtagtcgcacggtcctcgtggtacttacggtaagtcgtttttaggagttagaaaacgttacgtacgtccgtaaaggttcgggtaacccggtgggggtacccgggtacccgtaaacgggtttacccggaaacgggggggttaaaccgggtacccgttagggggtaaacgggtttcggggggtaccttacggggttaaacgggggttaacgttttgggtaaaggttttaacgggaaaaggtttaccgggttaacggggttaacccgttaaagtttccgaaccgtttaagtcggggaccgggtaccgttaccggttagggtaacgggtaaaggggacccgttaagttaacccggaacccgtaagttaccgtaaacccgaagggttaaccgaaccgggtacccgaaacggtccggggtaaacgtaccccgttcccgtaaggttacttaaccgttaacccgtaaaacggttaccgaaaccggtaacgttacgtacgaacggtaccgtacggaaaccggtccggtaacggttaccggttaacgttagttaacccgttggttaacggtaacgggtacgggtacgttagggttaaccgggttttacgtaaacgg

SEQ ID NO: 125346 - DNA, 874 bp, Homo sapiens
  misc_feature: GYAE6OF02JOGTX.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttcctttggacttaattttaaaggtgtaccaggttgtagtaagtgcagtcgtgggtggtagtcggtgggggagtcgtttgggtacagtccgtggccgtacgggtccctggacgtaccttccttccgttgtcggaccgtacggtcccctgttacgggtaacttcgaaggttcttttaggaagttacgtaaacttacggtccgtaccttaggtacgggtaccggttcgggggtacccggtacgtaacgggttacccggaagggggtaacggtccggtagggtaacggttcgggtccgtacgggtaagtttagtacgggtaaggtttacggtaaagtttacgggtcgtaacgtaacgtttcgggtaccttagggttcccggacggttaccttcggtacgggtaacgggtaaccgggtacgttaaccgttccaaaccgttcgaacccgtaaacgtacggaaaccgtccggtaaccccgacggtaacgggaccttaccccgttcggttaaacgtttaaccgtacccgttaaaccgaaaaggttccgtaaacgttaccggttccgtaaaacgggtaccgtaaccgggttacggaaaccgggttacccgtaacccgggttttaatttacggttaaactttaaccgggttacgggttaaacgggttaaccgggtaacgggggttactttaacccgggtttagggttttaaacttaacgg

SEQ ID NO: 125347 - DNA, 671 bp, Homo sapiens
  misc_feature: GYAE6OF02HKWRZ.10.23.C01.1.454.CMB.1.raw
  modified_base (208)..(208): a, c, t, g, unknown or other
  misc_feature (208)..(208): n is a, c, g, or t
  modified_base (412)..(412): a, c, t, g, unknown or other
  misc_feature (412)..(412): n is a, c, g, or t
tcagcatagtagtgcacgaccggtgctcgatttagtacacgtgattagggattggggagctctgggagaggagccccagccctgagattcccaggtgtttccattcagtgatcagcactgaacacagagactcaccatggagtgggactgagctggtattttcctttggacttagtttaaaggtcgtcagtgtgaagtgcagtctggnggtagtcggtgggggagtcgttaggtacacgtccgtggcgacggtccctaggacgtaccttccgtcctggtacgcctaccggtccgtcgtggtacttccaggttcttagagtagaatacgtcgacgtagtcgggtaccgtggggtccgtactaaggttcggaagggacggtcggtaggtacggtggtacaggtaaggtgttagntttaaggaagtggtaacgttacgtagtcgtaccgtagtcggacgtacgtcgtaggtacggaacgggtaccgtacgtactaacactaccgaacgacgaacgaccgacgaccgtagaccgtccgtaccgtacttactacctaaactaacgtacgaactcggtacagtaacgtaccgtaggaccggtaccggtaacggttactagttacgtacgttaggtacgtaacgggtagttacggttacggttacggttaactaacgg

SEQ ID NO: 125348 - DNA, 760 bp, Homo sapiens
  misc_feature: GYAE6OF02IQKBO.10.23.C01.1.454.CMB.1.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcttgggtacagccgtggcacggtccctgacgactcctcctgtgcagcctcgtggattcagtctttagatagaatagtcgcctagtcgggactcggggtccggactaacggttacccggaaggggaacggtccgtagggtacggtcggggtcttccggaaggtttagttggtagtttaggaaagttaggtacggtaacctagtttcgacccgttagtcggaccggtacttcgtaggtacgggaacgggtccgtaacgttccgaacctagtacccgaccgtaaggacggtaacccgaccggaccgaacgggtaccgtacccgttcccgttagttacccttacccgtaacccgtaaaagttaccgaaaccgtaacgttaccgtaacggtaaccgtacccggttagggaaccggtaacccggtaacccgggtttacccgttttaggttaaaccgttttccggttaaggtttaacgggttaaacggggtacgggggttaaccgtttaccggggtttaaacggggttttacccttaaaacgg

SEQ ID NO: 125349 - DNA, 735 bp, Homo sapiens
  misc_feature: GYAE6OF02F6X3E.10.23.C01.1.454.CMB.1.raw
  modified_base (568)..(568): a, c, t, g, unknown or other
  misc_feature (568)..(568): n is a, c, g, or t
tcagcatagtagtgcacgaccggtgctcgatttagtacacgtgattagggattgggggagctctgggagaggagccccagccctgagattcccaggtgtttccattcagtgatcagcactgaacacagaggactcaccatggaggttgggactgagcgtggtatttttccgttttggtactttaagttttaaaaaggtcgtacctaagtggtagtaagtgtacaggtcgtgggtaggtaggtcggtaggggggagtcgttaggtacgaggccgtggaccgacggtcccgtagacgtaccttccttaccgtggtcgacctacgtccgtacgtaggtactcgtagtcgtttagagtagtaactagtcgacgtagtcggtacggtcgggaccgtacgtaacggtaccggagggtaacgggccgtaggagggtcggtctagtaggttatggtaagttaggtaagtaggtctaacgagtttaccgacgttagcgacgtacgtacgtagtaaggaggtaccgattccgactaacgtacgaccgtaagaccgaacgaccggtacgaacggtaccnccgttaccgtaagttccgtaaccgtaaccgtaaatcggaaacctacgttacggaacgtaaccgtaaccggtacggtaacggtaccggtaaccgtacgtttaaggtaacctttaggttaggttacggtaacggtccgggtaattcgggtttaccggttaagttaacgg

SEQ ID NO: 125350 - DNA, 778 bp, Homo sapiens
  misc_feature: GYAE6OF02GFNY3.10.23.C01.1.454.CMB.1.raw
  modified_base (185)..(185): a, c, t, g, unknown or other
  misc_feature (185)..(185): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttggactgagctggtattttcctttggcttattttaaaagtntccagtgtgaagtgcagctgggtggagtcggtgggggaggcgttaggtaccacggtaccgtgggcctacggtccctggacgaccttctccttggtgccagcctcgtggtattcgagtccttttggatagtaaactagtgtccaagttcggaacggttcggggtccggaccgtaacggttcccgaaaggggggaacggtcccgtaggggtagggttacgggttccgtacgagggtttacgttggtaagttttagggaaaatttacgggttaggtaaccctaagtttcgaccgttaaggtcgggaccggttaaccgttcgtagggtaggaaaccggggtcccgtaagttacccaacccgtaatccccaaccgaaggtaccgaaccgggacccgaaccggaacgggctaccccggttacccgttaagtaaccttcccgtaacaaaaccgttagggaaacctacggttcgtaaccgaaccgtaccgtaggggaaccggacccgtaacggggttacccttttaggaaccgttttacgtaggggttaacgttaacggggaagggtttaggtacccggtttaagggtttaccttaaacgg

SEQ ID NO: 125351 - DNA, 419 bp, Homo sapiens
  misc_feature: GYAE6OF01BM9B1.25.46.E02.1.454.CMB.1.raw
  modified_base (414)..(419): a, c, t, g, unknown or other
  misc_feature (414)..(419): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctcctttgaaagcaactcggggactactggggccagggaaccctggtcaccgtctcctcagcctccaccaagggcccatcggtcttccccctggcgccctgctccaggagcacctccgagagcacagcgccctggctgccctggtcaaggctacttccactgtacagtctgacgcggctggcaaggcgcatagnnnnnn

SEQ ID NO: 125352 - DNA, 427 bp, Homo sapiens
  misc_feature: GYAE6OF01C7UX2.25.46.E02.1.454.CMB.1.raw
  modified_base (422)..(427): a, c, t, g, unknown or other
  misc_feature (422)..(427): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctcctttgaaagcaactcgggggactactggggccagggaccctggtcaccgtctcctcagcctccaccaagggcccatccggtcttccccctggccgccctgcctccgaggacgcacctccgagacgcacagcggccctgggctgcctggtcaaggctacttccactgtacagtctggagcgggctggcaaggcgcatagnnnnnn

SEQ ID NO: 125353 - DNA, 442 bp, Homo sapiens
  misc_feature: GYAE6OF01EYCGE.25.46.E02.1.454.CMB.1.raw
  modified_base (312)..(312): a, c, t, g, unknown or other
  misc_feature (312)..(312): n is a, c, g, or t
  modified_base (430)..(442): a, c, t, g, unknown or other
  misc_feature (430)..(442): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctcctttgaaagcaactcgggggactactggggccaggggaaccctggtcaccgtctcctcagcctccaccaagggcccatcggtctccccnggcgccctgctccaggcgcacctccgagacgcacagccgccgtggctcgccgtggtacgaacggtactactccactgtaacgtcgtagacggcgggctcgggacaagggcacagtagnnnnnnnnnnnnn

SEQ ID NO: 125354 - DNA, 721 bp, Homo sapiens
  misc_feature: GYAE6OF01D1POB.25.46.E02.1.454.CMB.1.raw
  modified_base (661)..(661): a, c, t, g, unknown or other
  misc_feature (661)..(661): n is a, c, g, or t
  modified_base (666)..(666): a, c, t, g, unknown or other
  misc_feature (666)..(666): n is a, c, g, or t
  modified_base (674)..(674): a, c, t, g, unknown or other
  misc_feature (674)..(674): n is a, c, g, or t
  modified_base (679)..(679): a, c, t, g, unknown or other
  misc_feature (679)..(679): n is a, c, g, or t
  modified_base (681)..(685): a, c, t, g, unknown or other
  misc_feature (681)..(685): n is a, c, g, or t
  modified_base (695)..(695): a, c, t, g, unknown or other
  misc_feature (695)..(695): n is a, c, g, or t
  modified_base (701)..(701): a, c, t, g, unknown or other
  misc_feature (701)..(701): n is a, c, g, or t
  modified_base (707)..(707): a, c, t, g, unknown or other
  misc_feature (707)..(707): n is a, c, g, or t
  modified_base (710)..(710): a, c, t, g, unknown or other
  misc_feature (710)..(710): n is a, c, g, or t
  modified_base (714)..(714): a, c, t, g, unknown or other
  misc_feature (714)..(714): n is a, c, g, or t
  modified_base (719)..(719): a, c, t, g, unknown or other
  misc_feature (719)..(719): n is a, c, g, or t
tcagactgtacagtcacgaccggtgctcgatttagactcatctacagggaaaggggctggagtgggttggccgtattaagaccaatagtgaagggtgggacaagagactagctgcatccgtgaaagactagattccaccatctacgaagggattgatttacaaaacaccgaacgactgttatcgtcgctaagtatagaacacgtccgtaggtaaacggttccggaaggaacctacgaacggttaccgtttttactttaaccttcgtttaaccctttaccgttttagaaaacgaccgtaaaccggttccggggaaactttccggtcggggaccgtaaccggggaccctcggtaccaccgtcgtcccgtaccgacgtccctaccaccggaacggcccctagttccccggttacccttcccccggtcggacccgtcccgtcggtaccctaccggaacgggcccgtaccgaccccgtacgaaaccggcgaccgtaaccgaccgggtcccggacccggttgggctaccgggtaccgtacggttaccgaaaaccggttctaacccgtttacccgacttacggtaacctacgtacggtcgggtaacggtcggtccggttaccgggaactacgggtcgtaatacggtaagtcgcgtgctaagctagccngtatnacgtgctngcagnannnnngcgactacgngtacgngagacngtnacanctcgnga

SEQ ID NO: 125355 - DNA, 656 bp, Homo sapiens
  misc_feature: GYAE6OF01BJJUX.25.46.E02.1.454.CMB.1.raw
  modified_base (206)..(206): a, c, t, g, unknown or other
  misc_feature (206)..(206): n is a, c, g, or t
  modified_base (615)..(616): a, c, t, g, unknown or other
  misc_feature (615)..(616): n is a, c, g, or t
  modified_base (620)..(621): a, c, t, g, unknown or other
  misc_feature (620)..(621): n is a, c, g, or t
  modified_base (623)..(656): a, c, t, g, unknown or other
  misc_feature (623)..(656): n is a, c, g, or t
tcagactgtacagtcacgaccggtgctcgatttagactcatctacagggaaaggggctggagtgggttggccgtattaagaccaagtagtgaaggtgggacaagagactacgctgcatccgtgaaagcagattcaccatctcgaagggatgattcaaaagaccacgctgtatctgcagatagaacagcctgaaggtcgagaccacngtccgtttacttacgtcgttaccttcctttaggaacgacctaacggtccggggactacgtcggggccgagggtaacccgtggtaccaccgtcctccctaccgacgtcccaccgaaccgaggccccctacgttccccggttcccctttcccccggtcgggccccgtccccgttcgaccccgttcccggaacgggtaccgtcccgaaccccggtaccggaacgacggaccctaaaccgggacccgggtccccggttcccccggaggggtccccttcgggtccccggttagggtaaccgtaaaccgggttaccctttaacccgtttaccccgtaacgtttaccgtacctacggtttccgacgggaacgggccggggtccgtacgggaaccgtaacgggccgtaagagtcggnngtgnngnnnnnnnnnnnnnnnnnnnnnnnnnnnnnnnnnn

SEQ ID NO: 125356 - DNA, 419 bp, Homo sapiens
  misc_feature: GYAE6OF02F81JI.25.46.E02.1.454.CMB.1.raw
  modified_base (414)..(419): a, c, t, g, unknown or other
  misc_feature (414)..(419): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctcctttgaaagcaactcgggggactactggggccagggaaccctggtcaccgtctcctcagcctccaccaagggcccatcggtcttcccctggcgccctgcctccaggagcacctccgagagcacagcggccctggctgcctggtcaaggctacttccactgtacagtctgagcggctggcaaggcgcatagnnnnnn

SEQ ID NO: 125357 - DNA, 424 bp, Homo sapiens
  misc_feature: GYAE6OF02H3RX4.25.46.E02.1.454.CMB.1.raw
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (416)..(424): a, c, t, g, unknown or other
  misc_feature (416)..(424): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctcctttgaaagcaactcgggggactactggggccaggggaaccctggtcaccgtctcctcagcctccaccaagggccccatcggtcttccccnggcncccctgctccagganccacctccgagagcacngcggccctggctgcctggtcaaggctacttccatgtacagtctgagcggctggcaaggcgcatagnnnnnnnnn

SEQ ID NO: 125358 - DNA, 423 bp, Homo sapiens
  misc_feature: GYAE6OF02IPRU6.25.46.E02.1.454.CMB.1.raw
  modified_base (408)..(408): a, c, t, g, unknown or other
  misc_feature (408)..(408): n is a, c, g, or t
  modified_base (414)..(423): a, c, t, g, unknown or other
  misc_feature (414)..(423): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctcctttgaaagcaactcgggggactactggggccagggaccctggtcaccgtctcctcagcctccaccaagggcccatcggtcttccccctggcgccctgctccaggagcacctccgagagcacagcggccctggctgcctggtcaggactacttcactcgtacagtctgagcgggctggcaaggcncatagnnnnnnnnnn

SEQ ID NO: 125359 - DNA, 478 bp, Homo sapiens
  misc_feature: GYAE6OF02HSMDI.25.46.E02.1.454.CMB.1.raw
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
  modified_base (461)..(478): a, c, t, g, unknown or other
  misc_feature (461)..(478): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctcctttagaagcaacgtcgggggactacgtggggccagggaaccctggtccaccgtctcctcacgcctccaccgaagggccccagtccggtcccttcccccgtggccgccctggcctccgaggacnccaccctccgagacgccacgacggcccggcccgtcggcctcgccgtcggtacaacggacttacctccacgtcgtacgagtctggacggcggcgtggacgtaggccgnagtagcnnnnnnnnnnnnnnnnnn

SEQ ID NO: 125360 - DNA, 509 bp, Homo sapiens
  misc_feature: GYAE6OF02F645R.25.46.E02.1.454.CMB.1.raw
  modified_base (229)..(229): a, c, t, g, unknown or other
  misc_feature (229)..(229): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (468)..(469): a, c, t, g, unknown or other
  misc_feature (468)..(469): n is a, c, g, or t
  modified_base (471)..(472): a, c, t, g, unknown or other
  misc_feature (471)..(472): n is a, c, g, or t
  modified_base (475)..(475): a, c, t, g, unknown or other
  misc_feature (475)..(475): n is a, c, g, or t
  modified_base (477)..(509): a, c, t, g, unknown or other
  misc_feature (477)..(509): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttatactgtacctcttgaaancaacgtcggggactacgtgggccagggaccctggtcaccgtctcctcacgcctccaccgaacgggcccagtccggtccttcccccgtggcccgcccctgcctccgaggcgccaccnccgagngcacgacgccggcccgtgggcctcgccgtacggtaccgaacggtaaccttaccttcccacgttcgtacctaggtccgtaggacggcggcgtacggaccgaacgggcactaagtaggnngnngangnnnnnnnnnnnnnnnnnnnnnnnnnnnnnnnnn

SEQ ID NO: 125361 - DNA, 725 bp, Homo sapiens
  misc_feature: GYAE6OF02HOOWP.25.46.E02.1.454.CMB.1.raw
  modified_base (638)..(638): a, c, t, g, unknown or other
  misc_feature (638)..(638): n is a, c, g, or t
  modified_base (673)..(673): a, c, t, g, unknown or other
  misc_feature (673)..(673): n is a, c, g, or t
  modified_base (723)..(723): a, c, t, g, unknown or other
  misc_feature (723)..(723): n is a, c, g, or t
tcagactgtacagtcacgaccggtgctcgatttagactcatctacagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctagaaggtcgaaggacacagtaccgttttattactgtaccttcctttagaaacgcaacgtcggggactacgtgggaccacgggaaccgtggtccaccggtccttccctcacgtccctacccgaccgaacgggtcccccaagttcccggttcccttaccccccgtgggcccgccccttgaccctccgaggtacgacccacccgttaccgagaaccgaccaaccgacgggcccggtaccccgtgggcctaccggccgttacgggtaacccgaaaacgggtcccttttaaacccgtttacccgaaccgtttcggtaaacccgtaaccggttttccgtaacggggtaacgggtaccccgggggtcgtttaacgggaacccggttaaacgggggcccggttaaaccgtaaagggttaacggtcagggtaacgtagcggacagtacgtcgtacgtacngtacgacgtacgtacgagtacgttacgtactatanacacgacgtcagtacgtctagtagtagtactacgacgtacgtactatagnga

SEQ ID NO: 125362 - DNA, 767 bp, Homo sapiens
  misc_feature: GYAE6OF01D3DR5.13.43.D10.1.454.CMB.1.raw
tcagtcacgtactacacgaccggtgctcgatttagactagcagtaaggggctgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttaggttaaacggccgggggggtcccttcgactctcctgtgcacgcctcgtggaatcactttcagtgacgcctaggatagaacgtcgggtccgccgaggcctaccggaggggaacggggcgtaggggagtgggagttcgggaccgttaagttaaaaggtgaacggcctaggagtgggtacgggacaacgagactacgctcgccgacccggtagaacgggcaaggtacttaccaaccgtactacctaccgaagaacgtagtacgtaacgttaacgaaaggaaacctaacgtacggtttacgttttacgtaacgtaacctaaagttacggaacgtaaccgtacccgtacggtaaccggtaccgggaacccggggtaaccgtaaccggttccgggtaccggttacggtttaaccgttacgttacggttaccgacccgacggtaccgtaacgacccggtaacccggttaacccgtccggttaaccccgtttaaaccgttttaacgttttttaacgttttttttacggtacccgttttccggggtaaccccgggggg

SEQ ID NO: 125363 - DNA, 762 bp, Homo sapiens
  misc_feature: GYAE6OF01A5TEH.13.43.D10.1.454.CMB.1.raw
tcagtcacgtactacacgaccggtgctcgatttagactagcagtaagggctgggagaggagccccagccttgggattcccaagtgttttcattcagtgatcaggactgaacacagaggctcaccatggagtttgggctgagcgtggtattttcctgctgctatttaaaaggtgtaccagtgtgaggtgcatctggtggagtcgtggggagcgttaggtaacggccgggggtcctcggactctccgtgtcgcgacgccgtcgtaggtaactcgtactttcgtagtcgtaacgtccgtaggacgtcggaacgtcggtacccgccgaacggtccgttacccgggaacgggggtaaaggggtccgttaggggtaggttcgggtacgtttacgggtacccgttaaagttaaaaaggtcggtaacggtcccgtaggacggtgggtacgggaacgtaaacgtacggaacgtaccgcgtacgacccgtaaccggtaacggtaaacgggaaccgtagtaaccgtttacccgaaccgtacgttcccgtaacctaagaacgggtactaacggtaacgttaacgaaacggtaaactaacggtacgttacggttttaccgtaagtaaacggtaactaacggtaacgtagttaccgtacgtaccggtacggtaccggggaacctcgttacggtccgtagtacgtaccgtgtccgaccgtagctagctaacggtcctacggtacctatttacgtttatttctaacggttcgtacggg

SEQ ID NO: 125364 - DNA, 897 bp, Homo sapiens
  misc_feature: GYAE6OF01CCYOA.13.43.D10.1.454.CMB.1.raw
tcagtcacgtactacacgaccggtgctcgatttagactagcagtaaggggctgggagaggagccccagccttgggattcccaagtgtttcattcagtgatcaggactgaacacagaggctcaccatggagtttggctgagctggattttcctgctgcttaagtttaaaggtcgtccagtgtggacgtgcatcgtggtggtagtcgtgggggagtcgttagggtaacggcccggggggtcctggacgtacgtccgtccgtggtcgaccgacgtccgtacggttcggggttacccaccggttacaacgtcctaacctaccctacgtaagttcggacgtccggttacgggtcccgaccggtacggacccggttaccggaaggggggtacggggtccgtagggtacgttcggtaccgttttccttttagtttttagtttaagtaggttaagttcggtaaagttactacgttaccgtccggacgtacggtacctccgggtagggccggggtactaacttccgaacctacgttccgaacgacggtaactaaccttaaccgttaacccgaaacgttaaccgaacccgtttcgttttaaacgttttaccctaaagtaaacgtttaccgaaacgttaccgggaaccttagggaaaccggtcgtaaccccgggtaaagtacgggtaacccgtacccggggttaccttaagggtttaccctttaagggtggttaaccgggaccgtaaagggtacgggttaccgggtaccccggggaaacccttaacggtttaaacccggtcggtttaaccccggtggtttaacgggttaccccgggttaccgggttaccgggggacccggggtaaacggtaaccccggggacccccgtttacgggtaaacccccccgg

SEQ ID NO: 125365 - DNA, 864 bp, Homo sapiens
  misc_feature: GYAE6OF01DQREN.13.43.D10.1.454.CMB.1.raw
  modified_base (371)..(371): a, c, t, g, unknown or other
  misc_feature (371)..(371): n is a, c, g, or t
tcagtcacgtactacacgaccggtgctcgatttagactagcagtaagggctggagaggagccccagccttgggattcccaagttgttttcattcagtgatcaggactgaacacaggaggctcaccagtggagtttgggctgagctggtacttttctgctgtcttaagtttaaagtgtcagtgtagagtgctatcgtaggtggtaggtcggtgggggtacggtcggttacggggtaaacggggtcccggggggttccccttcgtaccgttccgttccgtggtcgccgaccgtccgttacgtggaacttacctacgttttacaggttacgacccgtccggttagtagttaccggtaacgttccggggtacccncggtacccggccgttaccgggaaggggggtaacgggacgtggggacggttgggtacggttcgggtaacgttaaagttaaaaaggtcgaacggttccgtagggtaggtaggggtaccgtaacgaacgtacggtaaccctcggacctttacggacccgaaccggtaacgggacgggtacgtacggtacctttacccggaacttaccgtaccgtaccgaacggttagtacgtaagtaacgtaacgaaacggtaacgtacgttacgttcgtttacgtacgtaaacgtaacgtaacgtaacgcccgttaacggtaccggtaccgtaccggggtaccccgtagtaccggtacgttcccggttagttaccgtttaaccgtcggaccgtaacccggtcggaacgtacggacgttaccggttacccggtaccgtttaacccgtttaacgttttttaacttttacggttttttcccgaccggttttcgggtaaacccccgggg

SEQ ID NO: 125366 - DNA, 927 bp, Homo sapiens
  misc_feature: GYAE6OF01BZW3E.13.43.D10.1.454.CMB.1.raw
tcagtcacgtactacacgaccggtgctcgatttagactagcagtaaggggctgggagaggagccccagccttgggattcccaagtgttttcattcagtgatcaggactgaacacaggaggctcaccagtggagtttgggctggagctggtattttcctgctgcttaatttaaaggtgtcagtgtgaggtgcatcgtggtggagttcggtgggggacgtcggttagggtaaacggggtcccggggggttccttcggtaccttccgttcgttcggtacgcgacgtcctcggtaggtaacttcgttacctttcgaagtcgaaccggtcgtaggagtacggtaacgtccgggtacccgccgacgggtccgtaccgggaagggggaacgggtcggtagggacggtaggtaggttaccgggtaaccgttaaagttaaaaggtcgaacggtcgtaggtacggtacgggtacgggaaacgtaaacgtacggaccgtaacgtccgtaacggtacccgtaaccggtaagggaaacgggttaccctaaaacggtacccgtttaaccctaaccccgtaccgtttaccctaacccgggaaaggtaaggttaaacgtttaacccgggttaaaccggttaaaaccggggaaaaacgggtttaaaccccaagggttttaaccgttttttacggtaaaccgttaaccggtaaacgttaaaacgtacggaaaacgttccccgggtactttacgggaacccgggtttacccggggacccgggttaaccgacggttcgttaccggttacgtaaacgtttcggacggtccggaacctcggtaaccgtaccggaacggtttaccgggtaccccgttaaacgtccccgttttaaaatttggtttttttaaacccggtttccggtacccggttttaggggtacccccgggg

SEQ ID NO: 125367 - DNA, 604 bp, Homo sapiens
  misc_feature: GYAE6OF02ICK52.13.43.D10.1.454.CMB.1.raw
  modified_base (297)..(297): a, c, t, g, unknown or other
  misc_feature (297)..(297): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (463)..(463): a, c, t, g, unknown or other
  misc_feature (463)..(463): n is a, c, g, or t
tcagtcacgtactacacgaccggtgctcgatttagactagcagtaaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctcgggtccnccaggctccgaaggggagggcgtggagtgccgttctctttttattatagtagtggtatactatacncganacgtctccggtgggacggcgtactccgactactcctacgagtacaactaactaccaaagaaaccgcgtacttttcgtttactaactaaatacgaanaccggtctaggacgagccaagtcgaccgcggtcgttagttactgtggacgagtagaaggtccggtaccggggaaccctaacggttaacgttaccgtacgtcttaagcgggtaccggtcggtccgggggaactaaccccggg

SEQ ID NO: 125368 - DNA, 577 bp, Homo sapiens
  misc_feature: GYAE6OF02FJHX2.13.43.D10.1.454.CMB.1.raw
tcagtcacgtactacacgaccggtgctcgatttagactagcagtaaggggctgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccgggggggtcccttcgactctcctgtgcagcctctggaatcactttcagtgacgcctggatgaactgggtccgcaggctccgagggagggctggagtggatggcgtagtaaagtgagcctgatgggtggacaagagactacgctgcaccggtgaacgggcagtacttccgaccagtcctacgagacgatgattacgaaaggaacacgtagttacgttctggacaaatacgaaacacgacctgaacgtcggaccgggacacgtcgccgttgtacttacgtgtacgccgagacacgcaacgtaccgtcggaccctaattacgtttattttttacgtacgttcggtaccgggg

SEQ ID NO: 125369 - DNA, 589 bp, Homo sapiens
  misc_feature: GYAE6OF02IX0GZ.13.43.D10.1.454.CMB.1.raw
  modified_base (295)..(295): a, c, t, g, unknown or other
  misc_feature (295)..(295): n is a, c, g, or t
  modified_base (367)..(367): a, c, t, g, unknown or other
  misc_feature (367)..(367): n is a, c, g, or t
  modified_base (397)..(397): a, c, t, g, unknown or other
  misc_feature (397)..(397): n is a, c, g, or t
tcagtcacgtactacacgaccggtgctcgatttagactagcagtaagggggctgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccggggggtccttcgactctcctgtgcagcctctggaatcactttcagtgacgcctggatgaactgggtccncaggctccgaggggaggggctgggagtggattggccgtaattaaaagtgagtcctgagtggtgggacaacgngactacgctgcaccgtgaaggcagatcacntctccgagagatagattcgaaaggaacaacgtagttgtttacagactaaagtcgaaacacgcctagacgtcggcccgggaacacgtcgtaccgtgttaattacgtgtcgactacggctaacgcgtaacggttaccgtacggtaccctacgtttacgttttaacgttttttcgtaccgtttcggtacccgggg

SEQ ID NO: 125370 - DNA, 638 bp, Homo sapiens
  misc_feature: GYAE6OF02FS5F4.13.43.D10.1.454.CMB.1.raw
  modified_base (569)..(569): a, c, t, g, unknown or other
  misc_feature (569)..(569): n is a, c, g, or t
tcagtcacgtactacacgaccggtgctcgatttagactagcagtaaggggctgggagaggagccccagccttgggattcccaagtgttttcattcagtgatcaggactgaacacagagggctcaccatggagtttgggctgagctggattttccttgctgctattttaaaaggtgcccagtgtgaggtgcagctggtggagtcgtggaggaggcttgatccagccgtggggggtccctgagactctcgtgtgcacgcctctggtatttagtttagctagttatgccatgagtcgtgggtcccgccgaggcctccggaaggggacgggcgtgggtaggttgggtttcgggtagttaggtgtcgttcgttgagttcgatagctactatactagtgacgtagtaccgttaccgggttaacgggcctcgtttaccaacccgtattccgtacccgaagaacgtaactaacttacccgaaaagtaaccctacgtacttaagtactcgtacgacctaaggtactacgaaaccgcgtccggtagggaccgaccgaaggacctaaccggtcgttaacnccgtaagtggaacgaacgtaaagtacttagttagtaagtacgttaggttacggacgttacgtagtaccc

SEQ ID NO: 125371 - DNA, 518 bp, Homo sapiens
  misc_feature: GYAE6OF01DE9XK.12.85.H08.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagatacgacgtacacgaccggtgctcgatttagtatcactcagtcgcggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngcaccggaaccaatagtgacgttggtcgttataactttgtctcctggtacaaacagcacccaggcaaaacgcccccaatcctgatttangagtcactattcggctcagtatttcaatcgcttctctggttccaagtctggcaacacggcctcctgaccatctcgtggggtccaggctgaggacgagctgattatactgcagtcatatacaagcacttcactctcgtgtgttcggcggtggaccaagctcgaccgtctaagtcagcccaaggcctacgccccctggtaccactcctcgttcccctaccc

SEQ ID NO: 125372 - DNA, 731 bp, Homo sapiens
  misc_feature: GYAE6OF01E4IX1.12.85.H08.1.454.CMB.1.raw
  modified_base (589)..(589): a, c, t, g, unknown or other
  misc_feature (589)..(589): n is a, c, g, or t
tcagatacgacgtacacgaccggtgctcgatttagtatcactcagtcgcgggggggtctcaggaggcagcgctctcaggacatctccaccatggcctgggctctgctattcctcaccctcctcactcagggcacagggtcctgggcccagtctgccctgactcagcctgcctccgtgtctgggtctcctcggacgacgtcgatcaccaactctccttcgcactacggtaaccgaacgcacgtggacggtttacgggttgggttaagttaaacttaactagttcttcccttcggttaaccgaaaccaacgaccaccccaacggcgacgaacgaccccccaaaacctacactagtatttttagttatagttccaaccttaaacttaccggccccgttaccgtagggggttttccgttcgtacgttccgtcctttccttccgttcggcgttaccctaacgtacgtcgtactaacctaccggacccgtccctcgaccactcttcctggggcctcccacggacgttcggaagggaaccgacgggcttaggtaatttaatttactttggcagtcctcaattataaccgaaagacncggacacgaccctaccccttcgttttacggtacgtttaccgggaaaggttggggaacccctaaacgggttcccgtaacccccggttcccttaaacccggtccgaacgaccccccgtaaaaccgggccccctaaaaccccccc

SEQ ID NO: 125373 - DNA, 522 bp, Homo sapiens
  misc_feature: GYAE6OF01CU5N5.12.85.H08.1.454.CMB.1.raw
tcagatacgacgtacacgaccggtgctcgatttagtatcactcagtcgcgggggggtctcaggaggcagcgctctcaggacatctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctctgtaccaacaacaccaggcaaacgcccccaactcctgatttatgaggtcactattcggtcctcaggtaatttctaatcgcttctctgttcaagtctggcaacacgcctccctgaccatcctcgtcgggtccaggctggaggacgaggtctgtattattactgctagttcaatatacaagcctacgttccacttctcgtggtgttcggcggtggaccaagctcgaccgtacctaagtccagcccgaaggcctcgccccctcgtctacccg

SEQ ID NO: 125374 - DNA, 517 bp, Homo sapiens
  misc_feature: GYAE6OF01A126A.12.85.H08.1.454.CMB.1.raw
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (455)..(455): a, c, t, g, unknown or other
  misc_feature (455)..(455): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaaacgccccccaaactcctgatttatgaggtcactattcggtcctcaggaatttctaatcgcttctctggttccaagtctggcaancggcctccngaccatctctggggtccaggctgaggacgaggctgattatactgctagttcatatacagcacttccatctcgtggtgttcggngtaggaccaagctgaccgtctaagtcagcccaggcctcgcccctggtcactctgtccccgcc

SEQ ID NO: 125375 - DNA, 522 bp, Homo sapiens
  misc_feature: GYAE6OF01DERWL.12.85.H08.1.454.CMB.1.raw
  modified_base (212)..(212): a, c, t, g, unknown or other
  misc_feature (212)..(212): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacaggggtcctgggcccaatctgccctgactcagcctgcctccgtgtctgggtctcctggacagtcgatcaccatttccngcaccggaaccaatagtgacgttggtcgttataactttgctcctggtacaacagcaccaggcaaacgcccccaatcctgatttatgaggtcactattcgtcctcagatttctaatcgcttctctggttccaagtctggctaacacggcctcctgaccatctctggggtccaggctgaggacgagctgtattagttactgctagttcatatacaagcacttccatctcgtggtcgtcggcgtggaccagtctcgaccgtcaagtcagcccaaggcctcgcccccgtggtaccactctcgttcccctacccg

SEQ ID NO: 125376 - DNA, 568 bp, Homo sapiens
  misc_feature: GYAE6OF01DBTKD.12.85.H08.1.454.CMB.1.raw
  modified_base (425)..(425): a, c, t, g, unknown or other
  misc_feature (425)..(425): n is a, c, g, or t
tcagatacgacgtacacgaccggtgctcgatttagtatcactcagtcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaactcatgtattttgatgtcactaatcggaccctcgagggtttctgatcgcttctctgctcaagtctcgactacgacggtccctcctgaccatctcgtcggctccgagctgagacgaggctgattattatgcagctanataatacaagcagcagcctacccttacgttttcgtaccgttacgggaacgtacggggtaacctaacggttcccgtaacccggttcccgtaaccggtcctaacgggacccccaagggacccccaaacccccgtacgttacccgg

SEQ ID NO: 125377 - DNA, 711 bp, Homo sapiens
  misc_feature: GYAE6OF01BNMX1.12.85.H08.1.454.CMB.1.raw
  modified_base (212)..(212): a, c, t, g, unknown or other
  misc_feature (212)..(212): n is a, c, g, or t
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngccaccggaaccaatgtgacgttgtcgttataactttgtctcctggtacaaacngcaccaggacaacgcccccaatcctgtatttangagtacacttattcggtcctcgaaggtaatttctaatccgtctttctcttcggttaccaagttctaggacaacgaccggtccctcccgtacgacctacttcgtacgtcggggtacccagggtcttagggacgggtaccggtaggtccgttaggtaactttacgttaaccgtggtacgttaaggtttacctaaatttaactaacgaacgtacccttaacctttaccctaacgttccgttaccgggttcgggtttcggttacccggggtacgggttaccgggaaccgtaacggtccgttacggtaccccgttaaccgttaacggtccgaaccggtaccccgtaaacgggtcccgttacccgacccccccgttgggtaccctaccgtttcccttacccggttccccctaaccccg

SEQ ID NO: 125378 - DNA, 540 bp, Homo sapiens
  misc_feature: GYAE6OF01EAACD.12.85.H08.1.454.CMB.1.raw
  modified_base (212)..(212): a, c, t, g, unknown or other
  misc_feature (212)..(212): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngccaccggaaccaatagtgacgttggtcgttataactttgtctcctggtacaaacngcacccaggcaaacgcccccaatcctgatttangaggtcactagttcggtcctcaggtaatttctaatcgtcttctctgttcaagtctggcaacncgcctcctgacatctcgtgggtccaggctggacggacgaggcttagattagttactgactagttcatatacaagtcacttcactctcggtggtgttcggcggtaggaccagtcgtacgaccgtactacgtcacgacccaagcctccgcccccgtgtccactcctccgtcccctaccc

SEQ ID NO: 125379 - DNA, 503 bp, Homo sapiens
  misc_feature: GYAE6OF01ETD1A.12.85.H08.1.454.CMB.1.raw
  modified_base (319)..(319): a, c, t, g, unknown or other
  misc_feature (319)..(319): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgtattatgaggtcactattcggtcctnaggtaatttctaatcgcttctctggttccaagtctggcaacaccggcctccctgaccatctcgtggggtccaggctgaggacgaggctagattattactgctagttcaatatacaagcactcacttctcgtgtgtcggcggtgaccagctgacctctagcacgccaaggctcgcccctgctacg

SEQ ID NO: 125380 - DNA, 511 bp, Homo sapiens
  misc_feature: GYAE6OF01CU2ST.12.85.H08.1.454.CMB.1.raw
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaacgccccccaaatccctgatttatgaggtcactattcggtcctcaggtaatttcaatcgcttctctgttccaagtctggcaacacggcctcctgaccatctcgtgggtccaggctgaggacgaggctgattattactgcagttcatatacaagcacttcactctcgtgtgttcggcggtggacaagctgaccgtctagtcagccagctcgcccctggcactctgtccctaccc

SEQ ID NO: 125381 - DNA, 574 bp, Homo sapiens
  misc_feature: GYAE6OF01AXHBL.12.85.H08.1.454.CMB.1.raw
  modified_base (301)..(301): a, c, t, g, unknown or other
  misc_feature (301)..(301): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttgtcgttataactttgtctcctggtacaaacagcacccaggcaaacgccccccaactcctgatttangaggtcactattcggtcctcaggtaatttctaatcgtcttctctggttccaagtctgacaacacggtcctccctgacctatctcgtcgggtccaggctggacggacgaggctagtattattactgctagttcatatacaagcctacttccacttctcggtaggttcgttccggcgggtcggacctaaggtctacgacccgtaccgtaagtccgagcccaaggtcctacccggccccccgttggtaccaccgttcctccggttccccgtccccg

SEQ ID NO: 125382 - DNA, 566 bp, Homo sapiens
  misc_feature: GYAE6OF01C2969.12.85.H08.1.454.CMB.1.raw
  modified_base (382)..(382): a, c, t, g, unknown or other
  misc_feature (382)..(382): n is a, c, g, or t
tcagatacgacgtacacgaccggtgctcgatttagtatcactcagtcgcgggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatcctcctgcactgcaaccagcagtgacgttaatgattaataactatttctcctggtaccagcaacacccaggcaaacgccccaaactcctcactttatggtgtcgggaatcggccctcaggggtttctaatcgcttctctggctccaagtctggcaaaacggcctccctgaccatcncttggactccagcctgagacgaggcgatactactgcattgctacacgacaaggactccgtaacgttgggtacggttcgggtcgggacggaccgaaaccgtgaacccgttaccgtaggtccagcccgaaacggtctcggccccctcggtccacgtcttcgttccccaccctcccgtcttacccgg

SEQ ID NO: 125383 - DNA, 527 bp, Homo sapiens
  misc_feature: GYAE6OF01DUU7E.12.85.H08.1.454.CMB.1.raw
  modified_base (210)..(210): a, c, t, g, unknown or other
  misc_feature (210)..(210): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctcgtgtctgggtctcctggacagtcgatcaccatttccngcaccggaaccaatagtgacgttggtcgttataactttgctcctggtacaaacngcacccaggcaaagccccccaatcctgatttangaggtcactattcggtctcaggaatttctaatcgacttctctggttccaagtctggcaacacggcctccctgacccatctcgtggggtccaggctgaggacgaggctgtattatactgctagttcaatatacaagctacttccaactctagtggtgttcggcggttgggaccaagcctgaccgtctaagtcagcccaaggcctgcccccgtggtcactctgttcccaccc

SEQ ID NO: 125384 - DNA, 535 bp, Homo sapiens
  misc_feature: GYAE6OF01BCKMU.12.85.H08.1.454.CMB.1.raw
  modified_base (214)..(214): a, c, t, g, unknown or other
  misc_feature (214)..(214): n is a, c, g, or t
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (417)..(417): a, c, t, g, unknown or other
  misc_feature (417)..(417): n is a, c, g, or t
  modified_base (471)..(471): a, c, t, g, unknown or other
  misc_feature (471)..(471): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggacagtcgatcaccattttccngcaccggaaccaatagtgacgttggtacgttataacttttgctctaggtaacaaacngcaccaggacaaacgcccccaactcctgatttangagtcacttattcggtcctacgaggtaattttctaatcgtactttctcttggttaccaagttctaggcaacaccggcctccctgaccatctcgtcgggccaggctgagacgngctgattatactgctagttcagtatacaagctacttcactctcgtggtgtcggnggtagacgagctcgaccgtctagtcagccaagcctcgccctcgcactcgtccgtcccctacccc

SEQ ID NO: 125385 - DNA, 540 bp, Homo sapiens
  misc_feature: GYAE6OF01BX8SY.12.85.H08.1.454.CMB.1.raw
  modified_base (265)..(265): a, c, t, g, unknown or other
  misc_feature (265)..(265): n is a, c, g, or t
  modified_base (363)..(363): a, c, t, g, unknown or other
  misc_feature (363)..(363): n is a, c, g, or t
  modified_base (441)..(441): a, c, t, g, unknown or other
  misc_feature (441)..(441): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgctcctggtacaaacngcacccaggcaaacgccccccaactcctgatttatgaggtcactatttcggtcctcaggtaatttctaatcgcttctctggttccaagtctggcaacncggccctccctgaccatcctcgtggggtcccagggcctgacggacggaggtctaggatttattactgctagttcatanacaagccacttccacttctcggtgtcgttcggcggtggaccagctgacctctagtcagcccaggctccgccccgtcgtccacttctccgttccctaccc

SEQ ID NO: 125386 - DNA, 520 bp, Homo sapiens
  misc_feature: GYAE6OF01EFNVI.12.85.H08.1.454.CMB.1.raw
  modified_base (211)..(211): a, c, t, g, unknown or other
  misc_feature (211)..(211): n is a, c, g, or t
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (517)..(517): a, c, t, g, unknown or other
  misc_feature (517)..(517): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngcaccggaaccaatagtgacgttggtcgttataactttgtctcctggtacaaacngcaccaggcaaacgccccccaatcctgatttangagtcactattcggtcctcaggtatttctaatcgcttctctggttccaagtctggcaacncggcctcctgaccatctctggggtccaggctgaggacgagctgattattactgctagttcatatacaagctacttccactctcgtggttgttcggcggtggaccaagctgaccgtctaagtccagcccaggcctcgcccctgtcacttctcgttcccnccc

SEQ ID NO: 125387 - DNA, 544 bp, Homo sapiens
  misc_feature: GYAE6OF01AWTQK.12.85.H08.1.454.CMB.1.raw
  modified_base (356)..(356): a, c, t, g, unknown or other
  misc_feature (356)..(356): n is a, c, g, or t
  modified_base (419)..(419): a, c, t, g, unknown or other
  misc_feature (419)..(419): n is a, c, g, or t
  modified_base (529)..(529): a, c, t, g, unknown or other
  misc_feature (529)..(529): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctctggtacaacagcaccaggcaaacgcccccaactcctgatttatgaggtcactattcggtctcagtatttctaatcgctttctctggtccaagtctggcaacncggcctcctgaccatcctcgtcggggtcccagggctaggacggacgaggctgtattattaccngctagttcatactacaagtcacttccactctcggtaggttcgttcggcggttagggaccaaggtctagaccgtctaagtcagcccaaggcctacggcccctggtactacncttcgtccccacccg

SEQ ID NO: 125388 - DNA, 765 bp, Homo sapiens
  misc_feature: GYAE6OF01DHF5R.12.85.H08.1.454.CMB.1.raw
  modified_base (220)..(220): a, c, t, g, unknown or other
  misc_feature (220)..(220): n is a, c, g, or t
tcagatacgacgtacacgaccggtgctcgatttagtatcactcagtcggtcggggggggtctcgaggacggcagcgctcctcaggtacgcctccaccatggcctggctctgctgctcctcactctcctcactcaggacactagggttccctgggcccagtctgccctagactcagcctgcctcgtgtcgtgggtctccgtggacgagtccgatccaccgngtcctcctgccacgtcgggaccagcaggttgagttggttcggtaacttaagttaaccttgtcctaccgtacgtaaccaacctaacgacccgaacggaaccaaaaccgaccccccgtaaaagtcgtaacttggtaagttttaggacggaacggtactaaacggtaacgtccggtacccgttaggtacgggttttacttaacgttcgtaccgtttcgtcggtcggtaccgttaccggtaacgtacgttacggacccaaaccgtccggtccctaacccgtagacctaaacttccgtaaccggtacggtcccgtacgtaggtaccgtagggaacggaacggtaggaccgttaagttaacgtttaacgtcgactaacggtcctaacttaacgtaacaaacgtaacgacgtagtaaccgtagttaccgtacccgtttggttaccgttaacgggttacgggaaacgtcggggtaacctaagggttcctacccgtaccgttaacgtccgacggtaccccggaacggacccctaaacccgtcgtccggtaaccc

SEQ ID NO: 125389 - DNA, 629 bp, Homo sapiens
  misc_feature: GYAE6OF01EN3RQ.12.85.H08.1.454.CMB.1.raw
  modified_base (387)..(387): a, c, t, g, unknown or other
  misc_feature (387)..(387): n is a, c, g, or t
  modified_base (615)..(615): a, c, t, g, unknown or other
  misc_feature (615)..(615): n is a, c, g, or t
  modified_base (619)..(619): a, c, t, g, unknown or other
  misc_feature (619)..(619): n is a, c, g, or t
  modified_base (624)..(629): a, c, t, g, unknown or other
  misc_feature (624)..(629): n is a, c, g, or t
tcagatacgacgtacacgaccggtgctcgattttagtatcactcagtcgcggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaaagaaaacactgtatctgcaattaaccagcctgagagtcgaggacacggccctttattactgtgcgaaggatcgcccctataatggtggctggagtcggggtagttttggttccgtggggccgacgggaaccctggtccaccgtcttccctcncgcctcccaccgaacggcccacgtccggtcctcccccgtggcccacccctcctcccaacgacgccacccgtcgtcgggggaccaccgacggcccggccccgtggggccgtcggccccgtggttacccgaagggtacccttaccgtttacccgtacggttccgtaacgttccgttaggacggtccggggccgttgggaccgtaaacggggcccgacgtaacgttaggcngcgngcgcnnnnnn

SEQ ID NO: 125390 - DNA, 687 bp, Homo sapiens
  misc_feature: GYAE6OF01B3WAZ.12.85.H08.1.454.CMB.1.raw
  modified_base (214)..(214): a, c, t, g, unknown or other
  misc_feature (214)..(214): n is a, c, g, or t
  modified_base (267)..(267): a, c, t, g, unknown or other
  misc_feature (267)..(267): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctattttccngccaccggaaccaatagtgacgttggtcgttatactttgctcctggtacaacngcaccaggacaacgcccccaactcctgatttangagtcactatcggtcctnagtatttctaatcgtcttctctggttacaagtctggacaacacggccctcctgaccatcgtcgtcgggtccaggctggacggacgacggtcgttagtaactttacgttactggactaggtttacaagttaactaaccgaagtaccctacctttaccctaacgttccgttccgggttgggttacggtttcccggggtacgggttaccggggaacctaacgggtcccttaacgggtacccccgttaaccgttaaacggtcccgtaaccggtacccccggtaaacggggtcccttaccccgggccccccccgttacggggttaccccttaacccgtttcccgttccccgggtttccccccgttacccccccg

SEQ ID NO: 125391 - DNA, 733 bp, Homo sapiens
  misc_feature: GYAE6OF01BLJD9.12.85.H08.1.454.CMB.1.raw
  modified_base (216)..(216): a, c, t, g, unknown or other
  misc_feature (216)..(216): n is a, c, g, or t
  modified_base (279)..(279): a, c, t, g, unknown or other
  misc_feature (279)..(279): n is a, c, g, or t
  modified_base (315)..(315): a, c, t, g, unknown or other
  misc_feature (315)..(315): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggacagtcgatccacctattttccngccaaccggaaccaatagtcgtacgttggtacgtttattaactttgtcctcgtgtaacaaacngccaccaggacaaacgcccccaactcctgtatttangagtcacttagttccggtcctacgaagtaatttctaactcgtcttctcgttcggttaccaagttcgtgaccaaccgtaccggtccctcccgtacgacctatccgttaccggttcggggtaccctagggtctacgggacgggaacggaggtcttagtaatttacttaacgtcggtactagttaccaagttaactaacaacgtccttaacccttacctaaccgttccgtttacgggtcggtttaccgggtttccgggtacgggtacggggtacctaacggtccggttaacccggtacccgttacggttaaaccggtccgtaaaccgggaccccgtaaacgggtcccgttccccggttacccccgttaccggttccctaacccgtttccccggttccccgttttacccccgtaaccccccg

SEQ ID NO: 125392 - DNA, 664 bp, Homo sapiens
  misc_feature: GYAE6OF01DDZQM.12.85.H08.1.454.CMB.1.raw
  modified_base (305)..(305): a, c, t, g, unknown or other
  misc_feature (305)..(305): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatctcctgcactggaccagcagtgatgttggacttataaccttgtctctagtaccaacaacacccaggacaaacgacccccaaactccatcgtatttagngtaggtctactacgttccgtctacagtaatttctaatcgtcttctctcgttccgaatcgtcggacaacgaccggtccctcccgtacgacctacttccgtacgtcggggtaccaggtctgggaacggacgaggtctacggtaatttacgttaccgtggtaccttaggtttacaagttaactaacgtaagtaccctacctttacccgtaacttccgttacggttcggttcgggttccgggtaccgggtcggaaacccgtaaggtccgttaccggtaaccccgttaccgttaaaggtaccccgacggtacccccgtaaagggtcccccgttacgtaccccccggttcgtcccgttaaccccg

SEQ ID NO: 125393 - DNA, 701 bp, Homo sapiens
  misc_feature: GYAE6OF01CJHUP.12.85.H08.1.454.CMB.1.raw
  modified_base (213)..(213): a, c, t, g, unknown or other
  misc_feature (213)..(213): n is a, c, g, or t
  modified_base (299)..(299): a, c, t, g, unknown or other
  misc_feature (299)..(299): n is a, c, g, or t
tcagatacgacgtacacgaccggtgctcgatttagtatcactcagtcgcggggggggtctcaggaggcagcgctctcaggacatctccaccgatggcctgggctctgctgctcctcaccctcctcactcagggcacagggtcctgggcccaatctgccctgactcagcctgcctccgtgtctgggtctccgtggacagtcgatcactatttcngcaccggaacaatagtgacgttggtcgttatactttgtctctagtacaacagacaccaggacaaccgaccccaactctagtattangagtctactatcgtctctagtatttctaatcgtcttctcgttcgtactaagtcgtaggaccaacgaccggccctacccgtacgtacctacgttccgtcggtcggggtccgacggtcgtagggaacggacggagggtacttagtaacgtttacttacgtgtactacgttactaaattactaacgtaacgtctaacctttacccgtaaccttccggttacgggtttcggggtttcgggttccggggtaccggggttacgggtaaccgtaaggtcccgttaacgggtacccggtaaccgttaacggtcccgaaccgtaccccggtaacgggtccccgttaccccggtcccccgttaccgggttcccgtaaccctttcccgttccccggttcccccgttacccccg

SEQ ID NO: 125394 - DNA, 539 bp, Homo sapiens
  misc_feature: GYAE6OF01CFPWF.12.85.H08.1.454.CMB.1.raw
  modified_base (212)..(212): a, c, t, g, unknown or other
  misc_feature (212)..(212): n is a, c, g, or t
  modified_base (270)..(270): a, c, t, g, unknown or other
  misc_feature (270)..(270): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngcaccggaacaatagtgacgtttggtcgtttaataacttttgtctcctggtaacaaanagcacccaggacaaacgcccccaactcctgtactttatgagtcacgtacttcggtcctcaaggaattttctaattcgctttctcttcggtaccaagtctgacaacgacgcctcctgaccatctcgtcggggtcaggcgtgaggacgagctagatttatactgctagttcaatatacaacgnaccttcatctcgnggtgtcggnggtcggacaagcgagccgtacagtcacgccaggctccgccccgtggccacttctcgttccctaccc

SEQ ID NO: 125395 - DNA, 641 bp, Homo sapiens
  misc_feature: GYAE6OF01AVWWB.12.85.H08.1.454.CMB.1.raw
  modified_base (263)..(263): a, c, t, g, unknown or other
  misc_feature (263)..(263): n is a, c, g, or t
  modified_base (405)..(405): a, c, t, g, unknown or other
  misc_feature (405)..(405): n is a, c, g, or t
  modified_base (580)..(580): a, c, t, g, unknown or other
  misc_feature (580)..(580): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttcctgcaccggaaccaatagtgacgttggtcttatactttgtctctggtacaacngcaccgaggcaaacgcccccaactccgattactagacggtactactacttcgtcgtcaggtacttacttaactcgtcttctctcgtccgtacgtctcgtacacacgtccgtcctacgtcactctcgtcgggtcgtacggtcncggtacggacgaggtctagtaagtttactacgttgactacgttactacgtaatacgaaccgtctaaccctttcctacttccttccggtacggtttcggttccgggtgggtacccgggtacgtaacgcttccgtacccgtccgttaaaggtcccgacggtaaccccacgggttacnccccgggttaccccttacggtaccgttacctccgggtcccttttaccccgccccgttcccg

SEQ ID NO: 125396 - DNA, 578 bp, Homo sapiens
  misc_feature: GYAE6OF01CWM25.12.85.H08.1.454.CMB.1.raw
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctcgtgtctgggtctccgtggacagtcgatccacctatttccngcaaccggaaccatagtgacgttgtcgttatactttgctctggtacaacngcaccaggacaaacgcccccaactcctgtatttagngtagtcactacttccggtctacaggtatttctaatcgtcttctctcgttcagtctggcaacgcgtcctccgtanacctatcgtcgtcgggtaccaggcgtggacggacgaggtctagtatttagttactgctagttacagtaatacaagcctactacctactcgtcggtgtcgttcggcggttacggacgagcgtcgaccgttactaacggtcacggaccaacggtccctcccggccccgttacggtcctaccttccgttcccgttccccgtaccccg

SEQ ID NO: 125397 - DNA, 651 bp, Homo sapiens
  misc_feature: GYAE6OF01DUHX9.12.85.H08.1.454.CMB.1.raw
  modified_base (213)..(213): a, c, t, g, unknown or other
  misc_feature (213)..(213): n is a, c, g, or t
  modified_base (303)..(303): a, c, t, g, unknown or other
  misc_feature (303)..(303): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngcaccggaacaatagtgacgttggtcttatactttgtctcctaggtacaaacagcaccaggacaaacgccccccaactcctagtatttangaggtcactgttccggtcctcaggtaattttctaattcgtctttctcttcggttaccaagtctggacaacgacggccctcctcgacctactcgtcgtcggggtaccagggtctaggaggacggacggtctaggtatttacttacgtgactagttcaagttaactacaagtcctaaccttccctacgttcctcgggttacggtttcgggttccgggtacgggtacgggaacccgtaaggtccgtacggtaacccgttacctaacggtcccgaagtaccccgaaggtccccgttccggcccccccgttagggtacccctacgttccccttccggttcccccctaaccccg

SEQ ID NO: 125398 - DNA, 606 bp, Homo sapiens
  misc_feature: GYAE6OF01BQOFP.12.85.H08.1.454.CMB.1.raw
  modified_base (213)..(213): a, c, t, g, unknown or other
  misc_feature (213)..(213): n is a, c, g, or t
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngccaaccggaaccaatagtgacgttggtcgttataactttgtctcctggtaacaaacagcacccaggcaaacgccccccaatcctgatttangaggtcacttatcggtctcaggtaatttcaatcgcttctctggtcagtctggcaacncgcctccngaccatctcgtcgggtccaggtctggacggcgaggctgtattattcgngcagcctanatagtcgcgaggcaacgactaacgttggtttttcgtaccgtttacggaacgttcgggaacccctagggttacccaccccggttaccgtagggtcccaccggacccccggaaacggtcccccaaaaccccgtcgttaccgacccttaaccgttcccgttacccggtttcccccgtccccc

SEQ ID NO: 125399 - DNA, 549 bp, Homo sapiens
  misc_feature: GYAE6OF01A10G8.12.85.H08.1.454.CMB.1.raw
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccaatctgccctgactcagcctgcctccgtgtctgggtctcctggacagtcgatcacctatttcctgccaccggaaccaatagtgacgttggtcttataactttgtctctggtacaacngcaccaggcaacgcccccactcctnattangagtcactattcggtctcaggtatttctaatcgtcttctcgtggttccaagtctggcaacncggtcctcctgaccattccgtcgtggggtccagggctggaggacgaggctagtatttatactgctagttcataatacaagtctaccttcacttcgtcggtggtggttcggcgggtggaccagctacgaccgttactaagtcacgacccgaggcctcgcccccgttggtccacttcgtccgttccctacccc

SEQ ID NO: 125400 - DNA, 560 bp, Homo sapiens
  misc_feature: GYAE6OF01EX7FW.12.85.H08.1.454.CMB.1.raw
  modified_base (301)..(301): a, c, t, g, unknown or other
  misc_feature (301)..(301): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
tcagatacgacgtacacgaccggtgctcgatttagtatcactcagtcggcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttcctgccaccggaaccaatagtgacgttggtcgttataactttgtctctgtacaacagcaccagacaaacgcccccaactcctgtatttangaggtcactattcggtcctcgagtatttctatctcttctctgtcagtcngcacgcgcctccnaccatctcgtgggtccaggctgaggcgagtctagtattatactgctagttcatatacaagcctacttccacttcgtcggtggttcggttccgggcgggtacgggaccctagccgtacggaccgttaccgtaagtccacggcccgtaaggccctcccgtcccccgtcggtcctaccgttcctccgtcccccgtacccc

SEQ ID NO: 125401 - DNA, 645 bp, Homo sapiens
  misc_feature: GYAE6OF01BFCVH.12.85.H08.1.454.CMB.1.raw
  modified_base (215)..(215): a, c, t, g, unknown or other
  misc_feature (215)..(215): n is a, c, g, or t
  modified_base (428)..(428): a, c, t, g, unknown or other
  misc_feature (428)..(428): n is a, c, g, or t
tcagatacgacgtacacgaccggtgctcgatttagtatcactcagtcggcgggggggtctcaggaggcagcgctcgtcgggacgtctccaccatggcctgggctctgctattcctcaccctcctcactcagggcacagggtcctagggcctagtctgcccgactcagcctgcctcgtgtctgggtctccgtgggacagtcgactcacctattccngcaccggaaccaatgtgacgttgtcgttatactttgctcctgtacaacagacaccaggcaacgcccccaactcctgactttatcgtaggtcactacttccggtcctcgacggtactttcgtaatccgtactttctcgttcggttaccaagtctcggacaacgtacggtcctcctgacctactctcgtcggggtaccaggtctaggacggacgnggtactaggtacttacgttactagtactacgtttactattactacgaacgtacctacctacctactacttacggttcggttcggtttaccgggtcgggtcgggtaaccgaacgtcgtacggtaccgtacgtaacgtacgtacggtcccgtaaggtcctaccgccccgtcgtacctactccgttccgttccccgtacccttcccttccgtccgttccg

SEQ ID NO: 125402 - DNA, 600 bp, Homo sapiens
  misc_feature: GYAE6OF01EK4OL.12.85.H08.1.454.CMB.1.raw
  modified_base (211)..(211): a, c, t, g, unknown or other
  misc_feature (211)..(211): n is a, c, g, or t
  modified_base (431)..(431): a, c, t, g, unknown or other
  misc_feature (431)..(431): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcactatttccngccaccggaaccatagtgacgttggtcttatactttgctctgtacaacagcaccagcaaacgccccccaatcctagtatttagtgacggttcacttagttccggtacctcgtaaggtaatttctaatccgtcttctctcggttaccaagtctggacaacgcgcctcctgaccatcgtcgtcgggtccaggctggacggacgaggtcttagtattattacngtactagttcaattacgaacacgtcctacttccacttcgtcggtggttcggttccgggacggtacgggaccaagcctacggtacccgtacctaaggtccacggacccgaaggttcccgtcccgtacccccgtcggttaccctaccgttccgttcccgtcccccgtcccc

SEQ ID NO: 125403 - DNA, 735 bp, Homo sapiens
  misc_feature: GYAE6OF01DQFZN.12.85.H08.1.454.CMB.1.raw
  modified_base (232)..(232): a, c, t, g, unknown or other
  misc_feature (232)..(232): n is a, c, g, or t
  modified_base (541)..(541): a, c, t, g, unknown or other
  misc_feature (541)..(541): n is a, c, g, or t
  modified_base (723)..(723): a, c, t, g, unknown or other
  misc_feature (723)..(723): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcacgtaagggcacgagggtcctgggacccaatctcgccctgactcacgcctcgccctcgtgttccgtgggtcctccgtaggactacgtcgactccaccttactttccgngacccgaaccggaacctagtacgtcggtacggtttggttactttaattacgttttgtccttcgtacggtaaacaaccgacgtacccaaccgaacggacccaaacccgtcccccctaactccgtacgtattttacgaggtacgtacctaacttcgttcgaccttagtagttacttactatccttacttctcgttacgtacctaagtccgtacgaccaaccgtccgtaccctccgtacgactacgtccgtcggtaccgggactacggtcgaacggcgggaaggccgttattacgttaactttacgtaccgngtaccgtattactaattacacgtacctccgtaactacctacgttcgtcgggttcggttacgggttcccgggacgttacgggacctacggtacccgttcggtacctaccgtaagtacccgaccgtaccggtacgtccctcccggtaccccgtcgtaccctctccccgttaccccgttaccccncccgttaaccgg

SEQ ID NO: 125404 - DNA, 665 bp, Homo sapiens
  misc_feature: GYAE6OF01C297B.12.85.H08.1.454.CMB.1.raw
tcagatacgacgtacacgaccggtgctcgatttagtatcactcagtcgcgggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtcgacgttaatgataataactatttctcctggtacagcaacaccaggcaaacgccccaaactcctcatttatggtgtcggaacttcggccctcgtacggggtttctaatcgctttctctcggctacccgaagttcgtacggacgtaaaaaccggcccttccctcgaccctaagtccttcgtcggacttcccgaacgtcccttgaagggaccgaagggccccgtaatttaaccttaactcggaccagtttcgacacgtagaaccgaagggacgttaccccgtaacgttgggttacgggtttcggacgggtagggaaacccctaaagtccggacccggtaccgttacggtccaacggccccgaaagggccttccgccccccgttaccggtcctaacccgttcgttaccgttcccctaccccgtccttccgtttaacccgg

SEQ ID NO: 125405 - DNA, 846 bp, Homo sapiens
  misc_feature: GYAE6OF01A8X5C.12.85.H08.1.454.CMB.1.raw
tcagatacgacgtacacgaccggtgctcgatttagtatcactcagtcgcggggggggtctcaggaggcagcgctctcaggacatctccaccatggcctgggctctgctgctcctcaccctccctcactcgacggcacggtacggtcgtcggaccattcgccgcctagctacgcgcctcgtccgtcgttcgtcgtcggtcctcggtagacgtacggtcactaccactttacttccgtacgaccgaaccgaactaagttacggtacgttacggtttacggttactttaactttacgtttcgttacctccgttaggtaaaaccaacgaccgacccgaaccggaccggtaaccgaaaccccgaaccccccgtactttacccgagtttaacttttacggacggttacggttacctaacgtttacggtttcccggttaccgtaggtaaacgtttaacttttacgtacgttccgtttcctttccttacgggtttccgttaactacggttgtacggaaccaaccggtccgtacccctccgtaacgcctacgttccgttacgggtaccgggtacgtaacggtcgttagggaaccgggtacggtacggttctaaggtttacctttaacgggtactcgtacgttacgtttacagttttaacaacgtacctaccttcccttaaccgcgtttacggttacgggttcggttaccggggtttccggacgggggttacaacgtaccgttcggaacccggttacccgttaaccggttaccgcggtaaaccgtaccggaacggttccgtacccccggttcccgggtatacccgtctttacccggttcccggtccccttaccccg

SEQ ID NO: 125406 - DNA, 773 bp, Homo sapiens
  misc_feature: GYAE6OF01CMSWB.12.85.H08.1.454.CMB.1.raw
  modified_base (250)..(250): a, c, t, g, unknown or other
  misc_feature (250)..(250): n is a, c, g, or t
  modified_base (655)..(655): a, c, t, g, unknown or other
  misc_feature (655)..(655): n is a, c, g, or t
  modified_base (748)..(748): a, c, t, g, unknown or other
  misc_feature (748)..(748): n is a, c, g, or t
tcagatacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcgtcgtcgtttcgtaggtggtactttttaaaaggtgcctagtgtgaggtgcagtgttggagtcgtggggagcgttggtacgagggcccggggggtccctagngaccttctccgtgtcgacctgccttcgtaggtactttactaaactttttaacaggttccgtttgaacccgttaggttcgggccgttcggggtccctaccggacggttccgtaccggagggggtaacgggcgtgggtagtcgggtttacacggtaatttaagttaacgtaggggtaaaaggggtactaaataaccgtacaagttaactagtggaaccgtcgttacggtagggtaacggggtcccgtaacgtaacctcggttcccacgtaacgagtaaccctaaataacccgaaagaaaccttcgtactaactcttacggaactaaaacgttaaccccagggtaccctggaagttaccggagggaactaacccggtaccgttaccttttaagtcgtccggttaaggngaaaccgtctcccccgaacttaaacgtggtacgggtactcgggtttacggaccgggttcgggtttagtttcggggtccgtccgggggttaacncccggggttaaacgtcggtaccccg

SEQ ID NO: 125407 - DNA, 946 bp, Homo sapiens
  misc_feature: GYAE6OF01BM8OC.12.85.H08.1.454.CMB.1.raw
  modified_base (220)..(220): a, c, t, g, unknown or other
  misc_feature (220)..(220): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccaatctcgccctgactcagcctgccctccgtgtcgtgggtcctccgtggacagtcgatccacctatttccngccaaccggaaccaagtagtcgtacggttggttacttacttaacttttgtccttaccgttaggttaaccaaacgacgtaccgaacccgacggaaccgaaaacccggaccccccctaaaccttcccttacgtaatttttaacgtacggtaacggttaccctaacgtttaaccgtttccggttacccttacgtaaacgggttaaactttttaccgtaaacttccgttacctttaccgtttaccggtttaccggggtttacccgtaaccggtttacgtacgggtaacccgaaaccgtaccccgggttaccccttaccccgtacggaccccttaaaccttccggttacccgggttaccgggggttacccgtaccgggtacggtacgggtaaacggggaccgggtaacgggtccgtttagttaacgtttaacgtttaacgtaccgtacgttacggtttaactaacgttaactaacgtaacgtaccttaaccggttaccctaacctttccggtttacgggttcgggtttcggggttaccggggtacccgggggttaacgggtaacccgtaaccgggtaccgttaccgggttaaccccgttaacccggttaacggtaccgttaaccccgggaaccccggtaacggggtaccccgttccccggttaccccccgttaccgggttaccccttaacccggttcccgttaaccccgggtttccccccgttccccccgg

SEQ ID NO: 125408 - DNA, 819 bp, Homo sapiens
  misc_feature: GYAE6OF01EFAMA.12.85.H08.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
tcagatacgacgtacacgaccggtgctcgatttagtatcactcagtcggcggggggggtctcaggaggcagcgctctcaggacatctccaccatggcctgggctctgctgcctcctcaccctcctcactcgagggcacgacgggtcctgggcccaatctcgccctgactcacgcctcgcctcgtgtcgtcggtcctccgtggacngtcgactcactntttccngaccaaccggaactaagtagtcgtacgttggttacgttattaacttcgtcctcgtaggtaaccaaacgccgaccaaccgacgaaccaaacccgacccccctaactccgtaagttacttagtacggtacgttactaaccgttcgtttacccgggtcctaaccgtaaggtttaactttacgtaacgttccgttcctttcgttaccgttcggttaacctaaggttccgtacggacctaaaccggtcccgtacccttcccgactaaccgtccgttcggttccgggttcccggggtccgtacggttacgggaacgggtacccggtaggtcgtttaacgttacgtttaacgttacggttacgtaaccgtttacgtttaacctaaagttaaccgtaaccgtaaccttacccttaccccgtttacctaccggttccggtttaccggggttggtttcccgggttacgggggtaccgggtaacggtaaccctacgggtccgtaaccggtaccgttaccgtaaccgaccggtaaccgaccgtaccggtccgaccccggtcccgtaccgtcgttacccttcccgttaccctccccgtacccgttccgg

SEQ ID NO: 125409 - DNA, 791 bp, Homo sapiens
  misc_feature: GYAE6OF01D14GD.12.85.H08.1.454.CMB.1.raw
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctcgggccaatctcgccctgactcacgcctgcctccgtgtcgtgggtcctcgtggacagtcgatcacctatttccngaccaaccggaactaagtcgtagtacgtttggtacttaataactntcgtctctacggtaccacgcgacaccgagcacgaccgaccccaatctagttcgttattttagacttcgtactaacttacgtccggtccgttacgggttacgggtttctacgtacgttcggtttccttccgttcgtacggtaccttaccgtaagttccgtaacggtacctaaccggtccgtccccttacccggcttaaaccctcttaccgttccggtaccgggtacccttaccgggcggtaccggttaggggaaaccgggtacgggttacgggtacgttacggtttaactttttaagtccgttacggtacacgttccgttaacgtaactaaccgtaaccgaacgtccggtaacgacccgttaactccccgtttacctttacggttttccggaaccggtttagggggtaacccggtacggggttaaaccccgtacgggtttacccttaaccccggttacccggttaaaccggacccggtaacccggaaccccgtaaaccccggaaccccttaccccgttaagttccccgg

SEQ ID NO: 125410 - DNA, 524 bp, Homo sapiens
  misc_feature: GYAE6OF01CCH6N.12.85.H08.1.454.CMB.1.raw
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtcgtgggtctcctggacagtcgatccacctatttcctgacacccggaaacaatagtgacgttggtcgtttatactttgctcctggtacaaacagcacccaggaccaaacgcccccaatcctgatttangngtcactatcgtctcagtatttctaatcgtcttctctcggtcaagtctggacaacncggtcctcctgaccatctcgtcgggcaggctgaggcgagctgtatattacngctagtcatanacagctactcnctctcggtgtcgtcggnggtacggacagctcgaccgtctaagtcagccctaggcctccggcccctcgccactccttcgtcccctaccc

SEQ ID NO: 125411 - DNA, 601 bp, Homo sapiens
  misc_feature: GYAE6OF01ELTDK.12.85.H08.1.454.CMB.1.raw
  modified_base (218)..(218): a, c, t, g, unknown or other
  misc_feature (218)..(218): n is a, c, g, or t
  modified_base (469)..(469): a, c, t, g, unknown or other
  misc_feature (469)..(469): n is a, c, g, or t
tcagatacgacgtacacgaccggtgctcgattttagtatcactcagtcgcgggggggggtctcaggaggcagcgctctcaggacatctccaccatggcctgggctctgctgctcctcaccctcctcactcagggcacgagggtcctgggcccaatctgccctgactcagcctgcctccgtgtctgggtctccgtggacagtcgatccacctatttccngccaaccggaaccaatagtgtacgtttggtacgtttattaacttttgtcctccgtcggtaaccaacaacacccaggaccaaacgacccccaaactcatgtatttataggaggcaacgtaagccggtacctcgtagggtttcttagtcgtcttcgtcgtggctcgtagtctggacaacgcgtccctcctgacacttctcgtcgggctccgaggctaggaggacgaggcgtattacttacgtggttcgacttnagttagtcggtacggtagtacgtctaactttcggatcgttccttacggttcggacggacggacagcgtacgaccgtcgtcgtacgacgccgacgtcgtaccgtccccgtcgtacctcttcgtccgttccccg

SEQ ID NO: 125412 - DNA, 549 bp, Homo sapiens
  misc_feature: GYAE6OF01E0EKV.12.85.H08.1.454.CMB.1.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctcgtgtctgggtctcctggacagtcgatcaccatttcctgccaaccggaaccaatgtgacgttggtcttataactttgtctctggtacaacagcaccaggacaaacgcccccaactcctagatttangagtcactattcggtcctnaggtaatttctaatcgtcttctctgtccagtctggcacncgcctccnaccatctcgtgggtccaggctggagacgagtctgtattatntgcgtagttactatactacagtactccttctattccgtcggttggtggttcggcggtacgggacctaaggctcgtaccgtacgttacgcgacgcccgaggccctccgccccccgttcgcctacctccgttccgtccccgtccc

SEQ ID NO: 125413 - DNA, 654 bp, Homo sapiens
  misc_feature: GYAE6OF01CF1CP.12.85.H08.1.454.CMB.1.raw
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
  modified_base (309)..(309): a, c, t, g, unknown or other
  misc_feature (309)..(309): n is a, c, g, or t
  modified_base (604)..(604): a, c, t, g, unknown or other
  misc_feature (604)..(604): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgtctccgtgtctgggtctccgtggacngtcgatcacctatttccngccaccggaaccagtagtgtacgttggtcgttaatactttgtctctggtacaaacngacaccaggaccaaacgccccccaactcctagatttangagtcactattccggtcctagagtaatttctaatcgtcttctcgttcggttaccagttctggaccaaccgtaccggtccctaccgtacgacctacttccgtccggtcgggtaccagggtcgtagggaacggtacggaggtccttagtaagtttacgttacgtgacttacggttacaagtaactaaccgaatcctaaccttacgtaccgttccgttgggtcgggttcggttcgggacgggtacggaacctaggctcggtacccgttactaacggtccaaccgaccggacggtcccncccgttcccccgtcggtacctaccgtcccttcccgtccccgttacccccg

SEQ ID NO: 125414 - DNA, 727 bp, Homo sapiens
  misc_feature: GYAE6OF01AGWOG.12.85.H08.1.454.CMB.1.raw
  modified_base (269)..(269): a, c, t, g, unknown or other
  misc_feature (269)..(269): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggacagtcgatccacctatttcctgaccaccggaacaatagtgtacgttggtcttatactttgtctcgtagtacaacngccaccgagaccaaaccgccccccaactcctagtactttagtacgtacggtctacgttacgttccggttccctacgtaaggttaactttacgtaacttccgttcctttacgtccgtttcggttacctaaggttccgtacggacctaaccgaccgggtaccccttcccgttaccggtaccctacgttcccgtccggttacggggtaccacgggtccgttacgggacgggacggtaggtccgttagtaagtttacgttacgttacgacttaagttacctagttaacgtaccgaacgtaccttaccttacctacgttaccgttcgggttcgggttacggttccgggtcggtaccggacgtacggtccgtacgtacccgtacgtaaccggtcgaccggacccgtaacggcccgtaccccgtccccgtacgtaccctcctccgttcccgttccccgtaccccg

SEQ ID NO: 125415 - DNA, 884 bp, Homo sapiens
  misc_feature: GYAE6OF01BRLGT.12.85.H08.1.454.CMB.1.raw
  modified_base (217)..(217): a, c, t, g, unknown or other
  misc_feature (217)..(217): n is a, c, g, or t
tcagatacgacgtacacgaccggtgctcgatttagtatcactcagtcgcggggggggtctcaggaggcagcgctctcaggacatctccaccatggcctgggctctgctgctcctcaccctctcactcagggcacgagggtcctgggcccaatctgccctgactcagcctgcctcgtgtcgtcgggtctccgtggacagtcgatccacctattttccngaccaacggaaccaatagtcgtacgttggttacgttattaacttgtctccgtaggtaaccaaacgagtaccaacccgtaggaaccaaaacccggaccccccctaaacgttccccgtagtacttttagtacgtacggtactactacgtttccggtaccttacgaaggttactttacgtaacgttccgttactttccgttccgtttaccggttacctaaacgtttccggtacggtaacccgaaaccgtacccgggtccccttacccgaccggtaacccttacttccggttccggttacgggggtacccgtaacggggccgttacgggtaacgggtaaccggacgggttacgtaacgttacgtttaaacgtttcgttcggaacctttacgtttaacgtattaaacgtaacgaaacttccctacctttacctaccgttaccggttagggtttccgggtttacggttacccggggttacggggtaccgggtaacccggtaacgttacccgggtacccggttaaaccccggttacccggttaaacggtcccgtaaacccgggtaccccggtaaacgggttcccccgttaaccccccggttcccccggttacggttaacccctttaccccgtttaaccccggtttccccggttaacccccccgtttacccccgg

SEQ ID NO: 125416 - DNA, 778 bp, Homo sapiens
  misc_feature: GYAE6OF01CRSJA.12.85.H08.1.454.CMB.1.raw
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctgccctgactcagcctgcctccgtgtctgggtcctccgtggacagtcgatccaccgttctcctgccacgtcgggaccagtatgtagttttagaatttgactagtctctagtaccaacaactaccccggacaaacgtcccctaaagttaactctaatttagtaggagggaccaacgtaacggcccgtaccctcgaaggtattttcgagtactccgtaccttcgtcgtgtccgtacgaacgggtccgtcgggacccggaccgggtccctacccgtacgaactaaacgtacgttccgtcgggtacccttccggacgggtaccgtagggaaccgggtaaccggtacgggtaccctacgttaacttaaccgttatcggtccttagtccttacgtaagttacggttagggttaaagtttactaacgggttcgtttaccgggttttagggggttccgggttaccggggtacccgggaaccggggtaaccgtaaaccgggtttcggaaaccccggtttccgttaaacggcccggtaaccggaccccggtaaacgggtccccgtccccgggtaccccccgttcggttccctacccctttcccgttaccccgttcccccctccggtttccccgg

SEQ ID NO: 125417 - DNA, 777 bp, Homo sapiens
  misc_feature: GYAE6OF01A7JPO.12.85.H08.1.454.CMB.1.raw
  modified_base (217)..(217): a, c, t, g, unknown or other
  misc_feature (217)..(217): n is a, c, g, or t
  modified_base (279)..(279): a, c, t, g, unknown or other
  misc_feature (279)..(279): n is a, c, g, or t
  modified_base (317)..(317): a, c, t, g, unknown or other
  misc_feature (317)..(317): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtcctccgtggacaggtcgatcacctatttccgngccaaccggaaccagtaggtcgtacgtttggtacgttataactttgtctcctggtacaaacngccacccaggccaaacgccccccaatcctagtatttangagtcactattcggtacctgaggtatttctaatcgactttctcttggttaccaagttcgtggaccaacgtccggcccttcccgtacgaccctacttccgtacggtcgggggtaccagggcttacgggaacgggtcgaggtccgttagtacgtttaacttacgtcgtcctaaggtttacaacgttaacttaacgaacggtccctaacccgtttaccgtaaccgtttaccggttccgggtttacggggtttaccgggtttccgggggtaaccggggttacggggtaaccccgtaaaggttcccggttaccggttaaccccggttaccggttaaaccggttcccgtaaacccgggacccccggtaaaggggttcccccgttaccccgggttacccccccggtttaccggggtacccttaaccccggtttcccttcccccggtttaaccccccttaccccccgg

SEQ ID NO: 125418 - DNA, 717 bp, Homo sapiens
  misc_feature: GYAE6OF01CV46M.12.85.H08.1.454.CMB.1.raw
  modified_base (232)..(232): a, c, t, g, unknown or other
  misc_feature (232)..(232): n is a, c, g, or t
  modified_base (634)..(634): a, c, t, g, unknown or other
  misc_feature (634)..(634): n is a, c, g, or t
tcagatacgacgtacacgaccggtgctcgatttagtatcactcagtcggcggggggggtctcaggaggcagcgctctcaggacatctccaccatggcctgggctctgctgctcctccaccctcctcactcgagggcacgagggtcccgtcgggacccaatctcgcccctgacctcacgcctcgccctccgtgtcgtcgggtctcgtaggactagtcgatccaactctttccncgaccgaaccggaaacaagttggtcgtacggtttcggttacgtttaattactttcgtcctacgttacggtaacaacacgaccaaccgacggaaccaaaccgacccccctaactcctagttaactttacgtagacggtacctagttaccgtttccggtacctacgtaaggttaactttaactaactcgtactttactcgttaccgttactaagtctacggacctaaccgaccgtcctcctactacctacgttccgtcggtacggtacggacgtccgtaggacggaacggtacggtctagttaacttacgtacgtcgtacttacgtacctaagtactaacgtagtacctacttacccacgttcgttcgttacgggttcggtacggtacgggtacggacgtacgngttaccgaccgtcgtaacgtcggaccgtaccgcgtcccgtcccggtaccctcggttaccaccggttccttccgttcccctccg

SEQ ID NO: 125419 - DNA, 680 bp, Homo sapiens
  misc_feature: GYAE6OF01B51EV.12.85.H08.1.454.CMB.1.raw
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctcgtgtctgggtctcctggacngtcgatccacctatttccngaccaaccggaaccaataggtgtacgtttggtacttaatactttgtctcctggtacaaacagccacccgaggacaaaccgccccccaactcctagtatttagtagacggtacacttacgttccggtcctcgaggtaatttctaatcgtcttctcgttcggttactaagtctggacctaacgacggtccctccctcgacctactccgtcggtcgggtccaggccgtggacggtacggacggtcttaggtaactttacgttacgtgacgtagttcaatactaacgtaacgtacctacttaccctacttccgtcggttcgggtttacggttccgggtacgggtaccgggtaccgaagtccgtaccggtacccgtaccgtaacgtcccgaacgtaccccgacggtcccgtcccggtaccccccgttaccggtccctacccgttcccgttccccgtcccccttaaccccccg

SEQ ID NO: 125420 - DNA, 678 bp, Homo sapiens
  misc_feature: GYAE6OF01DMPDT.12.85.H08.1.454.CMB.1.raw
  modified_base (213)..(213): a, c, t, g, unknown or other
  misc_feature (213)..(213): n is a, c, g, or t
  modified_base (266)..(266): a, c, t, g, unknown or other
  misc_feature (266)..(266): n is a, c, g, or t
tcagatacgacgtacacgaccggtgctcgatttagtatcactcagtcgcggggggttctcaggaggcagcgctctcaggacatctccaccatggcctgggctctgctgctcctcaccctcctcactcagggcacagggtcctgggcccaatctcgccctgactcagcctgcctcgtgtctgggtctccgtggacagtcgatcacctatttccngacaccggaacagtagtgtacgttggtacgttatactttgctctggtacaacngccaccagaccaaacgcccccctaactcctgtattagtagtacggtctactacgttccgtcctacgtaggtaatttctaagtcgtcttcgtcttcgttctaacgtctggacctacgacgtcctccgtcgacctagtccttcggtcggggtaccgtaggcgtaggacggacgtagggtctagtacttattacgtcgcgtacgttactaacgttacgtactaaccgtactaccttccctacttccggttacggtttcggttcgggttcgggtaccgggtacgggtacccgtaacggtcccgtacggtaccccgttacgttaaacgttcccgaacggtcccggaaacggtccccgttaccccgaccccggttccggtaccctacccgttccgttccccgtttccccgtacccccg

SEQ ID NO: 125421 - DNA, 568 bp, Homo sapiens
  misc_feature: GYAE6OF01CU4Q2.12.85.H08.1.454.CMB.1.raw
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
tcagatacgacgtacacgaccggtgctcgatttagtatcactcagtcgcgggggggtctcaggaggcagcgctctcaggacatctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtatgattttggaattttgacctagtctctggtaccacaataccccggcaaagtccccaagttatcatttatgaggcactaagcggccctnaggagtttctgatcgcttctcttggctccgaaggctggcgaccgggcctcccngacaatgtccngggctccaggctagaggacgaggctcgattctactgctgccttcatatcgggtaagtttagtagtactacgttggggtagttccgggcgggtcgggaccaaaggttggacccgttaccgtaggtacgacgcccgtaaggccgttccggccccccttcgggtcaccgttcctcggtttccccctaaccccg

SEQ ID NO: 125422 - DNA, 608 bp, Homo sapiens
  misc_feature: GYAE6OF01AFSIG.12.85.H08.1.454.CMB.1.raw
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (454)..(454): a, c, t, g, unknown or other
  misc_feature (454)..(454): n is a, c, g, or t
  modified_base (465)..(465): a, c, t, g, unknown or other
  misc_feature (465)..(465): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggttcctgggcccaatctgccctgactcagcctgcctccgtgtcgtgggtctcctggacagtcgatcacctatttccngccaaccggaacatagngtacgttgtcgttatactttgtctctggtacaacngcaccaggcaacgcccccaactcctntattatgagtcactnttcggtcctcaggtatttctaactcgctttctctcgttccaagtctcggacaaccgaccggtccctcctcgacctatccgtcgtcggggtccaggtctggaggacgaggtctgtaacttagttctgctagttacataacactaacncgtaacttccncgttaccgttcggtcgggttcggttccggggacgggttaccggaccgtacgtccgtacgtacccggtaccgtaacgtccacgacccgacggtcccgtacccgtccccgtcgtacctaccttccgtcccgttcccctacccccg

SEQ ID NO: 125423 - DNA, 678 bp, Homo sapiens
  misc_feature: GYAE6OF01DL9CV.12.85.H08.1.454.CMB.1.raw
  modified_base (196)..(196): a, c, t, g, unknown or other
  misc_feature (196)..(196): n is a, c, g, or t
  modified_base (323)..(323): a, c, t, g, unknown or other
  misc_feature (323)..(323): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcaggacacagggtcctgggcccaatctgccctgactcagcctgcctccgtgtctgggtctccgtggacngtcgatccacctatttcctgccaacccggaaaccaatagtcgtacggtttggtacgttaattaacttttgtctcctggtaacaaacagaccaccgaggaccaaacgccccccaatcctgtatttagngaggtcacttacgttccgtcctacgaggtactttactaatcgtcttctctgttccaagtcgtacgactaacgaccggtccctccgtcgacctactcgtcggtcgggtccacgggtctacggacggtacggaggtcgtaggttaactttaacgttacgtcggtactaacgtttcgaacttacgtaacgtaacgtcctaacctttacccgtaacttccggttcggttcgggtttacggttccggggacggttacgggaccctaaggtcctacggtaccgtaccgttaacgtcgacgacccgtaaggtcccgtccgtcccccgtcgggtacttacccgtctcccgttcccctaccccg

SEQ ID NO: 125424 - DNA, 759 bp, Homo sapiens
  misc_feature: GYAE6OF01BI5P4.12.85.H08.1.454.CMB.1.raw
  modified_base (219)..(219): a, c, t, g, unknown or other
  misc_feature (219)..(219): n is a, c, g, or t
  modified_base (312)..(312): a, c, t, g, unknown or other
  misc_feature (312)..(312): n is a, c, g, or t
tcagatacgacgtacacgaccggtgctcgatttagtatcactcagtcgcggggggggtctcaggaggcagcgctctcaggacatctccaccatggcctgggctctgctgctcctcaccctctcactcgagggcacgagggtcctgggcccaatctcgccctgactcagcctgcctcgtgtctgggtcctcgtaggacagtcgatccacctagtttcccngaccaacccggaaacctaagttacggtacggtaccggtttaggtaccgtttaatttaaccgttttcgtcccttaccgtaggtaaaccaaaacncgaccaacccgaacggaccaaacccgacccccctaacttcctaggtactttagacggtacgtacctacgtacggtttccggtacctacgtaacgttaacttttacgtaacgttccgttacgtttcttcggttacggttactaacgtcgtacgggacctaaccgacccgggtcccttccctacgtacctaccgttccgtcggtccgggtaccgtacgggtccgtaggaacgggtacggtacggtactaggtttaacttacgttacgtacgtagtacgttacaagttaactacaacgtcctacgttcctacgttacgttggtcgttcgggtggacggtccgaagtacgtcgtaccgtaccggttaacctaggaccaccggtaccggcgtaccccgtcccgtaaccccgttcgaaccctccgtttaccgtccccggtttaccccctcccg

SEQ ID NO: 125425 - DNA, 827 bp, Homo sapiens
  misc_feature: GYAE6OF01D1MET.12.85.H08.1.454.CMB.1.raw
  modified_base (359)..(359): a, c, t, g, unknown or other
  misc_feature (359)..(359): n is a, c, g, or t
  modified_base (665)..(665): a, c, t, g, unknown or other
  misc_feature (665)..(665): n is a, c, g, or t
tcagatacgacgtacacgaccggtgctcgatttagtatcactcagtcggcgggggggggtctcaggaggcagcgctctcaggacatctccaccatggcctgggctctgctgctcctcaccctcctcactcagggcacgagggtcctgggcccaatctcgccctgacctcacgtcctgccttccgtgtcgtcgggtctccgtggacagtcgactccacctatttcctcgaccgaaccggaacctaagtaggtcggtacggtttggttacgtttaattaacgtttcgtccttacctaggtaaccaaacgacgccgaaccgacggaccgaaaccgcccccccaaattcctaggtactttagngtacggtcctaacgttacgttccggtacctacgtaacggttaacttttaccgtaacttcgtccgtttccttcgttccggtttaaccgtacggttaccgttcgggaaccgaacccgtaccgggtacccctttaccccggtacgtaaacccgtcgttaccccggttcgggttaccgggggttacccgacgggttcccggttagggaaccgggtaaaccggtcgggtacgtttacgttaagttacgtttaaccgtcggttacgtaacggtttacaagttaaccttaacgaactaccgtaccctttaacnccttaccggttggttcgggtttaccggtttccgggacgggttaccgggactaccggtctacggtacccggtacttaacggcccgtacggtacccggtaagtccccgcccggtaccccgttcgggtaccttaccggttcccgtacccggtcccggtttccccc

SEQ ID NO: 125426 - DNA, 735 bp, Homo sapiens
  misc_feature: GYAE6OF01DH36N.12.85.H08.1.454.CMB.1.raw
  modified_base (199)..(199): a, c, t, g, unknown or other
  misc_feature (199)..(199): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcgagggcacgacgggtcctcgggcccaatctcgccctgactcacgcctcgcctcgtgtcgtcgggtctccgnggacagtcgactcctaacctactttccgacgacccgaaccggaaacctaagtacggtcggtacggtttcggttacgttaactttaacgttttcgtaccttccgtaggtaaaccaacgacgaccaaccgacgaccaacccgccccaactctagtacttagcgtagtcctacttcgttcgtacctacgtaagttacttactaactccgtctttcgtacgttcgttacgtacgtcgtacggacctaacgtcccgtcccttccgtacacctcgttcgttccggttcggggtaccgtacgggcgtacgggaacggacggtacgtcgttagttaacttttacgtctacgtacttacgtttacaaacttacaaccggttctaccttaccgttcctaacgttcggttacgggttgggttaccgggttcgggtaccggtaacggtacaccgggttacctccggtaccttaacggacgtcgaacccgcggtcgtacccgccggttaccccgtacttccaccgttccgttacccctccccgttaccg

SEQ ID NO: 125427 - DNA, 788 bp, Homo sapiens
  misc_feature: GYAE6OF01CA38U.12.85.H08.1.454.CMB.1.raw
  modified_base (218)..(218): a, c, t, g, unknown or other
  misc_feature (218)..(218): n is a, c, g, or t
tcagatacgacgtacacgaccggtgctcgatttagtatcactcagtcggcggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggacagtcgagtccacctattttccngccgaaccggaaccaagtagtgtacgttggtcgttaatactttggtctccgtaggtaaccaaaacgacgtaccaacccgaggtaccaaaacgcccccccctaaacgttcccgtaggtaattttagtcggtaacgggtcctaacgttaacgttccgggtccctacgaaaggttatttacgtaaacgtccgtactttcgtacgttcggtttaccaagttctagggaccaaaccgtccggtccctccgtacgaccctagtcctcgtcggggtccagggaccttagggacggtacggaacggtcgttacggtaaatttacgttaaccgtgtactaacggttaccaaattaacgtaacgaaacgtcctaacccttcgtaacccgttcgttaccgggttacggttcgggtttaccgggcgggttaaccgggaccaaggttcccgtacggtacccgttaacccggtaacgttccgaaccggttaccccggaaacgggttccccgtacccccggtaccccccggttacggttaccctaacccgtttccggttaccccgttccccccgttaaccccccg

SEQ ID NO: 125428 - DNA, 728 bp, Homo sapiens
  misc_feature: GYAE6OF01CM0WJ.12.85.H08.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (254)..(254): a, c, t, g, unknown or other
  misc_feature (254)..(254): n is a, c, g, or t
  modified_base (506)..(506): a, c, t, g, unknown or other
  misc_feature (506)..(506): n is a, c, g, or t
tcagatacgacgtacacgaccggtgctcgatttagtatcactcagtcgcggggggggtctcaggaggcagcgctctcaggacatctccaccatggcctgggctctgctgcctcctcaccctcctacactcgagggcacgtagggtcctgggacccaatctcgccctgactcagcctgcctcgtgtctggtctcgtggacaggtcatccactnttccgngcaaccgtacatgtcgagttgtacgttattacgttntctccgtagtaacaacgcgaccaccgaggacctaaacccgccccctaatccgtatacttttgacgtaacgtctaacttcgttccggtcctacgtagttaactttacacgtctcttaccgtcttcggtactagtccgtaggaccaacgccggtcccctcgtacgacctctcgtacggttcgggaccgtaggtcgtacgacgggtacacggtccgttagttaacgtttacttaaccgcggtaacgttacgttanaacttacgtaacaccggtaccttaaccgtttcgaccttccggttagggttcgggtaccggtttcggggaccggtttacgggaccctaacgggtccgttaacccgggccgttaaccgtaacgcccgttacccgggaaacccggtcgggtaaccccgccccggttaacccccggttcggacccctttaccccggttccgttacccccggttcccccttaacccg

SEQ ID NO: 125429 - DNA, 809 bp, Homo sapiens
  misc_feature: GYAE6OF01BWZL7.12.85.H08.1.454.CMB.1.raw
  modified_base (197)..(197): a, c, t, g, unknown or other
  misc_feature (197)..(197): n is a, c, g, or t
  modified_base (214)..(214): a, c, t, g, unknown or other
  misc_feature (214)..(214): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccaatctcgccctgactcagcctgcctccgtgtcgtggtctcgtggacngtcatccactatttccngaccaccggaaccaagtagtcgtacggtttggttacgttttaattaacgttttcgtccttccgttacggtaaccaaacgacgaccaaccccgacggaccaaacccgccccccaacctcctagtaactttatggacggtctaacgttcgttccggtacctacgtaacggttaacttttactaacgttccgtctttaccgttcgttccggttaaccgtacgttcggtacgaccgtaaaccgacccggtcccttacccgtacgaccctacgttccgtcggttccggggtaccggcgtacgttacgggaacgggacggtagggttcgttaggtaacttttaacgttacgtacgtacgttaacgtttactaacgtttaaacgtaaccgtaaacgttcctttaaaccccttccgttaaccgttccggtttacggtttacgggggttacgggtttccggggtacggggttaccgggaacccgtaaacggttcggttacccggtaacccgtttacggtaaccgtaccgtaccggacccgtaccgggtccgtccccgtccccgttcgtaccttacccgttcgtacccgttcccccgttaccccg

SEQ ID NO: 125430 - DNA, 686 bp, Homo sapiens
  misc_feature: GYAE6OF01DXHBW.12.85.H08.1.454.CMB.1.raw
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccaatctcgccctgactcagcctgcctcgtgtcgtgggtctccgtgacagtcgactccaacctnttttcccncgaccaaccggaaacctaatagtacggacggttttggtacgtttaattaacttttcgtcttcgtacggtaacaaaacacgaccaaccaggaccaaaccgcccccaactcctagtactttagtacggacggtacctacgttacgttccggtcctacgaaggttaactttactaatcgtcttcttcgtacggttctaacgtcgtcgacaaccgaccgtccctccgtagacctacgttcgtccggtacggggtccacggtcgtacggacgggtacgtaggtcttaagttaatttacttacgtgtcttagttactataacgtacacgtactaccttcaacgttcgttaggttcgggttcgtcggggtacgtacggacctaacggtcgtcgtaaacccggttcaacggtccgaacgtacccgaggtccctcccggcccgtacgtactaccctttcccgtcctccctacccg

SEQ ID NO: 125431 - DNA, 756 bp, Homo sapiens
  misc_feature: GYAE6OF01E35JR.12.85.H08.1.454.CMB.1.raw
  modified_base (547)..(547): a, c, t, g, unknown or other
  misc_feature (547)..(547): n is a, c, g, or t
tcagatacgacgtacacgaccggtgctcgatttagtatcactcagtcggcggggggggtctcaggaggcagcgctctcaggacatctccaccatggcctgggctctgctgcctcctcaccctcctcactcgagggcacgacgggtccgtcggacccaatctcgccctagacctcacgcctcgtccctcgtcgtcgtcgggtcctccgtaggactacgtcgactcctaaccttactttccgacgaccgaaccgaacctagttacggtcggtacggtttcgttacgtttaacttaccgtttcgttccttaccgtacgtaacaaactacgccaaccgacggtaaccaaaccccgtaccccctaacttcctagttaactttacgcggtacgtacctactttacgttcgtacctacgtacgttatttactactccgttcttctcggttcgttaccgtactcgtacgaccaccgtcccgtcctccacgtacctctcgtcggtccgggtatacgggtacgagggaacggcggtagtacttagttacttattcgntacgtacgttacataacggtaacacgtcccttacgtaccttcgttccgtcggtcgggttcggtacggggtccggttaacgaccgtacgtcgttacccgtaccgtaacgttaccggtaccgaacggtacccgtaccggtccccggtacccccgtcccgggttacccgttacgttacccccggttcctttcccccgtccccgttaccccgg

SEQ ID NO: 125432 - DNA, 750 bp, Homo sapiens
  misc_feature: GYAE6OF01DDDR3.12.85.H08.1.454.CMB.1.raw
  modified_base (236)..(236): a, c, t, g, unknown or other
  misc_feature (236)..(236): n is a, c, g, or t
  modified_base (304)..(304): a, c, t, g, unknown or other
  misc_feature (304)..(304): n is a, c, g, or t
tcagatacgacgtacacgaccggtgctcgatttagtatcactcagtcggcggggggggtctcaggaggcagcgctctcaggacatcctccaccatcggcctgggctctgctgcctccctccaccctcctcactcgagggacacgacgggtccgtcgggaccctaatctcgccctgacctcacgcctcgtcctccgtgtcgtcggtcctcgtagaccagtcactaccactacttccncgaccgaacccgaactagtagtagtacggttgttacgttaattacgtttcgtctacgtagtaacaacncgaccaccgacgaccaacccgacccctaactcgtagttacttaggacgtacgtacctagttcgttccggacctagtaagtttaactttacgactccgttcttacctcgtacgttacgtagtcgtacggacctaacgacccggtcctacccgatacctctcggtccggtacggtcctacgggtacgagggacgaacgggttcgtaatacgttactttaacgtacgtcgtacgttaacgttctaaagtacgtaaacctagtaacccctttattaacccgtcccgtttacggttcggtttcggggtttacgggccgggttacgggtaccgtaaccgaggttacccggttcgttaacccggttactaaaccggggacacccggtaccggttcgcccctaccccggtccgttccggtaccctcccggtttccctcccgtcccccgttaccg

SEQ ID NO: 125433 - DNA, 746 bp, Homo sapiens
  misc_feature: GYAE6OF01C6C90.12.85.H08.1.454.CMB.1.raw
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (420)..(420): a, c, t, g, unknown or other
  misc_feature (420)..(420): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctcgccctgactcagcctgcctccgtgtcgtgggtctccgtggacagtcgatccaccgtctcctgcacgtgggaccagtaactgtattttaggaaattttgacctagtctcctacggtaccaacaactaccccggactaaacgtaccccaagttaaanctatttatggaggacacaaggccgcccgtcgaggtacgtttcngtatcgtacttcgtactcggtcctaccgaagcgtcggccggacccggtccctcccgagacgtaaatntccgtgggcctccgaggtccgtaggacggacgaacggtcttacgtaactttaacgtacgttcgaccgttcgtacctacgtaagtttaaggtcgggtttaaagttacgtaacggtaccgttaacggggtttttcggggtacgggtttacccggggacccgggtaacgggggtaaccctaaaaacgggttcccggttaaaccccgggtactttaaaccgggttcgaaacccgggtacccgtaaccggtccccgtacccccgggtcccccgttaccggttacccacccgttttcccgtacccggttccccccttcccggtttacccccg

SEQ ID NO: 125434 - DNA, 605 bp, Homo sapiens
  misc_feature: GYAE6OF01EG55Y.12.85.H08.1.454.CMB.1.raw
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
tcagatacgacgtacacgaccggtgctcgattttagtatcactcagtcgcggggggggtctcaggaggcagcgctctcaggacatctccaccatggcctgggctctgctgctcctcaccctcctcactcagggcacgagggtcctgggcccaatctgccctgactcagcctgcctccgtgtctgggtctcctggacagtcgatccacctatttccngccaccggaaccaatgtgacgttggtcttatactttgtctctggtacaaacngcaccaggcaaacgccccccaatcctgtatttagngaggtcactagttcggtcctcaggtatttcaatcgtcttctctggttccaagtcgtgaccaacgccgtcctccctagaccatccgtcgtcggggtccaggcgtaggacggacgagggtctaggtaactttacgtactgactagtttcaattactaacagtcctaccttccacttcgtcggttgggttcggttccgggacgggtggaaccgtaagtccgtacggtaccgtaccgtagtccgaacgcccgaaggtccctcccggccccccgttggtccaccttccgttccgtcccccctacccg

SEQ ID NO: 125435 - DNA, 689 bp, Homo sapiens
  misc_feature: GYAE6OF01BF7UG.12.85.H08.1.454.CMB.1.raw
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctcgtgtctgggtctccgtggacagtcgatcacctatttccngccaccggaaccaatagtgtacgttggttcgttataactttgtcctcctggtaacaaacagccacccaggacaaacgccccccaactcctgtatttanggacgtcactattcggtcctgaggtatttctaatcgtccttctcgttcggttaccaagtctcggacaacnccggccctcctcgacctactctcgtcggggtaccagggtctaggacggacggacggtcttaggttaatttacttaacgtcgtactaggtttacctaagttaactaacgaagtccctaaccgttccctaacgttccgttcggtacgggtttcgggttaccgggtcggggttaccgggaccgtaaacggtccgttaggtaccgttacccggttaccgtaacggttcccgacggtaccccgaacgggtcccttacccggtccccccgttcggtaccctaccgtttcccggttccccggtttaccccccccg

SEQ ID NO: 125436 - DNA, 726 bp, Homo sapiens
  misc_feature: GYAE6OF01BMZ0K.12.85.H08.1.454.CMB.1.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (314)..(314): a, c, t, g, unknown or other
  misc_feature (314)..(314): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccaatctgccctgactcagcctgcctcgtgtctgggtctccgtggacagtcgatccacctntttccngaccaccggaaccagtagtgtacgttggtacgttattactttgtcctctaggtaacaacacgccacccaggaccaaccgcccccactcctgtatttagngacgtcacttacgttcggtcctacgagttactttacgtaactctctttctcgttacggttcctaaggttcctaggaccaaccgtacccggtccctacccgtacgaccctacgttccgttaccggtccggggttcccgaacggggtcgtagggacgggacgggtacgggtcgttagttaacttttacgttacgtacgtacctttacggttacttaaacgtacttaacgtaaacggtcccttaacctttacccgttaccgttccgttacggttcgggttacgggttccggggtacgggttacggaccgtaacggtccgtacgtacccggttacgtaacgtccgaccggaccgtccggccgttccccggaccccgttcggtaccctacgttcccttacccgtcccccgtaccccg

SEQ ID NO: 125437 - DNA, 830 bp, Homo sapiens
  misc_feature: GYAE6OF01EKX0T.12.85.H08.1.454.CMB.1.raw
  modified_base (215)..(215): a, c, t, g, unknown or other
  misc_feature (215)..(215): n is a, c, g, or t
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggacagtcgatccacctatttccngccaaccggaaccaatagtgacgttggtcgttataactttgtcttcctggtaacaaacngccacccgaggaccaaacgccccccaactcctatatttanggtaacggttctaacgttacgtttccggtcctacgtaggttaaacttttctaaacttccgtactttccgtcgttacggtttcccaaacggttcttacggggacctaaaccgaccggtccccttcccgtagaaccctacgttcccgttccggtacggggtttacccaacggggtcccgttagggaaccgggaaccggtacgggtacctttaggtaacttttaacgtttaccgtcgggtacctaacggtttccaaatttaaccgttaaccaaacggttacccttaaccctttacccaacccgtttccggttaccgggtttcggggtttacgggtttacccggggtaccggggtttaccgggaacccctaaagggttcccttaacccggggtaaccctttacccggtaaacggttccgaacccggttaccccgaaagggtcccccgttaccccggtcccccccggttagggtaccccttaaccccggtttcctttccccggttaccccccgtacccccg

SEQ ID NO: 125438 - DNA, 882 bp, Homo sapiens
  misc_feature: GYAE6OF01D5LK5.12.85.H08.1.454.CMB.1.raw
  modified_base (109)..(109): a, c, t, g, unknown or other
  misc_feature (109)..(109): n is a, c, g, or t
  modified_base (220)..(220): a, c, t, g, unknown or other
  misc_feature (220)..(220): n is a, c, g, or t
tcagatacgacgtacacgaccggtgctcgatttagtatcactcagtcgcggggggggtctcaggaggcagcgctctcaggacatctccaccatggcctgggctctgctncctcctcaccctcctcactcagggcacgagggtcctgggcccaatctgccctgactcacgcctgccctcgtgtcgtgggtctccgtggacagtcgatccacctactttccngccgaaccggaaccaatgtcgtacggtttggtacgtttaattactttgtccttccgttaggtaacaaacacgccaacccgaggaccaaaccgccccccctaactcccgtagttattttacgtggtacgggttaccaacgttacgtttcccggttacccttacggaacgggttaactttttacctaaacgttccgtacgtttccctttcgttaccggtttacccgtaaaggttcccgtagggtacccgtaaaccgaccgggtccccctttaccctaggtaaccctaatttcccgtacggttccggggtacctacccgtacgggtacgttacggaacgggacggtaacgggtcttaggttaatttaactttaccgtacgtccggtacgtccttacctaagttacgttacggtacggttacgggttacggtcggttaacccgtttaccgtttaccggtaccttaaccggtttaacgggttccggggtacgggtaaacgggaacccggtaaaccgggttaccgttaacccgggttacccggttacccggtttaaccgggttacccgaaccccgggtaaccccgggtaaaccgggtccccggttaaccccgggttcccccccgggttaacccgggttccccgttaaacccggttttcccccccgggg

SEQ ID NO: 125439 - DNA, 801 bp, Homo sapiens
  misc_feature: GYAE6OF01CSSMM.12.85.H08.1.454.CMB.1.raw
  modified_base (217)..(217): a, c, t, g, unknown or other
  misc_feature (217)..(217): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccaatctgccctgactcagcctgcctcgtgtctgggtctccgtggacagtcgatccacctattttccgngccaaccggaaccaatagtgtacgtttggttacgttaattacgttttcgtcttcctggtaacaaacagccacccgaggaccaaaccgccccccaatcctgtatttagtgaggtcaacttcgttcggtcctgaggtactttctaatcgtcttctcgtgttccaagtcgtcggacaacgaccggtccctccgtacgacctactccgtacggttcggggtacccgagggtccgtagggacgggtaccggtaaggtcgttaaggtactttaacgtttacgtggtacctaacgtttacgtaaattaaacgttacccgtaaacggtacccttaacccgtttacccgtaacccgttttccggttaccggggtttcgggtttaccggggttttaccgggggaccggggttaaccgggggtaccctaaaccgggtccgtttacccgggtaacccggtttaccgtaaacgggttaccccgaccggtaaccccgggtaacgggttcccccgttaccccgggttccccccggttaccgggttaccccttaccggtttacccccgttccccgggtttacccccctttacccccccgg

SEQ ID NO: 125440 - DNA, 931 bp, Homo sapiens
  misc_feature: GYAE6OF01CR6GO.12.85.H08.1.454.CMB.1.raw
  modified_base (213)..(213): a, c, t, g, unknown or other
  misc_feature (213)..(213): n is a, c, g, or t
tcagatacgacgtacacgaccggtgctcgatttagtatcactcagtcgcggggggggtctcaggaggcagcgctctcaggacatctccaccatggcctgggctctgctgcctcctccaccctcctcactcgagggcacgacgggtccgtcgggacccaattcctcgccctgacctcacgtcctcgcctccgtgtcgtcggtctccgtcggacncgtcgactcacctactttccgtcgccgaacccggaacctaagttaggtacggttacggtttggttacgtttaactttaaccgttttccgttccttaccgttacggtaaacctaaaccgaccgtacccaacccgacggaacccaaacccgaccccccctaaccgtaccgttacgttaacgtttacgtacggtaaccgttaccttaccgttacgtttccggttaccgtacgttaacgttaaccttttacttaacgtccgttactttccttcgttaccggtttacgtaacgttccgacgtaccgtaaccgtcccggtcccgtaccgtaccgtaccttacgttcggttccgggttccgggtaccgtcgggttaccggtaggaccgggtaacggacggttccgtttagttaaaccgttttacgttcggaccgttacgttaaccgttaacttaacgttaacctaaacggtcccgtacccttacccgttaccgtaaccggtttcggtttaccggggtttcgggggttacccggttaccggggaccgggggtttaaccgacccgttaaccgggttcggtaccccgttaaccggtttacccgaacgggtaacccccggtaccgaacccccggggttccgtaccccgggttccccccggttcccccggttaacgttacccccgttaccgtttccccccgttacccccgggttcccccttaacccccgg

SEQ ID NO: 125441 - DNA, 908 bp, Homo sapiens
  misc_feature: GYAE6OF01BGP3A.12.85.H08.1.454.CMB.1.raw
  modified_base (448)..(448): a, c, t, g, unknown or other
  misc_feature (448)..(448): n is a, c, g, or t
tcagatacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggtctttttcttgtggtacttttttaaaaggtcgtcccagttgtgaggtgacaacgtggttggagtcggtgggggaggtcgttggtacgagggtcccgggggggtccctggagtacctcctccgtggtcgcgacggtcctcgtggtattactaaagttttaacacggttctttacgccgtagtcggggacgttcggggtccccgaccgacgggtcctaccgggaacggggaacggggccgtagggtacggtgggtacccgtagtaagttaaagttaaggtaacgggtaaaggggttanaacgttaaaccaacgtaagttaacgtacggttacggaaccggtaccgttaccgggtttaaggggtaaaccggggggttccccgttaaacgtaacccgtaaccgttaccctaaccggaaacgtaaccgtaaacccgtaaacgtttaaccccgaaaaacggtaaaaacccttacgtaacgttaacttaccggtaacggtaaacccttaaaacccgttaaaccggaaccgttccggtaaggtacggtaaacggttacgggaaaccgggtaacccgttaacccggttaaccgttttacgtttaagaccggtttaggaaacccgtaaggtacccgtacccgtaaccgttaaagttaccggtagggtcggtacggtggggttaagggtccgggggtttaaggtttacccggtcggggttacccggggaccgggttaaacccggtacccgggttcgtaacccccggg

SEQ ID NO: 125442 - DNA, 884 bp, Homo sapiens
  misc_feature: GYAE6OF01CF417.12.85.H08.1.454.CMB.1.raw
tcagatacgacgtacacgaccggtgctcgatttagtatcactcagtcggcggggggggtctcaggaggcagcgctctcaggacatctccaccatggcctgggctctgctgcctcctccaccctcctcactcgagggccacgacgggtccgtcgggaccctaatccgtcggaccccttgacctcgacgtcctcgcccgtccggttcgttcggttcgggtcctccgtcggacctaggtccgtactcctaaccttacttttccgacgtacccgaaacccggtaactaagttacggtacggttacggttttcggttaacgtttaactttaaccgttttcgtccgttaccgttacggtaaaccgtaaaccgaccgtacccgaaacccggtaacggaacccgtaaaacccccgtaccccccctaacgttcccgttaagtacgtttaagacggttacggtaccttaaccgttaccgtttaccggtaccttacgtaacggtttaactttacgtactccgttacctttcgttcgttaccgttaccgtaaggttccgtacgaccgtaaccgtcccgtacccctccgtacctacctcgttacccggttcgggtaccggtacgacgggtacgtacgggaaccggtggtaccggtgtttaagtaactttaccgtagttaccgtactttaacggtaactacgttaacaacctacgttaccttaccgttacctcgtttaaccggtggtttaaccggggttcgggtccgggttaacggccggtaaccttacggtcccgtaccgggttaacccaccggttacgccggtaaaccgcccggttcgcccgttcccccgtaccgttaccgtcaccccgttttacccgccccggtcccttaccccg

SEQ ID NO: 125443 - DNA, 938 bp, Homo sapiens
  misc_feature: GYAE6OF01BYNTE.12.85.H08.1.454.CMB.1.raw
tcagatacgacgtacacgaccggtgctcgatttagtatcactcagtcgcggggggggtctcaggaggcagcgctctcaggacatctccaccatggcctgggctctgctgctcctcaccctctcactcagggcacgacgggtcctgggcccaatctcgccctgactcagcctcgccgtcgtgtcgtgggtcctccgtggacagtcgactccacctacttcctgaccaccggaacaagtacgtgtacggttggtacgtttaacttactttcgtcttaccgtaggtaacaaacacgacctaccgaggaccaaacccgaccccccaacgtcctagttactttagacggtacgttaccacgtttaccgttccgggtaccctaggtaacggttaacttttaccgtaacgttccgttaccttttaccgtaccgttttaccggtttacctaaacggtttcgtaacggggaacccctaaccgtacccccggggttaccccttaccccgtaccgtaaaccccgttacgtttcccggttaaccggggttccgggggttacccctaacgggggttccgtaaccgggggaacggggttaacccggggacgggttaccgtttaaacggggtttaaacttttaaaccgtttacgccggtttaacccgttaaacggttttcctaaacgttaacctaaaccggtaacccgttccttaacccgtttacccctagggtttacccggtttacgggggtttagggtttcccggggttaccggggttacggggtaccggggtaacccgttacggttacccgttaccggggtaccccttaacggtaccgtacccgggaccccgttacgggaacccgggttaccccgttccccgggtaccccccggtttacgggttaccccttacccggttaccctttcccccggtttccccccccgtaccg

SEQ ID NO: 125444 - DNA, 710 bp, Homo sapiens
  misc_feature: GYAE6OF01CP5NN.12.85.H08.1.454.CMB.1.raw
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctgccctgactcacgcctcgcctccgtgtcgtcgggtctccgtaggacagtcgatccaccgtctcctgcacgtggaccagtatgtatttaggaattgactgtctcgtgaccacactacccganaacgtcctaagtatctattagngagcacacgcgccagtaggtnttcngtactcgtcttcgtcgtcgactacgaggtcgtcggacccgaccgggtccctaccgtagaacctagttacgtccggtacgggcctaccggtacggtcgtacggacggtaccggacgtcctacgttaacttactaccgtcgtacgtctaccgtacgtaagtacggtagggttaacgttagtacgtacggttacggtttcggggttcggtaccggggtaccggtaaccgggtaacggtaacggttacccggtaacccggttaaccggtacggtaaccggtacccggtaaccggtaacccggtccccggttaccccggtaccccccggtttcggtaaccccgttacccgttccccgtttaccccgttccccccgttcccccgtttaccccg

SEQ ID NO: 125445 - DNA, 756 bp, Homo sapiens
  misc_feature: GYAE6OF01ANEXP.12.85.H08.1.454.CMB.1.raw
tcagatacgacgtacacgaccggtgctcgatttagtatcactcagtcggcgggggggggtctcaggaggcagcgctctcaggacatctccaccatggcctgggctctgctcgctcctccaccctcctcactcgagggcacgagggtccgtcgggcccaatccgtcgccctgacctcacgcctcgcctccgtgtcgtggtctccgtgacagtcgactccacctcttcctacgccgaaccggaactaagtacggtacgtacggtttcggttacgttaacttacgtttcgtccgttccgtagtaaaccaaacgacgtaccaaccgaacggaaccaaacccgtacccccaaccttccgtagttacgtttacgtacggtacgtacctacgttacgttccggttacctacgtagttactttactacgtcgttcttctcgttcgtactacgtcgtacggacctacgccgtacctccgtacctactctcgtccggtgggtaccgaggtcgacggacggtacggtagtacgtagttaattcgttacgtgtacctagttactaataaccgtaacgtacctacgtacccctttacgtcgttacccgttcggggtgggttacccgggttccggggtacggtaaccggaccggtacggttccgtaccggtaaccgtaccgtaaccgtacgacccggttaacggcccgttcccgtaccccgttcccgttaccggcccttaccgtacccgttccccctaacccgttccccg

SEQ ID NO: 125446 - DNA, 815 bp, Homo sapiens
  misc_feature: GYAE6OF01DFHRY.12.85.H08.1.454.CMB.1.raw
  modified_base (226)..(226): a, c, t, g, unknown or other
  misc_feature (226)..(226): n is a, c, g, or t
tcagatacgacgtacacgaccggtgctcgatttagtatcactcagtcggcggggggggtctcaggaggcagcgctctcaggacatctccaccatggcctgggctctgctgctcctcaccctcctcactcagggcacgagggtcctggacccaatctcgccctgactcagcctcgcctcgtgtcgtcgggtctccgtggactagtcgtactcctacctagtttccgngaccaaccggaaactagtacgtgtacggttggttacgttaacttactttcgtcctaccgttaggtaaaccaaaccgacgtaccgaacccgaacggaaccaaacccgacccccctaacgttacccttaggttaacttttacgtacggtaacggttacctaacgttaccggtttccgttaccgttacgtaacggtttaacttttaccgttaaacgttccgtaacctttccgttacgtttaccggtttaacccggtaaacggtttccggtacggtaaaccctaaccggtaccccggtaccccgttaccccgtaaccgtacccgtttacgtacccggtttaccgggttaccgggggttacccgtacgggtacccggttaggggaaaccggggtaaccggtacgggtacgttaacgttaagttttaaccgttacggtacgttacgttagttaactataactaacgtacgtacctaccttctaacttcggtcggttgtcggtcgggtcggtacgtacacgtcgaccgtaccgttcgacgtctacggacgtccgtctcccgcccgtcgtacctacttcctcccgtacccctacccg

SEQ ID NO: 125447 - DNA, 779 bp, Homo sapiens
  misc_feature: GYAE6OF01CT511.12.85.H08.1.454.CMB.1.raw
tcagatacgacgtacacgaccggtgctcgatttagtatcactcagtcgcgggggggtctcaggaggcagcgctctcaggacatctcaccatggcctggctctgctgctcctcacctcctcactcgaggcacgacgggttccgtcggaccctaatcgtcgtccccgtagtaacctcgacgtcccgtcggtcccgttaccgttggtccgttcggttcctccggtggaaccagtccgactccgaccttacttcctcggacccgaaccggtaacctaagttacggtacgtaacggtttgttacgtttaacgttacgtttcgtaccgttcgtaacggtaaactaaaccgcgtacccaaccggaacgacccgaaaccccgtcccccctaaagttccgtagttaacgttttacgcggtaaccgttactaaccgtttacgttcccggacctaaggttaaggttaaccttttacgaactcgttactttcgttacgttcgtacgagtcgtcgaaaccgtaccgccgtcctacgtaacgcctacgttccgttgggcggtacgacgacgtacggacggacgtgcgttacgttattaacgtcgtgtacgtacttacggtataaccgtaacgtacgtccttaaccgttcgtacgttacggttcgttccgggtgttccgggtacggtaacgtacctacggtcgttacccgaacgtttacccgtagccgtaaccgaccggtcgcccggttacccgcccgttagtcccctagtttcccgtcccgtacccgtccccg

SEQ ID NO: 125448 - DNA, 716 bp, Homo sapiens
  misc_feature: GYAE6OF01EGTJA.12.85.H08.1.454.CMB.1.raw
  modified_base (240)..(240): a, c, t, g, unknown or other
  misc_feature (240)..(240): n is a, c, g, or t
tcagatacgacgtacacgaccggtgctcgattttagtatcactcagtcggcgggggggggtctcaggaggcagcgctctcaggacatctccaccatggcctgggctctgctgcctcctccaccctcctcactcgagggcacgacgggtccgtcgggacccaatcctcgccctgactcacgtcctcgtcctccgttcgtcgtcggtcctccgtcggactagtcgactccacctactttccncgaccgaaccgaactaagtacggtacggtacgttggttactttacttactttcgtctacgtagtaacaacgacaccaccgacgaccaaccacccctactcgtattattatacgacgtctacgttacgttccgtactacgtaagttactttactacgtctcttctcgtcgtactacgtcacgacacgccgtcctccacacctagttcgtcggtcgggtcgacgtcgtacggacggacgacgtcgtagtacttacgttacgtacgtacgttacgttactaactaactacgtaacgtacctaccttacctaccgttcggttcggttcgggttcgggttacgggtacgggtacggtacgtacgtagtaccccccccccccccccccccccccgtacgttaccgtacgtaccgtaccgaccgaccgtaccgtacccgtccccgtaccgttacctaccttcccttcccgttcccgtaccccg

SEQ ID NO: 125449 - DNA, 750 bp, Homo sapiens
  misc_feature: GYAE6OF01A5RWM.12.85.H08.1.454.CMB.1.raw
tcagatacgacgtacacgaccggtgctcgatttagtatcactcagtcgcgggaggtctgagagaggagcccagccctgggattttcaggtgtcctctatttggtgatcaggactgaacagagagaactcaccatggagttggctgagctggtctttttcttgtggtactttttaaaggcgcctagtgtgaggtgcatgttggagtcggtggggagtcttggtacgacgggccgggggggtccctggacgtacctcctccgtgtcgcacgtcctcgtggtacttacttaacttttaacacgtctttcgacctaggtcgggtcgtccgggtcccgccgacggtccgtaccgggaaggggtacggggtcgtggggtaggttcgggtacgtacgtaagttaagttaaggtagggtaaaggggtagaactaacgaacgtaattacgtagtacgacggtactggtacgggtaacggggtcccgtactacgtactccgtacgaagacgtaactaaccttaaccgaaaacgtaaactactacgtaactacgtacgtaaccttaaacgtaaccgctacgaggacgtacggtacggacgtaccgtaaccgttctttaacgttgtacggtcgaacggtaagtcccttacccggacttaacggtaggtcggtacggtcggtagggtacgggtttaccgggttgggtttacccgggttacggggacgggtaacccggtcgggttaacccgttcggtaaccccg

SEQ ID NO: 125450 - DNA, 872 bp, Homo sapiens
  misc_feature: GYAE6OF01EOFX0.12.85.H08.1.454.CMB.1.raw
tcagatacgacgtacacgaccggtgctcgatttagtatcactcagtcggcgggggggggtctcaggaggcagcgctctcaggaaatctcaccatggcctgggctctgctgctcctcaccctcctcactcgaggcacgagggtcctgggcccaatctcgccctgactcacgcctcgtcctccgtgtcgtgggttctccgtcggacagtcgactccacctacttcctcctgaccacgtacggaaccagctaggtcggtacggttggttacgttaataacgttattcgttcctccgtacggtaaccaacgtacgccaaccgacggacgacgaccgaccccaaactactacgttagttttacgtttttaggactttaccgtacgtaaccttaaacgttcccgtacccgttacgggtttacggggtttcgtacggtaccgtttccgttacctttcgtcggttaccgtcttaccgtaacgttaccgtacgtaacccgtaacccgtacccggtaccccgtacccgtacgtaccttacgttcccggttccgttccggtacccgtacggacggtaccggtaagggaccgggacggtacggtacgttagtttactttacgtttacgttcggtacgacgttacctaacggtaacttaacgtaaccgtaacgtacgaaccggtccgtaacccgttcccgtttaacccgttttacccggtttaccgggtttaacccggtttaacggggttaaacccggggtttaaccggggtaaaaccccggttaccgggttaaaccccggtacccgtttaaaccccgggttaccccggtacggtaaaccccggtaacccccggtaacccgtaaacccccgttaaaaccccccgg

SEQ ID NO: 125451 - DNA, 525 bp, Homo sapiens
  misc_feature: GYAE6OF02F6CN5.12.85.H08.1.454.CMB.1.raw
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaatcctgatttatgaggtcactattcggtcctcaggaatttcaatcgcttctctggttccaagtctggcaacacggcctcctgaccatctcgtggggtccaggctggaggacgaggttgattattactgcagttcaatatacaagcacttccacttctcgtggtgttcggcggtggaccagctgaccgtctaagtcagcccaaggcctcgcccctcggtcactctcgttcccgcctccg

SEQ ID NO: 125452 - DNA, 538 bp, Homo sapiens
  misc_feature: GYAE6OF02H3ESJ.12.85.H08.1.454.CMB.1.raw
  modified_base (212)..(212): a, c, t, g, unknown or other
  misc_feature (212)..(212): n is a, c, g, or t
  modified_base (320)..(320): a, c, t, g, unknown or other
  misc_feature (320)..(320): n is a, c, g, or t
  modified_base (434)..(434): a, c, t, g, unknown or other
  misc_feature (434)..(434): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctctggacagtcgatcacctatttccngccaccggaacaatagtgacgttggtcgttataactttgtctctggtacaaacagcaccaggcaaacgccccccaatcctagtatttatgagtcactattcggtcctnaggtaatttctaatcgtcttctcttggttaccaagttctggacaaccgacggcctccctcgaacctatcctcgtggggtccagggtctggacggacgaggctagtattattacngactagttcatataacaagtcacttccactcgtcgtgtcgtcggcgtggacagctgaccgtctagtcacgccaagtcctcgcccctgcactctccgtcccaccc

SEQ ID NO: 125453 - DNA, 558 bp, Homo sapiens
  misc_feature: GYAE6OF02I4F5P.12.85.H08.1.454.CMB.1.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
tcagatacgacgtacacgaccggtgctcgatttagtatcactcagtcgcggggggtcgtcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngcacggaaccaatagtgacgttgtcgttanactttgtctctggtacaacagcaccaggcaaacgccccccaatcctcgatttatgaggtcactatcggtctcaggtaatttctaatcgcttctcttggttccaagttcctggacaactacggcctcctgaccatctcgtgggtaccaggctgaggacgaggctagattatactgctagttcattataacgaagtacacttcacttctcgtggtgttcggcggttagggacaaagtctagaccgttacctaaggtccacggtccgaaacggccttcgacccccttcgggtacctaccgtcctttcgttccccgtcccg

SEQ ID NO: 125454 - DNA, 521 bp, Homo sapiens
  misc_feature: GYAE6OF02GKT9Q.12.85.H08.1.454.CMB.1.raw
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagatacgacgtacacgaccggtgctcgatttagtatcactcagtcgtgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctgtacaaacagcaccaggcaaacgccccccaactcctgatttatgaggtcactattcggtcctcaggatttcaatcgcttctctggttccaagtctggcaacacggcctcctgaccatctcgtggggtccaggctggaggacgaggctgtattattacngctagttcattanacagctacttcactctcgtggtgttcggcggtggaccaagctgaccgtctaagcacgcccaaggcctcgcccctggtccactctcgtcccaccc

SEQ ID NO: 125455 - DNA, 510 bp, Homo sapiens
  misc_feature: GYAE6OF02II6SK.12.85.H08.1.454.CMB.1.raw
  modified_base (361)..(361): a, c, t, g, unknown or other
  misc_feature (361)..(361): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcaggacacagggtcctgggcccaatctgccctgactcagcctgcctccgtgtctgggtctcctggacagtcgatcaccatttcctgcaccggaaccaatagtgacgttggtcgttataactttgctcctggtacaacagcacccaggcaaacgccccccaactcctgtatttatgaggtcacttattcggtcctcaggaatttctaatcgcttctctggttccaagtctgcaacncgcctcctgaccatctcgtgggtccaggctgaggacgaggctgattattactgctagttcatatacaagcactcactctcgtgtgtcggcgtggaccagctgccgtctagtcacgccagctcgccccgtgtccactctcgtcccgtccc

SEQ ID NO: 125456 - DNA, 638 bp, Homo sapiens
  misc_feature: GYAE6OF02GVCQU.12.85.H08.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (321)..(321): a, c, t, g, unknown or other
  misc_feature (321)..(321): n is a, c, g, or t
  modified_base (471)..(471): a, c, t, g, unknown or other
  misc_feature (471)..(471): n is a, c, g, or t
tcagatacgacgtacacgaccggtgctcgatttagtatcactcagtcgcggggggggtctcagggacggcagcgcctctcaggacactctccaccatggcctgggctctgctgctccgtcaccctcctcactcgagggcacagggtcctgggacccaagtctcgccctgactcagcctggcctccgtgtctgggtctcctggacagtcgagtccaccatttccngtccaccggaaccaagtgtgacgttgtcgttatacttgtctcctggtacaaacngactaccgaggccaaacgccccccgaatccctaggactttagngtaggtctacgtagttccgggtcctacgaaggtaactttctaatccgacttctcgtacgttacagtctcggacaactacggcctccgtgtacctattcgtcggtcgggtaccacgtcgtaggacggacgacggtctagtactttagtcgngacgttagtacaattacaaccgagtcctacgtaccacttcgtcggtgttcggttcgggcggtacggaccaggtccgtacgtaccgttacctacggtcaacggacccgtaagtcccgtacccgtccccgttcggtacctaccgttcggttcccggtccccgtaccccg

SEQ ID NO: 125457 - DNA, 519 bp, Homo sapiens
  misc_feature: GYAE6OF02F6MJ5.12.85.H08.1.454.CMB.1.raw
  modified_base (303)..(303): a, c, t, g, unknown or other
  misc_feature (303)..(303): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaacgccccccaactcctgatttangaggtcactattcggtcctcaggaatttctaatcgtcttctctggttccaagtctggcaacacggcctccctgaccatctcgtggggtccaggctggaggacgaggctgattattactgcagttcatatacagctacttccatctgtgtgttcggcgtggaccagctgaccgtctagcagcccaagctcgcccctggtccactctcgtccctaccc

SEQ ID NO: 125458 - DNA, 518 bp, Homo sapiens
  misc_feature: GYAE6OF02G6JHR.12.85.H08.1.454.CMB.1.raw
  modified_base (412)..(412): a, c, t, g, unknown or other
  misc_feature (412)..(412): n is a, c, g, or t
tcagatacgacgtacacgaccggtgctcgatttagtatcactcagtcgcgggtggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacgcctcctgaccatctctgggtccaggctgaggcgaggctgattattacngcagttcatatacaagcattcccatctcgtggtgttcggcggtggaccaagctacgaccgtccgtaagtccagcccaagctcgcccctggtccactctcgtacccc

SEQ ID NO: 125459 - DNA, 536 bp, Homo sapiens
  misc_feature: GYAE6OF02JJZSL.12.85.H08.1.454.CMB.1.raw
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcttataactttgtctcctggtacaacngcaccaggcaaacgccccccaatcctgatttangagtcactattcggtcctcaggtaatttctaatccgtcttctntggtccaagtctggcaacacggcctcctgaccatctctgggtccaggtctgaggacgaggcttgattatactgctagttcattacacaagctacttccactctcgtgtcgtcggcggttggaccaagctacgacgttcctaagtcacgcccgaagccgtaccgccccgtggtcctaccgtctccgttccccaccc

SEQ ID NO: 125460 - DNA, 527 bp, Homo sapiens
  misc_feature: GYAE6OF02GT7MD.12.85.H08.1.454.CMB.1.raw
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (463)..(463): a, c, t, g, unknown or other
  misc_feature (463)..(463): n is a, c, g, or t
  modified_base (511)..(511): a, c, t, g, unknown or other
  misc_feature (511)..(511): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacngcacccaggcaaacgccccccaactcctgatttangaggtcactattcggtcctcaggtaatttctaatcgcttctctggttccaagtctggcaacncggcctcctgacccatcctcgtcggggtccaggctgaggacgaggctgattattactgctagttcatataacagctacttccactctgtgtgttcggnggtggacagctgacctctacgtcagcccaaggcctcgcccctggtccnctctcgtccccgtccc

SEQ ID NO: 125461 - DNA, 520 bp, Homo sapiens
  misc_feature: GYAE6OF02IM60I.12.85.H08.1.454.CMB.1.raw
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttgtcgttataactttgtctcctggtacaaacagcacccaggcaaacgccccccaatcctgatttatgaggtcactattcggtcctcaggtaatttctaatcgcttctctggttccaagtctggcaacacggcctcctgaccatctcgtgggtccaggctgaggcgagctagtattatactgctagttcatatacaagcacttcactctcgtgtgtcggcgtgggacaagtctcgaccgtactagtcacgccaaggcctcgcccctggtccactctcgtccctccc

SEQ ID NO: 125462 - DNA, 556 bp, Homo sapiens
  misc_feature: GYAE6OF02G3FOF.12.85.H08.1.454.CMB.1.raw
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (366)..(366): a, c, t, g, unknown or other
  misc_feature (366)..(366): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacngcacccaggcaaacgccccccaactcctgatttangaggtcactattcggtcctnaggtaatttctaatcgtcttctctggttccaagtctggcaacncgcctcctgaccatctcgtggggtccaggctgaggacgaggctgatttattacgtgctagttcattatacaagtcacttccacttctcgttggttgtcggtcgggtggaccaagtcctaggacccgtccgtaagtcacgacccaaggtcctccgcccccgttggtccaccgttccttcgtcccctacccg

SEQ ID NO: 125463 - DNA, 517 bp, Homo sapiens
  misc_feature: GYAE6OF02GM8NX.12.85.H08.1.454.CMB.1.raw
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
tcagatacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctctggtacaaacngcacccaggcaaacgccccccaactcctgatttangaggtcactattcggcctcaggaatttcttatcgcttctctggttccaagtctggcaacacggcctcctgaccatctctggggtccaggctgagcgaggctgattattactnctagttcattanacaagcacttcactctcgtggtgttcggcggtggaccaagctgaccgtctaagtcacgcccaaggctcgcccctggtcactctcgtccctccc

SEQ ID NO: 125464 - DNA, 603 bp, Homo sapiens
  misc_feature: GYAE6OF02ILXYG.12.85.H08.1.454.CMB.1.raw
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagccaccaggccaaacgcccccccaactccctgtactttatgaggttcactatttccggtcctcgaaggtaattttctaattcgctttctcttggttccaagtctggcaacacggcctcctgaccatctcgtcgggccagggctggaggacgaggtctagtaatttattacgtgctagttcaattataacagtccactttcccacttctcggtggttggttccgggcggttcggggaacctaaggctacggacccgttcgtaacggtccacgcccgaaggtccctaccggtcccccctacgggtcctaccgtcccttccggttaccccctaccccg

SEQ ID NO: 125465 - DNA, 700 bp, Homo sapiens
  misc_feature: GYAE6OF02JDVJS.12.85.H08.1.454.CMB.1.raw
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngccaccggaaccaatagtgacgttggtcttatacttttgtctcctggtaacaaacngaccaaccaggacaaacgccccccaactcctagtactttatggacggttcacttagttccggtcctactaggtaatttctaatccgtcttctctcggttcaagtctggacaacgacgcctcctagacctatctcgtgggtccagggtctggaggcgaggtctagtaatttactacgtcggtactacgtttacagttaaactacgaaacgttcctaacctttccaaccgttccggttacgggtttggttaccgggtttccgggggacgggttaccgggaaaccctaagggttcccttaccgggtaccccgtttacggttaacgtcccgtaacgggacccccgttaaacgggggtccctcccgggttaccccccccgtttggggtacccttaacccgtttcccggttcccggtttaccccccccgttccccg

SEQ ID NO: 125466 - DNA, 504 bp, Homo sapiens
  misc_feature: GYAE6OF02JTTD5.12.85.H08.1.454.CMB.1.raw
  modified_base (300)..(300): a, c, t, g, unknown or other
  misc_feature (300)..(300): n is a, c, g, or t
  modified_base (415)..(415): a, c, t, g, unknown or other
  misc_feature (415)..(415): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaatcctgatttangaggtcactattcggtcctcaggattcaatcgcttctctggtcagtctgcacacgcctcctgaccatctcgtgggtccaggctgagacgaggctgattatactgctagttcatanacagcacttcatctcgtgtgttcggcggtggaccagctcgaccgtactagtcagccaaggctcgcccctggctacgtctcgtccctacc

SEQ ID NO: 125467 - DNA, 550 bp, Homo sapiens
  misc_feature: GYAE6OF02ISS0Z.12.85.H08.1.454.CMB.1.raw
tcagatacgacgtacacgaccggtgctcgatttagtatcactcagtcgcggggggggtcacaagaggcagcgctctcgggacgtctccaccatggcctgggctctgctgctcctcactctcctcactcaggacacagggtcctgggcccagtctgccctgactcagcctgccctccgtgtctgggtctcctggacagtcgatcaccatctcctgcactggaaccagcagtgatgctgggagtgataagtttgtctcctggtaccaacatcacccaggcaaagcccccagactcatgatttatgaggacaaaaacggccctcgggatttctaatcgcttctctggctccaagtctggcaacacgcctccctgacaatctctgggctccgaggctgaggacgacggctgatttattactgtctgctcatatgcgtaggtagtggtctactttcgactacgttacgttcggtaccgggacggggtaaccctaaggtccgtacggtacccgttaccgttaccggtccaacggaccccgaagggtcctaccccgg

SEQ ID NO: 125468 - DNA, 559 bp, Homo sapiens
  misc_feature: GYAE6OF02IT4GO.12.85.H08.1.454.CMB.1.raw
  modified_base (213)..(213): a, c, t, g, unknown or other
  misc_feature (213)..(213): n is a, c, g, or t
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngcaccggaaccaatagtgacgttggtcgttataactttgtctcctgtacaaacngcacccaggccaaacgccccccaaatcctgtatttangtaggtcacttagttccggtcctcgaggtaatttctaatcgcttctctgttccaagtcnggcaacacgcctcctgaccatctcgtgggtccaggctgaggcgaggtctgtattattcgtgctagttcatatacagtccacttccactctcgtgtgtcggcggtcggaccagtctacgtaccgtactaagtccacgacccgaaggtcctccgcccccgttcggtacctaccgtccgtttccccgtcccccttaccg

SEQ ID NO: 125469 - DNA, 628 bp, Homo sapiens
  misc_feature: GYAE6OF02GH7AE.12.85.H08.1.454.CMB.1.raw
  modified_base (615)..(616): a, c, t, g, unknown or other
  misc_feature (615)..(616): n is a, c, g, or t
  modified_base (619)..(620): a, c, t, g, unknown or other
  misc_feature (619)..(620): n is a, c, g, or t
  modified_base (623)..(628): a, c, t, g, unknown or other
  misc_feature (623)..(628): n is a, c, g, or t
tcagatacgacgtacacgaccggtgctcgatttagtatcactcagtcgcggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattaccaagaaaacactgtatctgcaattaaccagcctgagagtcgaggacacggcccttttattactgtgcgaaggatccgcccctataactggtggctgggatcggggagtttggttccgtggggccaggggtaaccctggtccaccgtctccgtcacgccctcccgaccgaacgggccccagttccggtcccttcccccgtcggccctacccctccctacccgaaacgacgccctaacccgtccgtcgggggccaccgacggcccgggcccgttcgggcctcggcccgttcgggtacgaacgggtaccttaccgttccgttacggtccgttaagttcctggtacggccggggtcgtcgggacgtacgggccgacgtaacgtacgnntgnncgnnnnnn

SEQ ID NO: 125470 - DNA, 525 bp, Homo sapiens
  misc_feature: GYAE6OF02GW82Y.12.85.H08.1.454.CMB.1.raw
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaacgccccccaactcctgatttangaggtcactattcggtcctnaggtaatttctaatcgcttctctggttccaagtctggcaacacgcctcctgaccatctctggggtccaggctgaggacgaggctgattattactgctagttcattatacaagccacttccactctcgtgtcgttcggcgtggacaagcctagacctcaagtcagcccaaggcctcgcccctcggtcacgtctcgtccctaccc

SEQ ID NO: 125471 - DNA, 572 bp, Homo sapiens
  misc_feature: GYAE6OF02I5D6C.12.85.H08.1.454.CMB.1.raw
  modified_base (212)..(212): a, c, t, g, unknown or other
  misc_feature (212)..(212): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (438)..(438): a, c, t, g, unknown or other
  misc_feature (438)..(438): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctcgtgtctgggtctcctggacagtcgatcaccatttccngcaccggaaccaatagtgacgttggtcgttataactttgtcctctggtaacaacagcacccaggacaaacgccccccaactcctgatttangagtcactnttcggtcctacaggtaatttctaatcgcttctctggttccaagtctaggaccaacacggccctcctgacctatctcgtcgggtaccaggctgaggacgaaggctagtattattacgtgactgttanattataacagtcctacttccacttccgttcgtgggttgttaccgggcgggtaggaccaagctacgaccgtctaacgtcacgacccgaggtccgtccggccccgttgtacctaccgttcttccgtccctaccccg

SEQ ID NO: 125472 - DNA, 574 bp, Homo sapiens
  misc_feature: GYAE6OF02HIFDC.12.85.H08.1.454.CMB.1.raw
  modified_base (212)..(212): a, c, t, g, unknown or other
  misc_feature (212)..(212): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (390)..(390): a, c, t, g, unknown or other
  misc_feature (390)..(390): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacatttccngcaccggaaccaatagtgacgttggtcgttatactttgtctctggtacaacngcaccaggacaaacgcccccaatcctgattangagtcactattcgtcctcagtatttcaatcgcttctctgttccagtctgacacncgcctcctgaccntctcgtgggtccaggctggacggacgnggctgtatttagttactgctagttcatactacagctaccttccacttcgtcggttcggttcggttccggcgggttacggacctaaggtccgtacggtacccgttaccgtacggtccacggtacccgaacggtcccgtcccggtccccctacggtcccactttcccgttccgttcccctaccccg

SEQ ID NO: 125473 - DNA, 623 bp, Homo sapiens
  misc_feature: GYAE6OF02H2TB3.12.85.H08.1.454.CMB.1.raw
  modified_base (275)..(275): a, c, t, g, unknown or other
  misc_feature (275)..(275): n is a, c, g, or t
  modified_base (394)..(394): a, c, t, g, unknown or other
  misc_feature (394)..(394): n is a, c, g, or t
tcagatacgacgtacacgaccggtgctcgatttagtatcactcagtcgcgggggggggtcgtcaggaggcgagcgctcctcaggacatctccaccgatggcctgggctctgctgctcctcaccctcctcactcagggcacagggtcctgggcccaatctgtccctgactctagtacctgcctccgtgtctgggtctctggactaggtcgatcaccgtatttccgtgccaccggaaccagtagtgacgttgtcgttatactttgctcctgtacaangcaccaggacaaacgtcccccaactcctagtattatgaggtcacgtagtcggtctcgaggtatttactaattcgtcttctcgtcggttccaagttctagacaacgcgcctcctgacctntcgtcgtcgggtcctaggctggacggacggtacggctaggtacttaacgttaacgtcgtacgttagttacgtaatataaccgaagtaccacgttccaactcgtacgtgggttcgtcgggtcggtcggaacctaagtccgtagtacccgttactacgttcaaccggtacctaaaggcccgtacccgtccccgttcggacttaccggtccgttccgttaccccctacccgg

SEQ ID NO: 125474 - DNA, 613 bp, Homo sapiens
  misc_feature: GYAE6OF02HI71H.12.85.H08.1.454.CMB.1.raw
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
tcagatacgacgtacacgaccggtgctcgatttagtatcactcagtcgcggggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatccacctatttcctgccaccggaaccaatagtgacgttggtcgttatactttgtctctgtacaacngcaccaggacaacgcccccaactcctgtattangaggtctactagttcgtcctcaggtattctaatcgtcttctctggtaccagtctggacacacgcctcctgacctatctcgtcgggtccaggctgaggagcggctagattatactgactagttcataactacaagtcctaaccttcccacttccgtacgttggttcggttcgggtcgggttacgggaaccgtaaggtccgtacggtacccgttacgtaaccggtcgaaccggtacccgtaacggtacccgttcccggtccccccgttacgggtaccctacccgttcccgttaccccgttccccctaacccccg

SEQ ID NO: 125475 - DNA, 611 bp, Homo sapiens
  misc_feature: GYAE6OF02HAXUQ.12.85.H08.1.454.CMB.1.raw
  modified_base (270)..(270): a, c, t, g, unknown or other
  misc_feature (270)..(270): n is a, c, g, or t
  modified_base (382)..(382): a, c, t, g, unknown or other
  misc_feature (382)..(382): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttcctgccaccggaaccaatagtgacgttggtcgttataactttgtctcctggtacaaacngcacccaggcaaacgccccccaatcctgatttatgagtcactattcggtcctcaggtaatttctaatcgtcttctctgttccagtctggacaacgcggtccctccctgaccnttcctcgtcggggtccaggcgtggaggacgaggctgtatttattactgctagttcaattactacaacgtcctacctttccacttccgttcggtcggttcggttcggggcgggttacgggaaccaacgtccgtacggtacccgttaccgtaaggttccaacggcccgtaagggtcccttccggcccccgttcgggtccctaccggtcccgttccggttcccccgtccccg

SEQ ID NO: 125476 - DNA, 531 bp, Homo sapiens
  misc_feature: GYAE6OF02GK647.12.85.H08.1.454.CMB.1.raw
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngcaccggaacaatagtgacgttggtcttataactttgctcctggtacaacngcaccaggcaaacgcccccaactcctgatttangaggtcactattcggtcctnaggtaactttctaatcgtcttctctcggttaccaagtctgcaacgcggcctcctgaccatctcgtcggggtccaggctggaggaccgaggctagtattactactgctagttcatatacagctacttccatctcgtgtgtcggcggtggacagctcgaccgtctagtcacgcccgaagcctccgccccgtggcctacgtcgtcgttccccgtccc

SEQ ID NO: 125477 - DNA, 632 bp, Homo sapiens
  misc_feature: GYAE6OF02HNF8Y.12.85.H08.1.454.CMB.1.raw
  modified_base (212)..(212): a, c, t, g, unknown or other
  misc_feature (212)..(212): n is a, c, g, or t
  modified_base (264)..(264): a, c, t, g, unknown or other
  misc_feature (264)..(264): n is a, c, g, or t
  modified_base (423)..(423): a, c, t, g, unknown or other
  misc_feature (423)..(423): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacatttccngcaccggacaatagtgacgttggtcgttataactttgtctctggtacaaacngcaccaggcaaacgccccccaactcctagatttatgaggtcactattcggtcctcaggtaatttctaatcgcttctctggttccaagtctggcaacgcggcctcctagacctatctcgtcggggtccaggtctaggaggacgaggctggatttattacngactagttacagttaactacaacgtctaccgttccaacttcgttcggttggttcggttcgggcggttacgggaacccaagtccgttacggacccgttaccgttaaggtcccaacggtccccgtaaaggtcccgttacccgggtaccccccccgtttgggttacccctaacccgtttcccgtttaccccggtttccccccgtaccccccg

SEQ ID NO: 125478 - DNA, 582 bp, Homo sapiens
  misc_feature: GYAE6OF02IYW6B.12.85.H08.1.454.CMB.1.raw
  modified_base (268)..(268): a, c, t, g, unknown or other
  misc_feature (268)..(268): n is a, c, g, or t
  modified_base (434)..(434): a, c, t, g, unknown or other
  misc_feature (434)..(434): n is a, c, g, or t
  modified_base (450)..(450): a, c, t, g, unknown or other
  misc_feature (450)..(450): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgcccctgacctcagcctgcctccgtgtctgggtctcctggacagtcgatcacctatttcctgccaccggaaccatagtgacgttgtcgttatactttgtctcctggtacaacngcaccaggcaaacgcccccaactcctgtactttatgaggtcactattccggtcctacacggtaatttctaatcgtctttctctcggttcctaacgtctggtacaactacgtccctcctacgaccctatctacgtcgggcctagccgtgacggcgaggcgtgaattntactgctagttatatntaacagctactccacttctggtcgtcggttcgcgggttacggacagtactcggtacctcgtaacgtctacgaccgtaacggtcgtaccgccccgttaccggtcctactccgttccgtacccttaccccccgg

SEQ ID NO: 125479 - DNA, 623 bp, Homo sapiens
  misc_feature: GYAE6OF02HF5IW.12.85.H08.1.454.CMB.1.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (431)..(431): a, c, t, g, unknown or other
  misc_feature (431)..(431): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttcctgccaccggaaccaatagtgacgttggtcgttataactttgtctcctggtacaaacagccaccaggaccaaacgcccccccaatccctgtatttangaggtcacttattcgtcctnaggtaatttctaatcgtcttctctcggttacaagtctgcaacncgcctccncgaccatctcgtcgggtcaggctgacggacgaggctgtattacgttacgtncgtagttcaattaactacaaacgtcctaaccgtttacccacttccgttacggtggtttcggttccgggtacgggtccgggaaacctagtcccgtagtacccgttacgttaacggtccaaccggtacccggtaacggtccgtcccgccccccggttcggtccctaaccgttcgttacccgttacccctacccg

SEQ ID NO: 125480 - DNA, 828 bp, Homo sapiens
  misc_feature: GYAE6OF02HY32B.12.85.H08.1.454.CMB.1.raw
  modified_base (227)..(227): a, c, t, g, unknown or other
  misc_feature (227)..(227): n is a, c, g, or t
tcagatacgacgtacacgaccggtgctcgatttagtatcactcagtcggcggggggggggtctcaggaggcagcgctctcaggacatctccaccatggcctgggctctgctgctcctcaccctctcactcagggcacgagggtcctgggcccaatctcgccctgactcagcctcgcctccgtgtcgtcgggtcctccgtggacacgtcgatccaacctagttttccngaccgaaccggaaccaagttagtcgtacggtttggtacgtttaattacgttttcgtcttccgttacggtaacaaacgacgaccacccgacggaccaaacccgacccccccaacgttccctaggttactttacgtggtacggttacctaacgttacgttccggttaccttacgtaacggtttaactttacttaacgtccgtctttccgttccgttacggtttacccgtaacgttccggtacgggtaacctaacccggtaacccggtcccgttaccccgttaccggtaaccctaccgttcccggttaccggttccgggggtacccgtacggggtacgttacggggaacgggtaccgggaccggtagttaggttaaacttttacgtaccgttacggtacgttaacgttactaaacgttactaaaccgtaacgtaccgtacccttaccgtaaccgtttcgttacgggttcgggtttcggttaccgggtcgggttacggaccgtaacgtcgtacgtacccgttacgtacggaccaccggtaccgaacgtttcccgacccgttccccggcgttaccgttacccgtcgttaccccggtacccttcccg

SEQ ID NO: 125481 - DNA, 539 bp, Homo sapiens
  misc_feature: GYAE6OF02GQ1QB.12.85.H08.1.454.CMB.1.raw
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (363)..(363): a, c, t, g, unknown or other
  misc_feature (363)..(363): n is a, c, g, or t
  modified_base (409)..(409): a, c, t, g, unknown or other
  misc_feature (409)..(409): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngccaaccggaacaatagtgacgttggtcttataactttgctctgtacaangcaccaggcaaacgccccccaatcctgactttatgacggtcactattcggtcctcgagtatttcaatcgcttctctgtccagtctgcacacgcctccgnaccatcctcgtcgggtccaggctggaggcgagctagtattatacgnctagttcatatacagctactcactcgtcgtgtcggtcggcggtacgggacaagtctacgaccgttctagtccacgtacccaacggcctaccgcccccgttggtcctaccgtccgttccgtccccgtcccc

SEQ ID NO: 125482 - DNA, 760 bp, Homo sapiens
  misc_feature: GYAE6OF02H6461.12.85.H08.1.454.CMB.1.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctctcatcagggcacagggtcctgggcccaatctgccctgactcagcctgcctccgtgtctgggtcctccgtggacagtcgatcacctatttccngccaaccggaacaatagtgacgttggtcgttatacttgtctctagtacaacngcaccagacaaccgcccccaactcctagtattagtgtacggtctactacgttacggtcctacgaggttaacttttactaagtctctttctcgttacggttacctaaggttccgtacggaccaaccgtacccggtcccttaccccgtacgtaaccctacttccgtaccggttcgggggtacccgtagggtccgtacggggaacgggtacggtacgggtaccgttagttaactttacttaacggtcgtaccgttaacgtttaccgtaaattaaacgttaaccgtaaacgtccttaaacccgttcccttaaccgtttcgttcgggtttacggggtttcggttcccgggggtacgggttacggggaaccctagggtccgttacggtaccccgttacgttaacggtccgaacccggtacccgaacggttcccctcccggttacccccgttacggtacccttacccgtttcccgttaccccggttacccccttacccccg

SEQ ID NO: 125483 - DNA, 627 bp, Homo sapiens
  misc_feature: GYAE6OF02J0WBM.12.85.H08.1.454.CMB.1.raw
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
  modified_base (258)..(258): a, c, t, g, unknown or other
  misc_feature (258)..(258): n is a, c, g, or t
  modified_base (396)..(396): a, c, t, g, unknown or other
  misc_feature (396)..(396): n is a, c, g, or t
tcagatacgacgtacacgaccggtgctcgatttagtatcactcagtcgcggggggggtcgtcaggaggcagcgctctcaggacatctccaccatggcctgggctctgctgctcctcaccctcctcactcagggcacagggtcctgggcccaatctgccctgactcagcctgcctcgtgtctgggtctcctggacagtcgatcaccatttccngccacggaaccatagngacgttgtcgttatacttgctctgtacaangcaccaggacaaacgcctacccaactcctgtattactgagtcactattcggtcctcagtaattctaatcgtcttctcgtcgttacctagtctacggacaacgacgtcctcctagacctactctcgtcgggtacgcggntcgacggtacgacggtacgtgtactttacttacgtcgtacgttacgtactaagttactaacgaacgtacctaaccgttccctacttcccggttacggttcggttcggtttccgggtcgggtacggaacctacggtaccgtacgtaccggttaccggtaacgttaccgaaccgtacccgtaacggtccgtccgtccccggtcggttaccctacttccgtaccgttcccccgg

SEQ ID NO: 125484 - DNA, 553 bp, Homo sapiens
  misc_feature: GYAE6OF02FIAP1.12.85.H08.1.454.CMB.1.raw
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (439)..(439): a, c, t, g, unknown or other
  misc_feature (439)..(439): n is a, c, g, or t
tcagatacgacgtacacgaccggtgctcgatttagtatcactcagtcgcgggggggggtctcaggaggcagcgctctcaggacatctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggnaaagtcccccaagttaancatttatgaggcactaagcggccctnaggngtttctgatcgcttctctggctccaaggctggcgacggcctcccngacaatntctgggctcgnggctggaggacgaggcctcattactactgctgctcatatgggaggtttanagactacgttgggtgtttcgggcggacgggaccaaagggttcgacccgtactaaggtccaggtcccgaaggcctcgtcccccgtcggtacctactccttcgttcccctaccccg

SEQ ID NO: 125485 - DNA, 762 bp, Homo sapiens
  misc_feature: GYAE6OF02GN15D.12.85.H08.1.454.CMB.1.raw
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
tcagatacgacgtacacgaccggtgctcgatttagtatcactcagtcgcggggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngccaccggaaccaatagtgacgttggtcgttataactttgtctctggtacaaacngcaccaggacaaacgccccccaactcctagtatttatggaggtcaacttacgttccggtcctcgaggtaactttctaaattcgtctttcttcgttcggttaccaagttctgggacctaaaccgtacggtccctcccgtacggaaccctacttccgttacggttcgggggtccctacggggtcctagggacggtacggacgggtcgttaggtatttaacgttactcggtactagtttaccgaatttaacgtaaccgtaaaggtccaacggtaccgaacggtaccccttaaccccgtttgtttttacggttacccgtttaacggggtaaacgggtttaccggggtaaacccgttaaacgggttccccgtaacccgggttacccgttaaccggtcccgaaaccggtaccccgaaaaccgggtaccccctaaaccccccgtacgttaccggttacccctaacccgtttaccgtttcccggttaccccttaaccccg

SEQ ID NO: 125486 - DNA, 516 bp, Homo sapiens
  misc_feature: GYAE6OF02FHAEO.12.85.H08.1.454.CMB.1.raw
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (417)..(417): a, c, t, g, unknown or other
  misc_feature (417)..(417): n is a, c, g, or t
  modified_base (455)..(455): a, c, t, g, unknown or other
  misc_feature (455)..(455): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgctcctgtacaanagcaccaggcaaacgccccccaactcctgatttangagtcactatcggtcctnaggtaatttctaatcgtcttctctcggttccaagtctggacaacacggcctcctgaccatctcgtcgggtccaggctgaggacgaggtctgattattacngctagttcatactacaagtctacttcactctcgtggtnttcggcgtggacagctgactcaagtcacgccagctcgcccctggtccactctcgtcccacc

SEQ ID NO: 125487 - DNA, 920 bp, Homo sapiens
  misc_feature: GYAE6OF02JBLN1.12.85.H08.1.454.CMB.1.raw
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgccctccgtgtctgggtctcctggacngtcgatcacctatttccngccaccggaaaccaataggtagtacggttggttacgtttaattaacgttttgtccttccgtaggttaacaaacgcgaccacccgaggaccaaaccgccccccctaactccctagtaatttagtggtacggtacctaacttacgtttaccggtcctacgtaagggttaacttttaccgttaaacttccggtacttttccgttaccgttaccggtttaccgtaaacgttcgtacgggtacctaaaacccggtacccgggtccccttaccccgtacgtaaccccgtaactttcccgttccgggtttaccggggggttcccgacggggtccgtaacggggtaacgggtaccgggaacgggtacgtttacggttaaacttttacgttacctggtaccgttagttacctaattaacgtaaccgtaaacgtccttaaacccgttcccgttaaccgttcccggtttaccggtttaggggttttacccgggttttccggggtaaccggggtttccgggtaaacccgtaacggtccgtttaacccgggttaccccggttaaccggtttaacgggttaaccccgtaacccgggtaaaccccgttaaccggggtacccccgtttaccccgggttccccccccgggttacccgggttaaccctttacccccgttacccggtttttaccccccgttaccccccgtttaaccccccccgg

SEQ ID NO: 125488 - DNA, 698 bp, Homo sapiens
  misc_feature: GYAE6OF02IEFY4.12.85.H08.1.454.CMB.1.raw
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
tcagatacgacgtacacgaccggtgctcgatttagtatcactcagtcgcggggggggggtctcaggaggcagcgctctcaggacatctccaccatggcctgggctctgctgctcctcaccctcctcactcagggcacagggtcctgggcccaatctgccctgactcagcctgcctccgtgtctgggtctctggacagtcgatccacctatttcctgccaccggaaccaagtagtgtacgttggtcgttataactttgtctcctgtacaaacagccaccnggacaaacgtccccccaatccgtgaatttangcggtacactacgttaccgggtcctacgacggtaatttacctaagtccgtcttccttacgtggttaccaacgtcttacggcaaccgtaccggtccctccctcggaaccctacttccgtccgttcggggtcccaggtacgtacgggtaagggacggtacggaccttaggtacttaattaccgtagtctaacgttactaattactaacgtaacgacctaccgttccctaccttacgtccggttgggttcgtttccggggtccggtacgggtacccgtaaagtccgtacgtacccgttaaccgtacggtccgtacggtacccggaacggtccgtacccggtccccggttccggtaccttaccggtcccgttacccggttccccgtcccccg

SEQ ID NO: 125489 - DNA, 584 bp, Homo sapiens
  misc_feature: GYAE6OF02IXMAD.12.85.H08.1.454.CMB.1.raw
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
  modified_base (360)..(360): a, c, t, g, unknown or other
  misc_feature (360)..(360): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngccaccggaaccaatagtgacgttggtcgttataactttgtctcctggtacaaacngcaccaggacaaacgccccccaatccctagtattatgaggtcactattcggtcctcagtaattcaactcgtcttctctggttccaagtcnggacaacgacggccctcctgaccatcgtcgtcggggtccagggtctggaacggacgaggtctagtattaattactgactagttacagtataacgaacgtctaccgttctaactcgttcgtgttcggttcggcggtggaaccagctcgacccgttctaacggtcaccgtaccgaacggcctcccgtaccccgtcggtcctaccttccgttcccgtccctaccccg

SEQ ID NO: 125490 - DNA, 712 bp, Homo sapiens
  misc_feature: GYAE6OF02GSFVB.12.85.H08.1.454.CMB.1.raw
  modified_base (198)..(198): a, c, t, g, unknown or other
  misc_feature (198)..(198): n is a, c, g, or t
  modified_base (215)..(215): a, c, t, g, unknown or other
  misc_feature (215)..(215): n is a, c, g, or t
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacgagggtcctgggcccaatctgccctgactcagcctgcctcgtgtcgtgggtctccgtggacngtcatcacctatttccngccaccgaaccaatgtgacgttgtnttatactttcgctctgtacaacgacncaccgaggaccaaaccgaccccccaactcctagtatttagcggaggtccaacttacgttccggtcctacgaaggttaactttactaatcgtctttctcgtcggttaccaagtctggacaaccgccggtccctacccgtagacctacttccgttacggtcgggtaccagggtcctagggacggacggtaggtcgtagtaactttacgttaacgtcgtacgtacgtttacaacttaagtaaccaacgtaccttaacccttaccctaccgtttaccgttcgggtttacgggtttccggggtttaccggggtcggggttaacccgggaacttaaccgggtcgttaccggtacccgttaacgtacggtaacccggtacgacccggtaacgcccgttacccgcccccgtttcggacccttaccgtcccgtttacccgttccccttacccccg

SEQ ID NO: 125491 - DNA, 786 bp, Homo sapiens
  misc_feature: GYAE6OF02IL02S.12.85.H08.1.454.CMB.1.raw
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccgtctctgcacgtggacagtaatgtattttaggaatttgacctatctcctgtaccaacactaccccggacaaacgtccccaagttaactctaatttagtggacgggtacctaacgttaacggccggtaccctcgtacgggtacgttttctagacttcggtacctttctccgtggtcctaccgaacggtcgttcgggccggtaccccgggtcccttcccgtaggtaacctaacttaacgtcgtacggggccttaccgacgggtctacgggaacgggtaacggacgggtcttaccgtaactttaacctacgttcggccgttacgtccgttacttaagttacgttaggggaaggttttaactacgggtacttaccgggttttgggggtaccgggtttacccggggacgggttaacccgggggtaaacccgttaaaagggttcccggtaaaccccggttaccgttaaacggtacccggtaacccggtacccgtaaacggggtcccgtaccccggttacccccggttccggtaccccgttaccgttacccgtttccccggtttacccccctacccccgtttacccg

SEQ ID NO: 125492 - DNA, 695 bp, Homo sapiens
  misc_feature: GYAE6OF02FVLMK.12.85.H08.1.454.CMB.1.raw
  modified_base (215)..(215): a, c, t, g, unknown or other
  misc_feature (215)..(215): n is a, c, g, or t
  modified_base (273)..(273): a, c, t, g, unknown or other
  misc_feature (273)..(273): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctcgtgtctgggtctccgtggacagtcgatcacctatttccgngccaccggaaccaatagtagacgttggtcgttattaactttgtcctctggtacaaacngcaccaggaccaaacgccccccaatcctgtatttagtgaggtcacttattcggtcctacgagtactttactaatcgtcttctcttcggtactaagtctgaccaacgccggtccttcccgtagacctactccgtcggttccgggtccgtacggctacgggaacgggacgtagggcctagttacgttaagttaccgtgtaccgttagttactaacttaacttaaccgaacgtcccttaacgttccctaccgttaccgtttggttcgggtttacggttccggggtacggggttaccggaaccgtaacgtccggttaccgttaccctccggtaacgtcccgaacggaaccccggtaacggttcccgtacccggtccccggttaccggtccttaacccgtccgttaccccgtcccccttaacccccg

SEQ ID NO: 125493 - DNA, 553 bp, Homo sapiens
  misc_feature: GYAE6OF02GC6QU.12.85.H08.1.454.CMB.1.raw
  modified_base (214)..(214): a, c, t, g, unknown or other
  misc_feature (214)..(214): n is a, c, g, or t
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
  modified_base (465)..(465): a, c, t, g, unknown or other
  misc_feature (465)..(465): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngcacccggaacaatagtgacgttggtcgttataactttgtcctcctggtaccaacagccaccaggcaagcgcccccaaactcatgatttagtgaggcacgtaagccggcctcgtaggggtttcttatccgtcgttctctcggctcgagtctggaccaacncggcctccctgactaagtctcgtggcctcgaggcgtgaggacgnggcgtattatcgtgttcgnttatagtcgtcggtaggtagctattgtntgtccttagtcgtcggagacctagctacgaccgtcgtcggtacgccggacctacgtcgtaccgtcccgtccgtacgtcctcttacccg

SEQ ID NO: 125494 - DNA, 897 bp, Homo sapiens
  misc_feature: GYAE6OF02HVQP9.12.85.H08.1.454.CMB.1.raw
  modified_base (706)..(706): a, c, t, g, unknown or other
  misc_feature (706)..(706): n is a, c, g, or t
  modified_base (759)..(759): a, c, t, g, unknown or other
  misc_feature (759)..(759): n is a, c, g, or t
tcagatacgacgtacacgaccggtgctcgatttagtatcactcagtcgcgggggggggtctcaggaggcagcgctctcaggacatctccaccatggcctgggctctgctgcctcctccaccctcctcactcacgggcacgagggtcctcgggacccaatctcgccctgactcagcctcgcctccggtgtcgtgggtcctccgtaggacagtccgactccaacctatttccgagacccgaacccggaaacctaagttacggttacgtaccgggtttagttaccggttttaatttaaccgttttcggtaccttccgttaacgggtaacctaaaaccgaccgacccgaacccgaacggtaaccaaaccccggtaccccccctaacccttcctagtaacgtttacgtacggtaaccggttacctaacgttacggtttccggtacccttaacgtaaacggtttactttaccgtaacttccggtacctttccgttaccggtttaccgttaaccgtaacgttaccgtacggaacctaacccgtaccccggttaccctacccgtaacgtacccgtacttccggtacgggtaaccgggtccggacggtacggtaacggggacgggtaacgtacgggtcttaacgttaacgtttaactacggtcgtaacgttaacgtaacgttaactacgtaaacgtcctacctaccccgtttaanccggtttaggtcggtttcgggtacgggtttccggggacgttaccgggaaaccncgggttaacccgtccgttaaaccggttccgtaccgtaaccgggacccgtaaccggtaccgttccccgtaccccggtttcccgtacccggtaccttaaccccggttttcccggttccccccttaacccgtttaccccgg

SEQ ID NO: 125495 - DNA, 631 bp, Homo sapiens
  misc_feature: GYAE6OF02GMHDS.12.85.H08.1.454.CMB.1.raw
  modified_base (620)..(621): a, c, t, g, unknown or other
  misc_feature (620)..(621): n is a, c, g, or t
  modified_base (624)..(631): a, c, t, g, unknown or other
  misc_feature (624)..(631): n is a, c, g, or t
tcagatacgacgtacacgaccggtgctcgatttagtatcactcagtcgcggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaaagaaaacactgtatctgacaaattaaccagcctgagagtcgaggacacggccctttatactgtgcgaaggactcgcccctaataagtggtggctggagtcggggtagttttgggttccgtggggaccgaggggtaacccctggtccaccgtctcctcacgccctccaccgaacgggcccctacgtccggtcccttcccccgtcggaccctaccccgtcctacccgaaacgaccgccacccgtcggtaccgggggacctaccgaccggcccggcccgttcgggcctcggcccgtcggtaccgaacggtaccttaccgttccgtaccggttcgttacgttcgtacggacggtcgggcctacgggccaaggggtcccacgaagtaggcnngcnnnnnnnn

SEQ ID NO: 125496 - DNA, 697 bp, Homo sapiens
  misc_feature: GYAE6OF02ILM0I.12.85.H08.1.454.CMB.1.raw
  modified_base (272)..(272): a, c, t, g, unknown or other
  misc_feature (272)..(272): n is a, c, g, or t
  modified_base (339)..(339): a, c, t, g, unknown or other
  misc_feature (339)..(339): n is a, c, g, or t
tcagatacgacgtacacgaccggtgctcgatttagtatcactcagtcggcggggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatccacatctcctgccaccggaaccaatagtgacgttggtcgttaataactttgtctcctggtaccaaanacgccaccaggacaaacgccccccaactcctagtatttagtgaacggtccacgttacttcggtcctnaggtaatttctaaatcgtctttctcttcggttccaagtcgtcggacaacgacccggcctcccgtacgacctacttcctcggtagggtcccgtagggcctaagggacgggtacggtacggtacgttaggtaatttacgttaactggtacctaagttacctaagttaactaacgtaaactcctaccgttaccctaacttccgttacgggttgttcgggttaccgggtcgggtacggtaacccgaacgttccgttacgggtaacccgttacggttaaacgtcccgtacggtaaccccgaaggtcccgtaccccggtcccccggttcggtacccctacgttcccgttaccgttcccccccgg

SEQ ID NO: 125497 - DNA, 752 bp, Homo sapiens
  misc_feature: GYAE6OF02JB602.12.85.H08.1.454.CMB.1.raw
  modified_base (168)..(168): a, c, t, g, unknown or other
  misc_feature (168)..(168): n is a, c, g, or t
  modified_base (201)..(201): a, c, t, g, unknown or other
  misc_feature (201)..(201): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctcgccctgacctcngcctgcctccgtgtcgtgggtcctccgtggacngtcgatccgaccgtctcctgcacgtgggacctagtaatgtattttggaatttcgactgtctcctgtaccaacaacgtaccccggacaacgtacccctaaagttatctaatttagaggaacgggtacaacgttaacggcccggtccctacgagggtacgttttctaggtactccgtccttctccgtggacctacgtaacgggtctcgggacccgggtaccccgggtccctccctaggaactaaagttcctcggtcgggtacctccggaggtcgtaggacgggaacgtcggtctactaacgtttaccacgtcgcgttacgtcctactaagttgtaggtaacgtttatagtacgttacggtttggggttaccgtccgggggtaccgggtacccgggtaaaccgtaagggttacccgtaacccggttacccttaaagggtcccgtaacgggtaacccccgaagggtccccggtaccccggttaccccccggttacgggtccccttaaccggtttccccgtacccggtttacccccccgtacccgtttacccccgg

SEQ ID NO: 125498 - DNA, 611 bp, Homo sapiens
  misc_feature: GYAE6OF02FG20G.12.85.H08.1.454.CMB.1.raw
  modified_base (197)..(197): a, c, t, g, unknown or other
  misc_feature (197)..(197): n is a, c, g, or t
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (554)..(554): a, c, t, g, unknown or other
  misc_feature (554)..(554): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggacngtcgatcaccatttccngccaccggaaccatagtgacgttggtcttataactttgctcctggtacaacngcaccaggcaaacgccccccaactccgtnatttangtacgtctacttattccggtctcgaggtaactttctaatccgtacttctacttcggttccaaagttccgtacggcctaaaccgaccggtcccttaccctgaaccctattccgtccggttacggggacccaggtcctaggacggacgaacggtccttagactttagtactgactacggttcagttaactacaacgtcctaccttccacgttctcgttgttcgtcggcggttcgacagtctacgaccactaggcncgacccgaacgtccctaccccgtcgtccaccgttctcggttaccccgtcccttcccg

SEQ ID NO: 125499 - DNA, 697 bp, Homo sapiens
  misc_feature: GYAE6OF02GVZDF.12.85.H08.1.454.CMB.1.raw
  modified_base (179)..(179): a, c, t, g, unknown or other
  misc_feature (179)..(179): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtntctgggtctctggacagtcgatcacctatttcctgccaaccggaaccaagtaggtgtacgttggtcgttaattaacgtttgtcctctaggtaacaaacagaccacccaggaccaaacgccccccaactcctagtatttatggtacggttactacttacgttccggtacctacgtaaggtaactttactaacgtcgtacctttctccgttcgtacctaagttcgtcggaccaaccgaccggtccctcctcgacctactccttcggtcggggtacccagggtcgtacggaagggtacggaggtccgttagtaacttttagttacgtacgtacgtaagttcgtaataactaacaacgtactaccgtaccttactcttggttcggtggttccgggtcggtacgggaacctaacgtccgtacggtaccgtccgttaacgccgaaccgtacccggtaacggtcccgtacccggtccccgttacgggtaccctacccgttcccgttaccgtacccccgtaccccg

SEQ ID NO: 125500 - DNA, 886 bp, Homo sapiens
  misc_feature: GYAE6OF02H5JWS.12.85.H08.1.454.CMB.1.raw
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctctcactcagggcacgagggtcctgggcccaatctgccctgactcagcctgcctccgtgtctgggtctcctggacagtcgatcacctatttccngccaccggaacaatagtgacgttggtcttatacttgtctctgtacaangcaccaggacaacgcccccaactctagtattatgacggtctactacgttcggtcctacgaggttattttacctaattcgtcttccgttcgtcgtttccaacgttcgtacggtaccaaccgtaccggtcccttcccgtacgtaaccctacttccgttccggtcggggttcccgtacgggtccgtacggaacgggtaaccggtaaggtccggttaagttaaacgtttacgttaaaccggttcgttaccgttaacggtttaccttaaacgttaaacgttaaccctaaaaccgggtacccttaaacccgttttaccgttaacccgttacccggttttacccggggttttacggggttttacccggggtttttaccgggggttaccccggggggtttaacccgggggttaaacccgtaaaacccgggtccgtttaaccccgggtaaccccggggtttaaccccgttaaaccggggttaacccggtaaccccgggtaacccccggttaaaaccggggtttccccccgtaaccccgggtttaccccccccgggtttaccgggtaccccccgtttacccggtttacccccggtttttcccccgtttaaaccccccccgtttaacccccccgg

SEQ ID NO: 125501 - DNA, 641 bp, Homo sapiens
  misc_feature: GYAE6OF02FXZJY.12.85.H08.1.454.CMB.1.raw
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctcgtgtctgggtctccgtggacagtcgatccactattcctgcaccggaaccatagtgacgttgtcgttatactttgtctctgtacaacngcaccagcaacgcccccactcctgattangaggtcactacgttccgtcctcaggtaatttctaatcgtcttctacgtcgttaccaagtctaggccaacgccgtcctccctgacctactccgtcggtacgggtccgacgggctaggtacggacggtacggcgtagtaactttacttacgtacgtacgttagttactaagttaactaacgaatacccttaacttacccacttcgtcggttcggttcggtttcgggtacgggtacggtaaccgaaggttcgtaccgtaccgttaccgtaaccgtcgaccgtacccgaacggtcccgtacccggtccccgttcggtaccctacccgttccgttcccgtcccccgttacccccg

SEQ ID NO: 125502 - DNA, 631 bp, Homo sapiens
  misc_feature: GYAE6OF02IXCSY.12.85.H08.1.454.CMB.1.raw
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (476)..(476): a, c, t, g, unknown or other
  misc_feature (476)..(476): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggacagtcgatcacctatttccngccaccggaacatagtgacgttggtcttatactttgctctggtacaacngcaccagaccaacgcccccaactcctagtatttatggacgtctactacgttccggtcctagaagttaactttctaattccgtctttctcgttcggttacctaagttccgtacgggtaccaaccgtacccggtcccttacccgtacggaccctacgttccgtcggtcggggtccagggtcctggacggacgagggtctagtaatttataccgngtacgtagttactaattacgtaacacgtcctaccgttaccactcgttcgtggtcggttcgggcgtacggactagtcctacggtaccttacgtagtccacgtaccgtagccctaccggccccttaggtccacgtttccttcccgtaccccctcccg

SEQ ID NO: 125503 - DNA, 689 bp, Homo sapiens
  misc_feature: GYAE6OF02FKPN1.12.85.H08.1.454.CMB.1.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcacctatttccngccaaccggaaccaatagtgacgttggtcttatactttgtctctgtacaacngcaccaggacaaacgccccccaactcctgtactttatgagtctactattcggtcctgaggtatttctaatcgcttctcgttgtaccagtctggacctaacgaccggtcctccctgaccctacttccgtccgttcggggtcccaagggtccgtaggaacgggacgacgggtccttaggtaactttaacgtttacgtcggacttaaccggttctaattaactaacgaacgtcctaacctttcccaacgtttcgttaccgggtttggtttccggggttccgggtaccgggttacgggtaaccctaagggtccctaccgggtacccgttaccgttaacggtccaaccggaccccgtaaggtcccttacccgggacccccgtttccggtaccttaccgttcccgtttacccggttcccccgtcccccg

SEQ ID NO: 125504 - DNA, 671 bp, Homo sapiens
  misc_feature: GYAE6OF02HHOSM.12.85.H08.1.454.CMB.1.raw
  modified_base (303)..(303): a, c, t, g, unknown or other
  misc_feature (303)..(303): n is a, c, g, or t
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatctctgcacgtgggaccagcagtgatggttggacttataccttgtctctcggtaccaacaaccacccaggacaaacgccccaaactcatagtattanaggacgggacacgtaacggccggccgtcgtacgggttttctatcgtcttaccgtcgtcggtcctccgtagttcctgggaccaaccgtaccggtccctccctagacctaacttccgtcgtcgggccctaccggagggtccgtaggaacgggacgggacgggtccgggttaatttacgttaacgttcgttacgtacgttctaagttacggtgggtacgggtttagtacgtaccgttaccgtttacgtacgttacgtttcccgtaaggttccggggacgggtacggaccgtacgtccggtaccggttacccgtccggttcggacctaaccgggtacccgaagggtccctcccgggtaccccgtcgtacccg

SEQ ID NO: 125505 - DNA, 668 bp, Homo sapiens
  misc_feature: GYAE6OF02IGU0Q.12.85.H08.1.454.CMB.1.raw
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
tcagatacgacgtacacgaccggtgctcgatttagtatcactcagtcgcggggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggaccagtcgatcacctatttccngccaaccggaacaatagtgtacgttggtacttataactttgctcgtagtacaaacncgcaccagacaaacgcccccaatcctgtatttangtacgtcctaactagttccggtacctgaaggtatttactaatcgtcttctcgtcgttaccagttctggacaacgaccggtccctcctcgacctacttccgtcgtcggggtcctacggtcgtggtaacgggccggtaaggtccgttagttaaacttacgttacgtcggtacttacgttactaattaacttaaccgaactcctaaccttaccgtaccgttcgtccgggttggttcgggttcggtccggggtacggtaccgaacggttctaccggtacccgttaccgttacgtccgaaccgtaccggtacggtccctacccggtcccctacgggtcctaccgttccgtcccgtacccccgtccc

SEQ ID NO: 125506 - DNA, 872 bp, Homo sapiens
  misc_feature: GYAE6OF02JCI9M.12.85.H08.1.454.CMB.1.raw
  modified_base (138)..(138): a, c, t, g, unknown or other
  misc_feature (138)..(138): n is a, c, g, or t
  modified_base (223)..(223): a, c, t, g, unknown or other
  misc_feature (223)..(223): n is a, c, g, or t
tcagatacgacgtacacgaccggtgctcgatttagtatcactcagtcgcggggggggtctcgaggaggcagcgctctcaggacatctccaccatggcctggctctgctgctcctcaccctcctcactcacgggcacgngggtcctggacccaatctgccctgactcagcctcgcctaccgtgtctggtcctccgtaggacctagtcgatccacttatttccgngaccaaccggaactataggtcaccggtttaggtactttaattaaccgttttgtccttaccgttcggtaaaccaaacgtcgaccaacccgaacggtaccaaacccgtccccccaacttccctaggttaactttacgtaagtacggttcctaccgttaacgtttccgtacctacgtaaaggtttaaccttttacgttaagcccgtttacctttccgttcgttaccggtttaaccgaaagttccggtaggtaaccgttaaaccggtacccggttaccccttcggtaaccgtaccgtacttccgttccgggtaccggggttccacgtcgttacgggaacggtacggtacggtctagttaacgtttaacgttaccgtacggacttaacgttaacttaagttacccctaaagttaacccgtaccgttaccttacccgttaccgtccgggtttacgtccgggttttaccgggtcccgggttacggggttaaccggttaaccctaaccgggtacctttaccccgggtaaccgtttaacccggtaacgttaccggtaacccgtaccgggtaaaccgttcccgtaacccccgggtcccccggtttacggtaacccccgttccgttttaccccggttaccctttaccccggtaacccccc

SEQ ID NO: 125507 - DNA, 622 bp, Homo sapiens
  misc_feature: GYAE6OF02IBMD9.12.85.H08.1.454.CMB.1.raw
tcagatacgacgtacacgaccggtgctcgatttagtatcactcagtcgcggggggggggtctcaggaggcagcgctctcaggacatctccaccatggcctgggctctgctgctcctcaccctcctcactcagggcacgagggtcctgggcccaatctgccctgactcagcctgcctccgtgtctgggtctcctggacagtcgatcacctatttcctgaccaaccggaacaatacgtgacgttggtacgttattaactttgtctcctggtacaaacagccaccaggacaaacgcccccaatcctagtattatgaggtcactagttcgtcctcgagtatttctaatcgtcttctcttcgttaccaacgttcgtagacaacgccgtccctccctacgaccctagtccttacgtcggggtaccagggtcgtaggtacgggacgacggtctagtacttattactgcttaacgttactattacaatacgtcctaccttccacttcgttggtcgttaggttcgggtcggtaggtaccgaagccgtcgtaccgtcgtaacgtcgaaccgtccgtaacggctccccgtcccgttcggtacctaccgtccgttacccgttccccgtaccccg

SEQ ID NO: 125508 - DNA, 655 bp, Homo sapiens
  misc_feature: GYAE6OF02GFPJW.12.85.H08.1.454.CMB.1.raw
  modified_base (195)..(195): a, c, t, g, unknown or other
  misc_feature (195)..(195): n is a, c, g, or t
  modified_base (213)..(213): a, c, t, g, unknown or other
  misc_feature (213)..(213): n is a, c, g, or t
  modified_base (267)..(267): a, c, t, g, unknown or other
  misc_feature (267)..(267): n is a, c, g, or t
  modified_base (308)..(308): a, c, t, g, unknown or other
  misc_feature (308)..(308): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcgtgacngtcgatccactatttccngccaccggaactatagtgtacgttggtcgttaatactttgtctctgtacaaacngacaaccaggacaaaccgcccccctaactcctgactttagngacgtcacttattccggtcctagagtatttactatcgtacttcttcgtcgttaccgaagtcgtaggaccaacggaccgtccctaccgtacgacctacgttcgtccggttcgggtaccagggtctacgggaggaccggaggtccgttagtaactttacgtacgtgtcgttaagttactagttaatacgtaactcctacttcctacttcgtggtaggttcgggtccggtcgggttacgaccgtagtccgtacgtacccgtacgtacggaccgtacgaacccgggtacgttacccggtcccgtaccccggttcggtaacctccgttacccgttcccgtacccccgtcccc

SEQ ID NO: 125509 - DNA, 652 bp, Homo sapiens
  misc_feature: GYAE6OF02G3239.12.85.H08.1.454.CMB.1.raw
tcagatacgacgtacacgaccggtgctcgatttagtatcactcagtcgcggggggggggtctcaggaggcagcgctctcaggacatctccaccatggcctgggctctgctgctcctcaccctcctcactcagggcacagggtcctgggcccaatctgccctgactcagcctgcctccgtgtcgtgggtctcctggacagtcgatcacctatttcctgccaaccggaaccaatagtgtacgttggtcgttattaactttgtctcctggtaacaaacacgccaacccaggaccaaaccgccccccaactcctagtatttactggaaggtctaacgttacttccggtcctacgaggtaatttctaatcgtcttctcgtcggttaccaagtcgtaggaccaacgaccggtccctccctacgacctactccgtcggtcgggtccaggtccgtaggacgggacggagtctaggtatttacgtactcgtctaagttcataacgtacaagtacctacttacccacgttcgttcggttacggttcggttacgggcgggtacggaaccagtccgtacggtacccgtacgtacgtcaccggacccgtaacggtccgtcccgtccccgttacggtcctaccgttccgttcccgtcccgtccccg

SEQ ID NO: 125510 - DNA, 753 bp, Homo sapiens
  misc_feature: GYAE6OF02INADF.12.85.H08.1.454.CMB.1.raw
tcagatacgacgtacacgaccggtgctcgatttagtatcactcagtcgcgggggggggtctcaggaggcagcgctctcaggacatctccaccatggcctgggctctgctgcctcctcaccctcctcactcgagggcacgacgggtcctgggcccaatctcgccctgactcagcctgcctcgtgtcgtgggtctccgtggacagtcgactccaccgtctcctgcacgtggacctagtactgtagttttagtaatttgacctagtcctccgtacggtaccaaacaaccgtacccccggaactaaaaccgtcccctaaagtttaactaccgtaatttacgaggacgggtacctacggttaaccgggcccggtaccctacgtacggttagttttaccgtacggtacttccgtcctttcgtcgtacggtctaaccgaacgggtcgtacggcccggacccggtcccttaccggtactaacctaaagttccgtacggtcgggtacctaccgtcgggtacgtagggaacggtaacggtacggtaccttagttacttaaccgtcgttgtcttgtacctacgttaagttacggtagggtaggtttacacgtacggttacggtttggggtccggttacggggccggtaacggtaacgtaacggtccgtaaccgttactaacggtcgaacccgtaccgaccggtaccgttcccgtccccggtactaccgttccctaccggtttccccgtcccgttccctacccgg

SEQ ID NO: 125511 - DNA, 858 bp, Homo sapiens
  misc_feature: GYAE6OF02H1AKL.12.85.H08.1.454.CMB.1.raw
tcagatacgacgtacacgaccggtgctcgatttagtatcactcagtcgcgggggggggtcgtcgaggaggcagcgctctcaggacatctccaccatggcctgggctctgctgctcctcaccctcctcactcgagggcacgagggtcctcgggacccaatctgcccctgactcacgtcctgcccgttccgtgtaccgtgggtcctaccgtggaacagtcgatccaacgtctttccggaccgaaccgggaactaagtaggtcggtaaccggttggttacgttaattaaccgttttgtcctccgttaggtaacaaacgacgaccaaccgaacgaaccaaacccgtacccccctaaacgttcccgtaaggttaactttaacggtacggtaaccggttacctaacgtttaacggttcccgggttaacctaccgtaaaacggtttaaccttttaaccgtaaacgtttaccgtaccttttaccgtccgttttaacggttaaccccgtaaaggtttcccggttaacgggaaccgtaaaccccggtacccgggttacccctaaccccgggttacgaaaccctttaacgggtccctttcccgggggttacggggttaaccccgtggtaccggtacgggtaaccgggtaacgggtaccggtacgtacgttacgtttaacgttacgtacgtacgtacgttactactaactaactacgtactaaccgttactacgttccgtcggtcggttggtccccccggtaggtaccggtacgtacgtacgtaccgtaccgtacgtacgtcgtaccgtaccgaacgtccgtcccggtacccgtccgtaccgttaccgtccgttacccgtcccgttcccg

SEQ ID NO: 125512 - DNA, 708 bp, Homo sapiens
  misc_feature: GYAE6OF02GDHU9.12.85.H08.1.454.CMB.1.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgcccctgactcagcctgcctccgtgtctgggtctcctggacagtcgatcaccatttccngcaccggaaccaatagtgacgttggtcgttataactttgctctggtacaacngcaccagcaacgcccccaatcctgtattatgaggtcactatcgtctcagtattctaatcgtcttctcttgttaccaagttctggaccaacacggtcctcctgacctactcgtcgtcggggtacacgggtctaggacggacggacgtcgtagtactttaattaccgtcggtactacgttacgaattacgtaacctaacggtcctaacctttaccgtaaccgttccgttaccgggttagggtttcgggtttaccggggaccggggtttaccgggaaacccggttaaacggtccgtttaacccgggtacccggttaacccgttaaacgggtcccgtaaaccgggtaccccggtaaaccggtacccgttcccgggtacccccccgttacgggttaccccttaaccgtttcccgggttaccccggtttcccccggttaacccccccg

SEQ ID NO: 125513 - DNA, 709 bp, Homo sapiens
  misc_feature: GYAE6OF02G80H9.12.85.H08.1.454.CMB.1.raw
  modified_base (213)..(213): a, c, t, g, unknown or other
  misc_feature (213)..(213): n is a, c, g, or t
  modified_base (312)..(312): a, c, t, g, unknown or other
  misc_feature (312)..(312): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngccaccggaacatagtgacgttggtacgttataactttgtcctcctggtacaaacacgccacccacggacaaaccgccccccaactcctgacttttagngacggtctactagttccggtcctctaaggtaactttcgtaacttcgtctttctcgttcggtttaccaagtcgtacggcctaaacctaccggcccttccctacgaacccacttccgttcggtcggggttcccgagggccgttggacgggaccgtagggtcgtagtaacgtttacgttacgtcgtactaggttcaattaataacgtacgtcctaaccgttcccaacgttccgttacggttgggtttcggttaccggggcgggttaccgggaaacgtaaggtccgtacgggacccgttaaccggttacggtcccgaacggaccccggtaaggtcccgttcccggtacccccgttcgggtccctaacccggtttcccgttacccgttcccccctacccccg

SEQ ID NO: 125514 - DNA, 699 bp, Homo sapiens
  misc_feature: GYAE6OF02HI3NB.12.85.H08.1.454.CMB.1.raw
  modified_base (126)..(126): a, c, t, g, unknown or other
  misc_feature (126)..(126): n is a, c, g, or t
  modified_base (310)..(310): a, c, t, g, unknown or other
  misc_feature (310)..(310): n is a, c, g, or t
  modified_base (418)..(418): a, c, t, g, unknown or other
  misc_feature (418)..(418): n is a, c, g, or t
tcagatacgacgtacacgaccggtgctcgatttagtatcactcagtcgcgggggggggtctcaggaggcaggcgctctcaggacatctccaccatggcctgggctctgctgctcctcacccccctnactcagggcacagggtcctgggcccaatctgccctgactcagcctgcctccgtgtctgggtctccgtggacagtcgatcaccatttcctgccaccggaaccatagtgacgttgtacgttataactttgtctccgtgtacaacagcaccgaggaccaaaccgcccccctaatcctagtactttanggtacggttcacgttacgttccggtcctacgtaaggtaactttcgtaattccgtctttactcgttcggttccaagttctaggacaacgaccggccctcctagaacctnttcctcggtcgggtccaggtcgtaggacggtaccgaggtctagtactttacgttacgtcggtcttaacggttcaattacgtaacgtaacgtcctaaccttacccgtacttccggttacggtcggggttacgttccggggtcgggttaccgggaactacggtccgttacggacccgttaccgtaagtcccggaacggtaccccgtaggggtcccttacccggtcccccgttacggttaccaccgttttccggtaccccgttttacccccgaccctttcccgg

SEQ ID NO: 125515 - DNA, 811 bp, Homo sapiens
  misc_feature: GYAE6OF02IWMV1.12.85.H08.1.454.CMB.1.raw
  modified_base (564)..(564): a, c, t, g, unknown or other
  misc_feature (564)..(564): n is a, c, g, or t
  modified_base (589)..(589): a, c, t, g, unknown or other
  misc_feature (589)..(589): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctcgggcccaatctcgccctgacctcagcctcgcctccgtgtcgtgggtcctccgtggacacgtcgatccacctactttccgtgccgaacccggtaaacctaagttacggtcggtaaccggttttgggttaccgtttaattaaacgttttcgttccgttaccgttacggtaaaccaaacgacgtaccgaacccgtaaggaccaaacccgtacccccctaaaccgttcccgttaggtaactttaacgtacggaccggttactacgttacgttccggttaccgtacgtaacggtaactttactaacgtccgttcttactcgttacggttacctaagtcgtacgtaccgaacgtacccgtccctaccgtacgtacctacgttccgttaccgtccggggtacgacggttcgacggtaacgggacgnggtcttacgttactttacgttccgnggtaccttaggttactaacgttacgtaaccgacgttaccctaaccgtcccgttaagttccgttcggttacgggttcggtaccgggtaccgggttacggtaacgtaccgtccgttacggtacccggttacgttaacgaccggtaacctccgggtacccgtacgtaccccggttaccccgtcgggttacccacgttcccggtttccccggtccccgttaccccg

SEQ ID NO: 125516 - DNA, 666 bp, Homo sapiens
  misc_feature: GYAE6OF02F1ZBQ.12.85.H08.1.454.CMB.1.raw
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgctctggtacaaacngcaccaggcaaagcaaccccaatccngtatttanagaggtcacttattcggtcctacaggtaatttcgaaatcgtcttctctggttaccaagtctaggacaacacggtcctacccagaccctattccgtacgtacggggtccaggtcctaggtacgggacgacggtactgtaactttaacgttactggacgttaacgttccgtaacttaacttaacgtaacgtacctaacctttaccgtacttccgttacgttagggtttaccggttacgggtacggttacgggaacctaaggtacctacggtacccgttacccgtaacggttacgaacccggtaccgtaaaccggtctacccgggtcccccttacgggttaccctaccgttccttaccgttaccccccg

SEQ ID NO: 125517 - DNA, 702 bp, Homo sapiens
  misc_feature: GYAE6OF02GG509.12.85.H08.1.454.CMB.1.raw
  modified_base (310)..(310): a, c, t, g, unknown or other
  misc_feature (310)..(310): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctctcactcagggcacagggtcctgggcccaatctgccctgactcagcctgccctcgtgtctgggtctcctggacagtcgatccacctatttccctgccaacccggtaacctaagtaggtgacgttggtacgtttaataacttttgtcctcctaggtaacaacagcaccagacaaacgccccccaatcctntattatgtacggtctactagttcgtcctcgtaaggtactttactaatcgtacttctcgttcggtcctaagtctagcaacgtccgcccttccctacgtaccatccttacgtcggggtaccctagggctaggacggacggtaggtcgtacgtaagtttacttaccgtgacgtagttacctaattactaactaacgtacctaaccttccgtaaccttaccgtcggtttagggttccggtttacggggtccgggtacgggtaacccgtaacgtccgtaaccggtacccggttaaccgtaacggttaaccgaccggacccgtaacgggtacccgttaccggtccccccgttacggtaccgttacccttccgtttacccgttcccccttaacccccgg

SEQ ID NO: 125518 - DNA, 936 bp, Homo sapiens
  misc_feature: GYAE6OF02H1OZV.12.85.H08.1.454.CMB.1.raw
  modified_base (225)..(225): a, c, t, g, unknown or other
  misc_feature (225)..(225): n is a, c, g, or t
tcagatacgacgtacacgaccggtgctcgatttagtatcactcagtcggcgggggggggtctcaggaggcagcgctctcaggacatctccaccatggcctgggctctgctgctcctcaccctctcactcagggcacgagggtcctgggacccaatctcgccctgactcagcctcgcctcgttgtcgtgggtcctccgtggacgagtcgactccacctactttccngaccgaacccggaacctaagtaggttacggtacggttggttacgttaacttaacgttttcgtccttaccgttacggtaacctaaaaccgtacgacccgtaaccccgaacggtaacccgaaaaccccgtacccccccctaactttacccgttaagttactttaacgttacggttacggtaccttaccgttacggtttacccggtacctacgttaaacgggttaacttttaaccgtaacttcgtacctttccgttacgttacgggttaacctaacggttccgtaggaccctaaaccggtacccggtaccctacccgtaccgtaaccctacgttccgttaccggtaccgggtacccggtaacggttccggtacgggaacggggtacgggtacgggttacctaggtttaaacctttaacgttaccgttacggtaccgttttaaacggtttacgttaaattaacccggttaaaccgtaaacttaccctaaccgttttaccccgtaaccgttttccggtttacgggttacggggtttccgggttccggggttaccggggttaaccggtaaacgtaccggtaccggtttaaccggacccgtttaaccgtaacgggtccgtaccgggtacccgtacggttacccccgttcccgggtacccccgttcggttaaccccttacccggtttcccgttaccccccggtttacccctacccccgg

SEQ ID NO: 125519 - DNA, 1054 bp, Homo sapiens
  misc_feature: GYAE6OF02FQ3OQ.12.85.H08.1.454.CMB.1.raw
tcagatacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacaggtcgatccacctatttccgtgccgacccggaaaccaattaggtacgtacggtttggtacgtttaataacttttggtccttcctggtaaccaaactacgccaacccgaggaccaaaaccgtcccccccgaaactcccgttaggtactttacgtaggtaccggttcctaacgttacgtttcccgggtacccttacgaacgggttaaactttttaccgtaaaacgtttccggtacccttttcgttaccggttttccggtttaaccctaaaacgggttcccgttagggtaccccgtaaaaaccgaaccccgggggttcccctttacccccgttaacgggtaaccccttaaacgttttcccccgtttaaaccggggtttccccggggggtttaccccctaaacggggtccgggttttaccggggaaacggggttaaaccccggggtaaacggggttcccgtttaacggggtaaatttttttaacccggttaacccgggtttacggtaccccggttttaaggttttaaacccggacgtttaaaaccctttaaccggaaaccggtaccctttaaaccctttaccccgttaacccggtttccgtttaaccggggtttaaccggggttttccggggttttaccccggggttaacggggggtttacccgggtaaacccccgtaaaacggggtttccctaacccggggtttaccccggttaacccgttaaccgggttaaccccgtaacgggtaaacccccggtaaacgggttaccccggtttaccgggtcccccccccgttaggggttaaccccccttaaccggtttcccggtttacccccgggttttcccccccttaacccccccggg

SEQ ID NO: 125520 - DNA, 963 bp, Homo sapiens
  misc_feature: GYAE6OF02FPO4S.12.85.H08.1.454.CMB.1.raw
  modified_base (201)..(201): a, c, t, g, unknown or other
  misc_feature (201)..(201): n is a, c, g, or t
  modified_base (924)..(924): a, c, t, g, unknown or other
  misc_feature (924)..(924): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctcgggcccaatctcgccctgactcacgcctgccctccgtgtctgggtctccgtggacngtcgatcacctattttccctgaccaacccgggaaacctaagtaaggttcggtacgtttgggtacgtttaacttaacttttgtccttccgttaggttaaccaaaacgtacgaccaccccgtaacggggaccaaaaacccggtccccccccgtaaaaccttccccgttaggttaaactttttaagttacggtaacgggtaccctaacgttaacgtttttccgggtccccttacgtaaacgggttaaactttttaacccgtttaaaacgtttccgggttaccctttcctttacccggtttccggtttaaccccgtaaaaggtttcgtccgggtaaccaaacccggtacccgggtaccccttcccctacgtaacccgtaactttccggttccggttaccgggggttacctaccggggtacgtacggggtaacgggtaaccgggtacgggtacgttaggtaacgttttaactttaaccgtcggttaccgtaacggtttctaaactttacgtaaaccgtaacggtaccctacccttttacccgaacgttttcccgttacgggtttacggggtttcgggtttacccgggggtttacggggttacccggggtaaacccgttaacgggacccgttacccgggttaacccgggttacccctaacgggtaacccgtaccggtaaccccggaaacggtttcccgtaccccggtacccccggttaccggttacccncccggtttaccgtttccccggtttcccccttaacccccg

SEQ ID NO: 125521 - DNA, 767 bp, Homo sapiens
  misc_feature: GYAE6OF02HT3JO.12.85.H08.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctctcactcagggcacagggtcctgggcccaatctgccctgactcagcctgcctccgtgtcgtgggtcctcgtggaacagtcgatcacctatttccngaccaccggtaacagtgtcgacgttgtacttatacgtttntctctaggtactaacngcaccgagacaaccnccccatctatattngtagtctacgtcttcgtacncgtagtaacttcatcgtacttcgtacgttcgtactagtcgtcggaccaacgtccggtcctccgtactaacgtacttccggtaccggtcgggtaccgaacgggtacgtacgggtaacggtaccggaacggtcccgttaagggttaactttaacggttacccgaggttacccgttaacgtttaacgtaacttaaacgtaccgtaaaacgtccccttaacggtttacccctaacggttttacccgggcgggttttttaacgggggtcccggtttaaccggggggtacgggttaaaccccggtaaggaaaccgttccgtttaacccgggtacccgtaacccgttaacggaaccgtaccggaaccccggtaacggtttccccgtccggttaacccccggtggttacccttaaccccggttcgttttacccccggaccccctttaacccggg

SEQ ID NO: 125522 - DNA, 839 bp, Homo sapiens
  misc_feature: GYAE6OF02G9TJT.12.85.H08.1.454.CMB.1.raw
  modified_base (219)..(219): a, c, t, g, unknown or other
  misc_feature (219)..(219): n is a, c, g, or t
  modified_base (653)..(653): a, c, t, g, unknown or other
  misc_feature (653)..(653): n is a, c, g, or t
tcagatacgacgtacacgaccggtgctcgatttagtatcactcagtcgcggggggggggtctcaggaggcagcgctctcaggacatctccaccatggcctgggctctgctgctcctcaccctcctcactcagggcacagggtcctgggcccaatctgccctgactcagcctgcctccgtgtctgggtctccgtggacagtcgatccaccttgttttccngaccgaacccgggaaacctaagtacggtaggtacggttttcggggttaccttttaattaaccgttttcggttacccttcccgttaacgggttaaaccaaaaacggtaccgtacccgaacccccggaacgggtaaccccaaaaccccggtaccccccccctaaaaccttcccccgttaggttaaccttttacgtacggtaccggttacctaaaccgtttacggttcccgggtacctaccgtaacggtttaaacttttaccgtaagttccgttcctttacttccgttaccggttaccctaagttccgtacggtacctaaaccggtaccccggtcccttacccgtaacgaccctaacgttccgtcggttcgggtaccgacgtcgtaggacggtaacggcgtacgttcgttaagttcgttacgtcgtacgttaacgtntaacttaccgtaacgtaaacgtcctaccgttacctaccgttccgttgggtccgggtttacggtccgggttacgggtacggaactacgggtcgtaccgtaccgtaccgtacggtaccgtaccgtaccgtaccgtccgtccccggtcccgttacggtacccttcgtacccgttccgtccccggtcccc

SEQ ID NO: 125523 - DNA, 698 bp, Homo sapiens
  misc_feature: GYAE6OF02HU9Y5.12.85.H08.1.454.CMB.1.raw
  modified_base (214)..(214): a, c, t, g, unknown or other
  misc_feature (214)..(214): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (423)..(423): a, c, t, g, unknown or other
  misc_feature (423)..(423): n is a, c, g, or t
tcagatacgacgtacacgaccggtgctcgatttagtatcactcagtcgcggggggggggtctcaggaggcagcgctctcaggacatctccaccatggcctgggctctgctgctcctcaccctctcactcagggcacagggtcctgggcccatctcgcctgactcagcctgcctcgtgtcgtggtctccgtggacagtcgatcacctactttccngaccaaccggaacagtcgtagtacgttggtacgttatactttgcttctagtacaacncgcaccagacaaccgccccactctagtatttntagacgtcacttacgttcgtcctcgacgtaactttctaatcgtacttctcgtcggttacagttcgtacggacaacaccggtccttccgtacgacctacttcgtacggtcgggtcacggtntacggaacggacggtacggtcgtagtaacttttaacgtactcggtactacggttactaattaacgtaaccgaacgtccttaaccgtctaaccgttccgttacgggtttccgggttcggttaccgggtacggggttaacggaacctacggtaccgttaccgggtacccgtttacgtaaccgggtccgtaaccggaccccggtaagccccgtttaacccggcccccgtttaccgggaacctttcccggttaccgtttaccccggtccccttaccccg

SEQ ID NO: 125524 - DNA, 798 bp, Homo sapiens
  misc_feature: GYAE6OF02GECJN.12.85.H08.1.454.CMB.1.raw
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctctcactcgagggcacgacgggtccgtcgggcccaatccgtcgccctgacctcgagcctcgcctccgtgtcgtggtctccgtgacngtcgactcactattccngccaaccggaactagtagtcgacggttgtcgttataactttgtccttcgtaggtaactaacacgaccaaccgtacggacctaaacccgaccccccgtaaacttcccgtagtaacgttttaacgacggtacggtacctaacttacgtttccggttacctacgtaacggtaacttttactaagtccgttaccgttcctaccgttcggttaccgtaacgttccgttacggaccgtaaccgtaccggtccttacccgtcgtaacctacgttcgtccggtcgggtaccgtacgggtacgtacggtacggtacgacggtaccgtagtactttacgttacgtcgacgtagttacattaactaacgtaaccgctaccgttacctaccgttacggttcggttacggggttcggttaacgggggttccggtaacggtaacccgtaaagggtccgttaaccggtaccccggtttacgtaaacccggttccgaacccggtaccccggtaaacggtcccggttacccgttcccccgttaccggtacccttaccggtcccgttttaccccggtccccctttacccccgg

SEQ ID NO: 125525 - DNA, 758 bp, Homo sapiens
  misc_feature: GYAE6OF02F3C6N.12.85.H08.1.454.CMB.1.raw
  modified_base (195)..(195): a, c, t, g, unknown or other
  misc_feature (195)..(195): n is a, c, g, or t
  modified_base (213)..(213): a, c, t, g, unknown or other
  misc_feature (213)..(213): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccaatctgccctgactcagcctgcctcgtgtctgggtctcctggacngtcgatcacctatttccngccaccggaaccaatgtgtacgttggtacgttattacgtttgtcctctggtaacaacagcaccaggccaaacccgccccctaactcctagtatttacgtcggtacggtcacttacgttccggtcctagtaacggtaacttttactaactcgtctttctcgttcggttaccaagttcgtacggtaccaaccgtaccggtcccttcccgtacgaacctacgttccggttccggtaccgggggttccctacggggtccgtaagggacgggaacgggtagggtccttaggttaacttttaacgtaccgtgtaccttagttcaattacgtaactaacgtcctaaccgttcccacctttcgttacggttcgggttaccgggttccggggtacggggttaacccgaacgtaggtacccgttacgggtaccccgttaaccgttaacgggtccaaaccccgggtacccgtaacgggtccccgttaccccggtcccccgtttccggtacccttaacccggtttcccggtttacccccggttccccccgttacccc

SEQ ID NO: 125526 - DNA, 1002 bp, Homo sapiens
  misc_feature: GYAE6OF02I7GW3.12.85.H08.1.454.CMB.1.raw
  modified_base (126)..(126): a, c, t, g, unknown or other
  misc_feature (126)..(126): n is a, c, g, or t
  modified_base (429)..(429): a, c, t, g, unknown or other
  misc_feature (429)..(429): n is a, c, g, or t
tcagatacgacgtacacgaccggtgctcgatttagtatcactcagtcgcgggggggggtctcaggaggcagcgctctcaggacatcctccaccatggcctgggctctgctgctcctcaccctcctnactcacgggcacacgggtcctaggcccaatcctcgccctgacctcacgtcctggcccttaccggtgtccgtgggtacctccgtaggactacggttcgaattccaaccttacttttccgacgccgaaacccccgggtaaaacctaagttacgggtcgtaaaccgggttttgggttacccttaaatttaaaccggttttcggtcccttaccggtacggttaaaccaaaacgtacgtacccgtaacccgaagggtaccaaaaccccggtaccccccctaaaccgtccttaaggtttactttaacgngtaaccggttacctaaccgtttaacgttcccggttccgtaaccgtaaggttaacgttttacgtaaacgttccggtacctttacccgttacgttaccggtttaccctaacgttccgtgggaaccctaaaccggtcccggtccccttaacccgtcgtaacccgttaccgttaccggttaccggttccgggggtaccctaacgggggtccttaacggggtaacccgggtacgggttaaacgcccggttttaaggttaaaccgttttaacgttacccgttaacgggtaacccgtaaaggttttcccctaaagttaacccggttacgaaaaccgtttcctaacccgtttacccggaacgtttaacccgtttgggtaaccggggtttacgggttttcccgggaccggggtaccggtaaaccgtaaccggggttccctaagggttacccccttaaggggttaaccccgtccggtaacccggttaaccccgtaggggtttccccctacccggttaacccccggttcccgtttaaaccggacccctttaaccggttttccccccgtccccgttaacccccgg

SEQ ID NO: 125527 - DNA, 728 bp, Homo sapiens
  misc_feature: GYAE6OF02IK3HK.12.85.H08.1.454.CMB.1.raw
  modified_base (222)..(222): a, c, t, g, unknown or other
  misc_feature (222)..(222): n is a, c, g, or t
tcagatacgacgtacacgaccggtgctcgatttagtatcactcagtcgcggggggggggtctcaggaggcagcgctctcaggacatctccaccatggcctgggctctgctgctcctcaccctcctcactcagggcacgagggtcctcgggcccaatctgccctgactcacgcctcgcctcgtcgtcgtgggtctccgtggacagtcgatcacctattttccncgaccgaaccggaacctaagttacgtcgtacggtttcggttaccgtttaattaaccgttttcgtcttccgttggtaaccaaacgacgacctaacccgaggtaccaaaccgcccccctaactcctagttaacttttacgtcggtacggtactacgttacgtttccggttacctacgaacggttaacttttacgtaattccgttacttcgttcgttcggttacctaacggtctacggactaaccgccggtccctcctacgtacctacttccgtcggtcggggtaccacgggtcgtacgggacggacggacggtctacgttaacgtttacgtacgtcgtacgttacgttacgtattactaacgacgtacctaccttaccgtacttcgttcggttcggttcggttcgggcggttacggacctagcgttacggaccttacgtacgtccacggcccgtaggccttacccggcccgttacggtacctacgttccgttccggtacccctacccg

SEQ ID NO: 125528 - DNA, 865 bp, Homo sapiens
  misc_feature: GYAE6OF02GGRHH.12.85.H08.1.454.CMB.1.raw
  modified_base (228)..(228): a, c, t, g, unknown or other
  misc_feature (228)..(228): n is a, c, g, or t
tcagatacgacgtacacgaccggtgctcgatttagtatcactcagtcgcgggggggggtctcaggaggcagcgctctcaggacatctccaccatggcctgggctctgctgctcctcaccctcctcactcagggcacacgggtcctacgggcccaatctgccctgactcagcctcgcctccgtgtcgtgggtcctccgtggacgacgtcgaactccacctatttcccgngacctaaccgggaaacctagtacggtcgtacgtttgggtacgttttaacttactttcggtccttccgttacggtaaacaaacgacgccgaacccgacggaacctaaacccggaccccccctaacgttaccgtacggttaactttacgtacgggttacggtacctaaccgttacggtttacccgggttaccctaacggttaacgggtttaaaccttttaccggttaaacgttccccgttacgttttcctaccgttttaccgggtttaacccgtaacgggtttccgtaccgggtaaccgtaaacccggtaacccggttccccttaacccgttagaacccgtttaacgttcccgttacggggtcccgggttaaccgacgggttaccgtacggggaacggtacggtacgggtaccgttaggttaactttacgttaaccgtggtaccgttacgttacgtattaacgttacgaaaccgtcgttaacccgtacgttaccgttcggtttaccggtttcgggttaccggtttacggggtccggtacggacgtaacgtcgtacccgtacgtaccgtacgtaccgtccggacgtaccgtccgtcccgtacctccggtaccttccggtacccgttccttaccctacccg

SEQ ID NO: 125529 - DNA, 662 bp, Homo sapiens
  misc_feature: GYAE6OF01BQLHY.25.75.G09.1.454.CMB.1.raw
  modified_base (221)..(221): a, c, t, g, unknown or other
  misc_feature (221)..(221): n is a, c, g, or t
  modified_base (379)..(379): a, c, t, g, unknown or other
  misc_feature (379)..(379): n is a, c, g, or t
tcagactgtacagtcacgaccggtgctcgatttagtatagacatctaacgtacgacaaagggggaggaactggcctccagttaggtaccccacgtacggaacccaataggaagcccccgagcccgcagcttctcctttccctccgtgctactctggcctcccaggactgcctactggaggaaattggtgatgacgcagtctccacgcctccctgtctcgtntcctcgtgggaagccgccaccctctcctcgcacggccagtccagaacgcgttggacaggaacttagcctaggtaaccagcacgaaacgtggtccagcctacccaggacctcctccgtctatcggtcgctccaccaggtcccctagtactacgtccccnctaggttccagtgactagtcggtcgtgggactaggtcggttacaccgtctaccacgtattccaagtccaagaccttgactacggtacgtaggaagttagtttcgacgttaaggttttattacgtagtttacctaaccgtagtttaactaagttaaccgtacggtacccgttcgtacgggttacgtttaccggaccgtaaccggtacgtaaggttacgtaaacggacctaaacgggaacttgggtcggtactacgactaaccgtagtacctgttccgtctaccg

SEQ ID NO: 125530 - DNA, 591 bp, Homo sapiens
  misc_feature: GYAE6OF01ESBU7.25.75.G09.1.454.CMB.1.raw
  modified_base (209)..(209): a, c, t, g, unknown or other
  misc_feature (209)..(209): n is a, c, g, or t
  modified_base (499)..(499): a, c, t, g, unknown or other
  misc_feature (499)..(499): n is a, c, g, or t
  modified_base (522)..(522): a, c, t, g, unknown or other
  misc_feature (522)..(522): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctnagtgaaggtttcctgcaaggcttctggatacaccttcgacaagtcatgctcttctagttgggtgccgccgacggcccccggagaagggcttaggagtgggagtggggatgggtactacgaactacgtcgacctaaagttaggtaaagtgaactaaacgtacgtcgacccaagaaactcccgagggacagacgtactacgtttacgacgggacacacgtccgacgtaagtacgaggtctaacgtagtcggactaggagtcggtccgttaggtatcgtagaacgctacggtntaagtagtattgtgtgtagagtntaggtaggtgggatcgtctccgcgctaggttcgggaccgtacgggaccctggtccgtaccgtcgtaccg

SEQ ID NO: 125531 - DNA, 573 bp, Homo sapiens
  misc_feature: GYAE6OF01ECYEU.25.75.G09.1.454.CMB.1.raw
  modified_base (221)..(221): a, c, t, g, unknown or other
  misc_feature (221)..(221): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
tcagactgtacagtcacgaccggtgctcgatttagtatagacatcaacgacgacaaagggggaggaactgcgtcaggttaggacccagacggaaccatggaagccccagcgcagcttctcttcctcctgctactctggctcccagatgccactgggagaaattgtgatgacgcagtctccagcctccctgtctgtgtctcctgggggaagagccacccttntcctgccagggccagtcagagcgttggcaggacttagcctgtaccagcagaacctggccagcctccacgactcctcctctatggtgcttcaccaggcccctgactatccccacagttcagtgcagtggtctgggacagagttcactctcaccatcagcagcctgcagtcnganacttttgctagtttatactcgtctaccgagtactaataactggccttccgtaggtaccgtttgggacctaaggggaccctaagggttacggaaaagtcccgtaaaaacggtaaccttgggtacgggacccgtacggaccgtaaccctaagttacccgttaggttccctttcgtaacccg

SEQ ID NO: 125532 - DNA, 726 bp, Homo sapiens
  misc_feature: GYAE6OF01CRPKV.25.75.G09.1.454.CMB.1.raw
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
tcagactgtacagtcacgaccggtgctcgatttagtatagacatcaacgacgacaaagggggaggaacgtgctcagttaggacccagacggaaccagtggaagccccagcgcagcttctcttcctcctgctactctggctcccagatgccactggagaaattgtagatgacgcagtctccagccctccctgtctgtgtctccgtggggaaagcgccaccctctcctgcagggtccagtcagancgttggcaggacttagctggtaccngcagaacctggccagcctcccagactccgtcctctatcggtcgccttccgaccacgggccccctggactacgtccccgcacggttccacgttcggctagggtcggtccgtgggaacaggtagttccacgtctacgacctattcgagtccgtaagtcccgttacggaccgtaacggttcctaaggtaaaccgttacgttttttacgacccgtttaagggttttttaacctttaccgttacggttaacccgtaaccccgtaagggtttaaacttaaacggttaaaccgttccgggtaacccccttccgggttaccgggttaaccggttttacgggacccgtaaacggggtaccgtaaaggggttaccggaaacgtacccgtaaaacgggtaaccttacgggttcgggaccttacggtacctaaccgtacgttaccgttacgttaccgttccgttaacccg

SEQ ID NO: 125533 - DNA, 728 bp, Homo sapiens
  misc_feature: GYAE6OF01C8UIX.25.75.G09.1.454.CMB.1.raw
  modified_base (144)..(144): a, c, t, g, unknown or other
  misc_feature (144)..(144): n is a, c, g, or t
  modified_base (205)..(205): a, c, t, g, unknown or other
  misc_feature (205)..(205): n is a, c, g, or t
  modified_base (461)..(461): a, c, t, g, unknown or other
  misc_feature (461)..(461): n is a, c, g, or t
  modified_base (696)..(696): a, c, t, g, unknown or other
  misc_feature (696)..(696): n is a, c, g, or t
tcagactgtacagtcacgaccggtgctcgatttagtatagacatcaacacacgaaaaggggggaggaactgctcagttaggacccagacggaaccatggagccccagcgcagcttctcttcctcctgctactctggcctccagntgcccatggagtaaattgtgatgacgcagtcctccagccctcccgtgtctgtcgtctcggnggggaacgcgcccacctctccgtgcgacgggccagtcgaggtacggtcggttacggacgtacggtaacttacgccgtacggtaaccgagaacctaacggaaaccgtcggaacccacgcccctacccgaccgtaaccttcccctccgttactacgttcggtccgtcccttacccgaccggtcccgggtcccctcgtactaccccgtccccgacgtacggttcaggtccggacgtagggttcgggtacggtggaacgngtcgtccactcctacgacctagcacgctaccggcgtacgcgtacgtcgtaagtaacgtttgtttacgactttacggtttattcgtacgtaccttaactaagttaactaacgttaccgttcggtaccggtcggtttacgggtaccggtttaccggaaccggtaaggggtaaacccggtaaggggtaaacgtaaacggaaccgtaaaacgggcggtaggtaccgacgtacgtacccncgttaagttcgtaccgttctaccgttaccccg

SEQ ID NO: 125534 - DNA, 786 bp, Homo sapiens
  misc_feature: GYAE6OF01EH9L9.25.75.G09.1.454.CMB.1.raw
  modified_base (667)..(667): a, c, t, g, unknown or other
  misc_feature (667)..(667): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtcgcccactcccgaggtccagcttgtgcgaggtccgggctggaggtagaagaacgccgtcggggcctcgaggtagtaacggtttcctgacgtaaggtcttcgtggtactacctccttacgcaagtctatcgtccttcttcgtagttcgggtcgccggcccgacgggtacccccggagaacgggtccttagggtaggtggggaaggtcgggtaaggttcggacttaccgaaaccgttctacggaccgtaagttaggtaaattacgacctaaaacgtacgtaccgaccccgtaaagtaaacctacccggaagggacgtaaggtaaccggttaaccgtaaccggttttacggaacggggtaaaccctacgtacggtacccgggaacgtaacggttaaccgagggaacccttaacgacgttacggaccgtaggacgtccggtgttaggtacttacggagaacggtacccgtagtactagtttacgttaacgtagtcgtttagtaggtaagtacggttaacgnggggttacggtccgttacccggttaacgtccccggtaaccggacggttccgggtaccggggtaccccgggtaaccggtcccgtacccggttccccgtacccgttccgtccccgtacccg

SEQ ID NO: 125535 - DNA, 732 bp, Homo sapiens
  misc_feature: GYAE6OF01C4Q2P.25.75.G09.1.454.CMB.1.raw
  modified_base (213)..(213): a, c, t, g, unknown or other
  misc_feature (213)..(213): n is a, c, g, or t
  modified_base (445)..(445): a, c, t, g, unknown or other
  misc_feature (445)..(445): n is a, c, g, or t
tcagactgtacagtcacgaccggtgctcgatttagtatagacatcaacacacgaaaggggggaggaactgctcagttaggacccagacggaaccatggaacgcccagcgcagcttctcttcctctgctactctggcctccagatcgccagtaggaataattgtgactgacgcagtcctcacgcctcctgtctgtcgtcgtcgtaggggacgcnccctacctctccgtggacgacggctacgcgaggtacgtcggtggacaaggtacttcgcgtagtacagacaacgtaaccgcgacacgtcccaccgtactcccttcctaccttacgttacgtcggtacctcctacccgaacgtccggtacccctagacctacccgtcccgacgtacggttcgaacggtcgacggtacggtcgggtacgacgggacaggttacttacacgttacnccgaactacgtacgacacgtacgccgtcgacgtagtaacgtagtaacgtttagttacgtagtttacgtttacgtacgttacgtacccttaaggtaaacttaacgtttaaaacgtcggttacccggttaaccgttcggggttaaacggtttcggtaaccgggaaccgggtaaaacgggtaacggtaaggggtaaaaccgtaaacggaaacggtaaaacggtaccgggttacggacggtaccggttacaaccgtaacgttactacggtttacctacttaccggtacccg

SEQ ID NO: 125536 - DNA, 644 bp, Homo sapiens
  misc_feature: GYAE6OF01DF4AX.25.75.G09.1.454.CMB.1.raw
  modified_base (372)..(372): a, c, t, g, unknown or other
  misc_feature (372)..(372): n is a, c, g, or t
  modified_base (617)..(617): a, c, t, g, unknown or other
  misc_feature (617)..(617): n is a, c, g, or t
tcagactgtacagtcacgaccggtgctcgatttagtatagacatcaacacacgaaagggggaggaactgctcagttaggacccagacggaaccatggaagccccagcgcagcttctcttcctcctgctactctggcctccagatgcccagtggaagtaaattgtgatgacgcagtctccagccctcctgtctgtgtctcgtggggaagcgccacctctccgtgccgaggccagtcagcgtcgtgcaggactacgccgtaggtaccagccgaagtaaccgtcggccacgtcctaccgacgtacctcccgtcctcgtagtcggtcgtccttcccgaccggtcgggcccctgacctaccgtccccgcgtaggtcncggtcgacgtaggtggtccgtggaactgtacgtctacgtactcactagtcgagtccacgtccgtagtccgtagtcgttacgtaaagttctttgtactttagttttagtacctgtaaccctacgttaagttaaacttaacgttaacggttccggtacgttccgttacgggttacgttcggaacccggtacggaaaccgtaagggacgtaaacgacgaaaaccggtgtcggacgtaccgtacgaccncttatcccgtttatccgttagtacccg

SEQ ID NO: 125537 - DNA, 668 bp, Homo sapiens
  misc_feature: GYAE6OF01C0ZBM.25.75.G09.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (555)..(555): a, c, t, g, unknown or other
  misc_feature (555)..(555): n is a, c, g, or t
tcagactgtacagtcacgaccggtgctcgatttagtatagacatcaggggacccaacaaccacatccctcctcagaacgcccccagagcacaactcctcaccatggactggacctgggaggacttccttcgttttgggtggcagcacgccacgtaggtcgcccactcccgaggtccagtcttgtgactagtcgtggggctaggaggtagaagacgccgtgggcctgngtagtacgttccgngacgtacggtcttcgacgtactctaccgttcgactaagtctagtcgtactcgttcgaggttcggcgaccgccggtaccggccccgaagagggtccttaggaggtggacgtggactgacacaactgcgtaactaagtgtaacgctaactaactgaccgaacgaacgtacgccgaggtacacggtataccgttacgttaacggcggaactacgtacgtaccgagtacgtaacggcgtacgaacgtacggtcggaacgttggcgtccggagttggaccttgacggtacacggtcgtacgttattagtacgtttacgnggtcttagggattaacggagggttagggacgtcgtacccgttcgacccggttacggaccggttagggtcccgggaccgtcgggtacccgttggtcccacccgttcgtaccccg

SEQ ID NO: 125538 - DNA, 750 bp, Homo sapiens
  misc_feature: GYAE6OF01DE4WG.25.75.G09.1.454.CMB.1.raw
  modified_base (149)..(149): a, c, t, g, unknown or other
  misc_feature (149)..(149): n is a, c, g, or t
  modified_base (251)..(251): a, c, t, g, unknown or other
  misc_feature (251)..(251): n is a, c, g, or t
  modified_base (378)..(378): a, c, t, g, unknown or other
  misc_feature (378)..(378): n is a, c, g, or t
  modified_base (444)..(444): a, c, t, g, unknown or other
  misc_feature (444)..(444): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
  modified_base (672)..(672): a, c, t, g, unknown or other
  misc_feature (672)..(672): n is a, c, g, or t
  modified_base (716)..(716): a, c, t, g, unknown or other
  misc_feature (716)..(716): n is a, c, g, or t
  modified_base (742)..(742): a, c, t, g, unknown or other
  misc_feature (742)..(742): n is a, c, g, or t
tcagactgtacagtcacgaccggtgctcgatttagtatagacatcaacacacgaaagggggagaactgctcagttaggacccagacggaaccatggaacgccccagcgcagctttctccttcctcctgctactcgtcggcctcccaagntcggaccctacgtagggaaataaagtttgtagagtcggacgctacgtcctcccgcgtcccctccgttggttcttggtccgtaccgttcggacggggggaacnccgtacccaccttccgtccgttcggaccggccggaccgacgtacggaaggttcgggtcggttacggactaacgggttaactaccggtccgtagggtaccacgtaccgaaaccgtaccgtccggaccncccgtaccctacacgtacctcccgtacttagcgtttgccgtcccgtaccgaccgccgtccgtaacnccctacccgtccgcgttaggtcacggtcgacgtggtcggtacgacgactacgttacgccctaacgacctaccacgtacaccgacgactcgacgtntacgtntacggtaacgacttttagtacttcgtttaacgttactacgttactaacgacgttaacttaacggtacgtccgttaccgtacgtttacgggaccggtttaagtaccgggaacggaacgggttaaaccngggttaaaaccgaacgtaacggtactaacgggttcgccggtaanaccgtctacgttacgtgtacgttccnccgttccg

SEQ ID NO: 125539 - DNA, 810 bp, Homo sapiens
  misc_feature: GYAE6OF01DF9OT.25.75.G09.1.454.CMB.1.raw
  modified_base (800)..(800): a, c, t, g, unknown or other
  misc_feature (800)..(800): n is a, c, g, or t
tcagactgtacagtcacgaccggtgctcgatttagtatagacatcaacacacgaaagggggagaactgctcagttacggacccagacggaaccagtggaacgccccagcgcagtcttctccttcctccgtgctactcgtaggcctccgagatcgcccagtggaagtaattggagagtcgacgctacgtcctccgacgtcctccgtgtacgtgtctcggtacggagggacgcctaccctaccgtcgccgtcgaccggtacggccgtaacgacgaggttccggtggttacggaaccgtaaacggttacgttaaccggaccgttaccgggtaaccgaacgtaaccgtaaccggtaaccgttccggacccaccggtacccctacgtaccgtacccttccgttaccgtcgttacgtcgttaccgcccgttacccgaaccgggtcccgtactaccgaaccgtttccccgacccggagttaacgtccggaaggttccggtacgtaggtccgggtcgtaacgggtctaaacggtctccctaccgtctacccgtaaccgagtacgtccgtctaacggtcctagtaacgtgtaacggttaggttaagtttcgttaagttcgttaacttttacgaccgtttaccgtaaagttaaccgtaactttacgtaaacgttcccggcggtttaaccggtaccgggttaccggttaacgtcccgggaaacgtaaccgggtacgtacgggaaaggtaaacgtaccgtacggtagtacggtccgtaaacctggacccctagttaccttcggtcgttaccncgttaacccg

SEQ ID NO: 125540 - DNA, 937 bp, Homo sapiens
  misc_feature: GYAE6OF01D7CIX.25.75.G09.1.454.CMB.1.raw
  modified_base (157)..(157): a, c, t, g, unknown or other
  misc_feature (157)..(157): n is a, c, g, or t
tcagactgtacagtcacgaccggtgctcgatttagtatagacatcaacacacgaaagggggaggaactgctcagttaggacccagacggaaccatggaagcccagcgcagcttctcttcctcctgctactctggcctccaagctcgccacgtggaanaaataggtgatgacgcagtcctccgacgccctaccgtgtactgtcgtctaccgggagggacacgaccgtccctaccccttctcccgtagggaccgaaccggggccctaagggtcctaaggtagtttaacggtaacggccggtaactaaacgttccggaccgttacggtaaccacggaccgaaacggaaccgtcgggaccggtacgggtccccgaggtccctcctacgtacgtcccggtacggccgaaccgacctaccccgaaccgggtaccgggacccaacgggttaacccggtaaccgttaccgaacccggttaccggttaacgggttacccggtaaggggttcgggaaccgggttacgggggtttaccggggggttaaccgtaaccgggggggtaaccttaaccgggtttaccccttttaccccggtacccttttacccggtaaaccccccacgtaaccggtaacccgttacccgggaaaccgtccggtcccgttacggaaccgttacggttaacccggtttagggttaaccgttttaacgggttttacgttaaaccttttaggttttaccgtttacgttacggtaaccgtaacgtaaccgttaacgttaaaacggtttaaccgggtacggttaaccggtttaccgttaacgggtttacgtaacccggggtaaacgggtaacccgtacgggtacggttaaccgggtaacctaggacccggtaaagtaaaccgtcggttacgggtaccggtactaccggaaccttacgtccgtttaccg

SEQ ID NO: 125541 - DNA, 755 bp, Homo sapiens
  misc_feature: GYAE6OF01EQA3N.25.75.G09.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (276)..(276): a, c, t, g, unknown or other
  misc_feature (276)..(276): n is a, c, g, or t
tcagactgtacagtcacgaccggtgctcgatttagtatagacatcaggggacccaacaaccacatccctcctcagaagcccccagagcacaacctcctcaccatggactggacctggaggatccttctttttggtggcagcagcccacgaggtcgcccacctcccaggtccagtcttgtgctagtcgttgggggttgaggtnaaggacgcgtgggcctgagtgtagtttcngacgaggtcttcgtgtactaccaccttcgactagtcatcgtcttntcgtgttggcgccgcccgaccggacccggaggtacggtgtaggtacggtaggtaggtaggtagtggactaaccgtaacgtacgtcgaacgtaagttacgtaactacgtaactaaacgtactaacgaaccgtaaacgtaaccggaccggacggaacgtaacgtacggttaacgttacgtaacggtaacggtacctaaccgtaccggtaccggtacggtaacggtaccgtacggtacgtaacgtacggtacggtacgtagggtacggtcggtacgttacgttacgtacgtaacggaacggtacgtacgtacgttaagttacgtttagtttacggttggttaggtagtaaggtacggtaacgggtaggggtacggtacgttaccggttaccgtcccggtaccgttacgggttcccggggtacgggtacccgggtaacccgggtccgtacccggtaccgttacccgttcccgtaacccgtccg

SEQ ID NO: 125542 - DNA, 826 bp, Homo sapiens
  misc_feature: GYAE6OF01B2NRC.25.75.G09.1.454.CMB.1.raw
  modified_base (129)..(129): a, c, t, g, unknown or other
  misc_feature (129)..(129): n is a, c, g, or t
  modified_base (135)..(135): a, c, t, g, unknown or other
  misc_feature (135)..(135): n is a, c, g, or t
  modified_base (476)..(476): a, c, t, g, unknown or other
  misc_feature (476)..(476): n is a, c, g, or t
  modified_base (643)..(643): a, c, t, g, unknown or other
  misc_feature (643)..(643): n is a, c, g, or t
tcagactgtacagtcacgaccggtgctcgatttagtatagacatcaaacacaacaaaggggggaggaactgctcagttaggacccagacggaaccatggaacgccccagcgcagcttctcttcctcctnctactntggcctccagatcgaccacgtaggaagtaaattggtagatgacgctagtcctccacgtccctaccgtgttcgtaggtcgtccgtcggtagggggaacgacgacccctaccttccgtaccgtggacgacgggtaccaacgtacgacggtagggtcggttaacggacgttaaaacgggtaacgttaacggtcccggtaacggttaaccaaggacgtaaaaaccggtaaaccccggtcggaaccctccgaaccccgtaccccgtaacgttaacccttcccgttacctttaccgttaaggtccgggacttacccgtttacccccgaaccgggccggttaaccccncggtaaaccttaccccggaccccggtaccgttagggtacggtaacgtgggaccgttacggggttaccggggtcggtaaccggaacgaattaccggttcctaaacctccgtaaacctacacggttacgaacctcgaccgtctacgtactacgtactaaggtaagtttntagtaacttacgtttacgacttactacctaacgtattaactacgtacttacggccgttaggttacggttacggttaaccggacggtacggaaacggttaaagggacgtaaacgtaaccggtaaggtagtaacgacgtacgtaacccaactaccgtacttccggtaacttccgtaccggtaacc

SEQ ID NO: 125543 - DNA, 824 bp, Homo sapiens
  misc_feature: GYAE6OF02HGTA7.25.75.G09.1.454.CMB.1.raw
tcagactgtacagtcacgaccggtgctcgatttagtatagacatcaacgggacacaaagggggaggaactgctcagttagggacccagaccggaaccatgggaacgccccgagcgcagtcttctcttccctcctgctactcgtggactccgagagtcgcctactggactaaattcgtgatcgacgcctagtctccaggtcctccctggtactgtcgtactccgtaggggaagctcccaccgtctccgtggaccacgggcctaggtccgtaggacgtcggtttaggaactaaggtaaccttacgccgttaggtaaccaagaacaaacgtaaacccgtggacccaaacggccccctaaccgacgtaaccttccctacttacgtagtggtcgtccttaccgaaccgtaccgggtccccttaggtaacgttaccctaccccgtccgtacggtttccacggttcggacctacgggttcgggttccgtaggggaacctacggtaaccggttccctaacccttccgtaacctaaccgttacgttccgaacggtccctaccggtccggtacgtacgtaaacggtccggtaaggtaaacgtttacgttttacgtaacgtttaacgttttacgttaaccgtacgttaaccctaaccgtaaagtttaaacttaaaaccgtaaccggttccggtacccgttacggttaacgggttaaccgttttacggaacccggtaaaggggttaacccgaaggggtaacggaaacgtaacgtaaacggtaacgtcggtacgtacgtacgaccgtacctacgttccgtaccgttcctacgtaccg

SEQ ID NO: 125544 - DNA, 873 bp, Homo sapiens
  misc_feature: GYAE6OF02G8YO2.25.75.G09.1.454.CMB.1.raw
tcagactgtacagtcacgaccggtgctcgatttagtatagacatctaacgtacgacaaagggggaggaactgctcagttacggaccagacggaaccatggaagcccagcgcgacgcttctcttcctcctgctactctggctcccagatcgccactggacgaaattgtgatgacgcagtctccacgcctcctgtctcgtcgtctccgtggggaacgacgcctacccgttcgtcctcggccgacgggtcccaacggtccacggtacggtccgggttagggacctaacgggtaaaccgttacggtaccgttaacgggtaacctaacggtaccgaacggtaaaacccgtcggacccgaacgccccgtacccaacggtacccttaccccgtaccgttaccgttaacgttcgggtccgttacccgtttcccgaaccccggtaccgggggtcccccttaggtaaccgttaccccggttacccccccggtacccgttaacgggtttccgtaacgggttacggggtaccggttaacggggtttccgggggttccgttaaggggtaccgttaagggtttaccggtttccgaaccgttccgtaccgtaaccgtacgtaccggaacgtacccgtacggtcccttacgcccgtaacgtcgttaacgtaacgttctttttacgacgtttaacgttttacttaccgttcggtacctaaacgtaagtttaacttaaacggttaaccgttcggttacccttacgggttacggttaccgggtttacggaaaccggtaaacgggtaccgtaacgggttacggaaccgtaaccgtaacggtaccgtagggtacgcgttaggacccgtactagttccgtacttacgtcgtaccg

SEQ ID NO: 125545 - DNA, 676 bp, Homo sapiens
  misc_feature: GYAE6OF02IKUNI.25.75.G09.1.454.CMB.1.raw
  modified_base (297)..(297): a, c, t, g, unknown or other
  misc_feature (297)..(297): n is a, c, g, or t
tcagactgtacagtcacgaccggtgctcgatttagtatagacatcagggggacccaacaaccacatccctcctcagaagcccccagagcacaactcctcaccatggactggacctggaggactcctctttttgggtggcagcagccacgaggtcgcccactcccaggtccagcttgtgcagtcgtggggctggaggtagaagaacgccgtggggcctcgagtgtaaggtttcctgcgaacggcttcgtggtactacctaccttcgacaacgtccatcgtctcttcgtagttgggtcnccgcccgaccgggccccccggaagaacgggtctttggaggtcggtaagttggggaatcgggactacgaaaccgtccgtacgaccgtaaggtacggtaacacgtaaccaaaaccgttacgtaccgaacctaaagtaaccgtcccgtaagggacctagtacgtacgtaacgtttacgacggtaccacgtacgtacccggctaacgtacgaggtctaagagtaccggactggacgtcggaccgttagacttcgaacgtaacgccgtacggtactagttgttaacttgtgtacgtagagtactagtggtagggctcgtccgtaccgcggtaccttagggtccggggactacggggtccctacgggtacctcccggtatcccgg

SEQ ID NO: 125546 - DNA, 793 bp, Homo sapiens
  misc_feature: GYAE6OF02HIS1V.25.75.G09.1.454.CMB.1.raw
  modified_base (314)..(314): a, c, t, g, unknown or other
  misc_feature (314)..(314): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtcgcccactcccaggtccagcttgtgctattcgtggggctggaggtgaagagccgtgggcctcgagtgtaaggtttcctgcgaacggtcttcgtggactacgtaccttcgactaacgtcatgcttcttacagtttgggtcgccgtcccgacgggccccccggaanaacggggtccttggagtcgggatggggatgggactacgaaccgtcgtacggaccaaagttgggtaaactcggaactaaaaccgttacgtaccggaaccccgtaaaaggtaaaccgttaccccggaaaggggccgtaaacgggttaaccggtttaacccgttaaacccggttttttaaaccgggaaccggggtaacctaaaccggttaccgttaccccgggaaccggtaaagttaaccggacggtcccttaaacgtacggttacgggtaacccgtaggtacgggtacgggccctttagggactttacgaggaactaccggacgtacgttaattcggtaactttaggtgttaggtacgtaacgttaacgtaggtacggggtcgggactttcccgggtcgttaccttcgggaaccgttacggggttccgggggacccttagggggtacccctcggggtttacccacccggtttcctacccgg

SEQ ID NO: 125547 - DNA, 687 bp, Homo sapiens
  misc_feature: GYAE6OF02I2H1N.25.75.G09.1.454.CMB.1.raw
  modified_base (164)..(164): a, c, t, g, unknown or other
  misc_feature (164)..(164): n is a, c, g, or t
tcagactgtacagtcacgaccggtgctcgatttagtatagacatcaacacaccaaagggggaggaactgctcagttaggacccagacggaaccatggaagccccagcgcagcttctcttcctcctgctacctctgctcccagatgccactggaagtaaattcgngatgacgtcagtctaccacgcctcctgtctagtgtacctccgtaggggaacgcgccctaccctcgtccctcgcgacggggcccagttccgaagtcggtcgtttagggactaacgggtactttacggccgttagggtacccacgacctaacgaaaccgtgtacccaggtccctaccgacgtaccttcccgtcgtcttagtcggtccgtacctttcccgaaccggccgggtacccctagtaccgtaaccctccccggtaccgtacggtcctaaggtccgacgtacggtcggtaccgtcggaacttggtactccaaccgttcaccgtaccataccgtacgtacaccggtctacgctaacgttccgaagtatcgtttacgacgtttagtttaacgttccgtcgtaccgtaacttagttaactacgttacgtcgaactcggttacgtcgttacgacccgtagacaacgggtcaagacgaacgtattcgggactcgtacgtctactcgtcctaacgttctaccgtaccg

SEQ ID NO: 125548 - DNA, 773 bp, Homo sapiens
  misc_feature: GYAE6OF02I1GJG.25.75.G09.1.454.CMB.1.raw
  modified_base (522)..(522): a, c, t, g, unknown or other
  misc_feature (522)..(522): n is a, c, g, or t
tcagactgtacagtcacgaccggtgctcgatttagtatagacatcaacacacgaaagggggaggaactgctcagttacggacccagacggaaccagtggaacgcccagcgcagtcttctcttcctcctgcttactctcggcctccagatcgcccagtgggaagtaaattgtagactacgacgctagtctaccgacgtccttcctggtctgtcgttcgtacgggtaggggacggaccaccctccttccgccgtacggacggacggaccgtacgtcgaaggtcggtcggttaggacgtaacggtacgttacggtacgttacggacgacgtacgaacggtaaccgtcgaccgtacgccctaccgacctacccgtcccttactcgtagtcgtccgcctaccgaccgccggtcctactaccgtacctcccggcgttaacgtcgtacggtcgggtacgtacggttcggttacggacggagtacggtcgtaccacgtccgtaacacgtctacgacgtacgcgttaccgngtaccgttacgtacgttaagttaacgttatttacggtaacgttactttaacgtacgttacgttaaccgtaactttaacgttaacgtaacgttaccgtacggttcggttaccggttacgggttaccgtacgggaacggtaaacggaacggttaggtaaccggaacggttaaccggtaacggttaacggttacggaaccggttcgtaccgaacgttacgttaccgcggtttaacccttcgttacccgttaccg

SEQ ID NO: 125549 - DNA, 909 bp, Homo sapiens
  misc_feature: GYAE6OF02FYXX9.25.75.G09.1.454.CMB.1.raw
  modified_base (202)..(202): a, c, t, g, unknown or other
  misc_feature (202)..(202): n is a, c, g, or t
tcagactgtacagtcacgaccggtgctcgatttagtatagacatcaacacgacaaagggggaggaactgctcagttaggacccagacggaaccatggaagccccagcgcagcttctcttcctcctgctactctggctcccagatgccactgggacaaattgtgactgacgacagtcctccacgtcccgtcccctgtcctgtnttccgtccggtagggggaagacgaccctacccctccgttaccctgaccgtaggggccctaaggtccgagaggtccggttaggaccgtaacgggtaacttacgccggtaggttaacccgaggtaccaaacggtaaaacccgtcgggacccctaacggtaccccgttaccccctaacggtaccctaccccgttaccccgttacgttaaacggttccgggggttacttacccccgtttaccccggtaaaccccgaccggggtacccccccgttagtacccgtaacccccgttccccccggtacccggtaacgggtttccaaacggttcggggtaccgtacgggttcggggttacccgtaggggaaccgtaacggtacggttaacccgtaccttacccggttaccaaacccgtactaccgggtacgaccggtaccgtacccggttccgggtacgtacgttccggttaaagtaacggtttaacgtttcggtactttaaacggttttacctttaacgttaccgttacctaaaccgtaacggttaacttaaacgtaaccgtaccgggtacccttaccgggtagggtaccgtttaacggtaacccgtaaacgggtaccgaacggggtacgtaaaacgccgggtaaaaaccacgggttacgggtaccgtacgtaacgacccgtaactaccgttacgtacgttaccgtacttacccg

SEQ ID NO: 125550 - DNA, 512 bp, Homo sapiens
  misc_feature: GYAE6OF01CD146.53.31.C09.1.454.CMB.1.raw
  modified_base (433)..(433): a, c, t, g, unknown or other
  misc_feature (433)..(433): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaaagactttgagaggccctcagggacccctgagcgattctctggctccagctcagggacaaacagtcaccttgaccatcagtggagtccggcagagacgaggctgactattactgtcagtcgcagacagcagtggnagtatgtgtgttcggcggagggacgtacgtctcgccgtaccgtacggtacgacgaccgaacggacgtcgccccgtcccg

SEQ ID NO: 125551 - DNA, 502 bp, Homo sapiens
  misc_feature: GYAE6OF01AWQLW.53.31.C09.1.454.CMB.1.raw
  modified_base (314)..(314): a, c, t, g, unknown or other
  misc_feature (314)..(314): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtcttggtgatttataaagactttgagaggccctnagggacccctgagcgattctctggctccagctcagggacaacagtcaccttgaccatcagtggagtccggcagaggacgaggctgactattactgtcagtccgcagacagcagtggcagttatgtcgtattcgggcggagggacgtacgctgccgtccgtaggtcagcccaaggcctgcccccgtcgg

SEQ ID NO: 125552 - DNA, 810 bp, Homo sapiens
  misc_feature: GYAE6OF01C43T2.53.31.C09.1.454.CMB.1.raw
  modified_base (246)..(246): a, c, t, g, unknown or other
  misc_feature (246)..(246): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcgaggacagacggccaggactcacctgctcgtggcgatgctattcgaccaaaaanatatgtcttactggtaccagcaggacgccaggccacggcccctgtcgttggtatatttaagtaaacgtactttaggacgacggtcccctacgacgggacccctggacgtcggtactttcgtcgtcggcctccgagtcctacggaacgggaacctaaaccgtacggttacccaaccgtttacgaaccgtacgtacgtaacggtcgggacggttccccggaaccggaaggaacgggtaaccggaacgggtaccgttacggtaaccgtttaacgtttaccgttaggttacccgtaacggttacccggaacgtaacgaaccgtaacggtaccgtaacgggttacggtaacccgttaagggtttacgttacgggtttacccggttaacgggttttacccgggggacccggggtaaacgggggttaacccgtttaaccgggtacccggtttaacccggggtaacccccggtttaaccgggttaacccggggttaaccccgtaacccggggttaacccccggtaaaggggttccccctaaccccgggggttcccccccgtttaacccgggg

SEQ ID NO: 125553 - DNA, 650 bp, Homo sapiens
  misc_feature: GYAE6OF01BTLQN.53.31.C09.1.454.CMB.1.raw
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccaccctcggtgtctgtcgtcctcgaggacaggacggccaggactcacctgctctggcgatgcattgaaccaaaaanaatatgtcttactggtaccagcagaggccaggccgacggccctgtcgttggtntatttaataaagtactttgagacggccctcgacgggacccctgacgcgtattccgtcgtcggcctccgagccgtacgaacgggaacaacgacgtacctaccgttcgacctatcgaggtcggacgtcccggacaaggacggacggacggtacgtacgtaacgttaactttaccgtcgttaccgacgtccgacgaacgaaccgaggtaccgtaaggtcggacgttaagtttacgtcggttacggttacgttccggggacgggtaacgggtaccgtaccggtcgttacggtacccggttaccggtaggtaccgaaccggtacccgaacggtccgtcccggtcccccgtaccgg

SEQ ID NO: 125554 - DNA, 526 bp, Homo sapiens
  misc_feature: GYAE6OF01A1F9C.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagtactttgagaggccctcgacgggacccctgagcgattctctggctccagctcgaggacaacagtcaccttgaccatcagtggagtccggccagaggacgaggctgacttattacgtgtcacgtccgcagacagcgagtggactagttatgtcgtagttcggcggtagggtacgtcggtctcggacccgtcgtaggtccgacgcccgaaggcctcgcccccgtcgg

SEQ ID NO: 125555 - DNA, 527 bp, Homo sapiens
  misc_feature: GYAE6OF01DSHM7.53.31.C09.1.454.CMB.1.raw
  modified_base (240)..(240): a, c, t, g, unknown or other
  misc_feature (240)..(240): n is a, c, g, or t
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
  modified_base (477)..(477): a, c, t, g, unknown or other
  misc_feature (477)..(477): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaanatatgcttactggtaccagcagaggccaggccaggcccctgtcttggtgatttataaagtctttgagaggccctagacgggacccctgagcgattctctggctccagctcgaggacaacagtcaccttgaaccctntacagtggacgtccggcagaggacgaggctgacttattactgtacagtccnagacagcagtgcagtttatggtacgtagttcgggcggtagggacgtacgngtcggtaccgtccgtaggtacgacgacccgaaggcctcggcccccgtcgg

SEQ ID NO: 125556 - DNA, 533 bp, Homo sapiens
  misc_feature: GYAE6OF01CC9ZQ.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacaatatgacttactggtaccagcagaggccaggccaggcccctgtcttggtgtatttataaagcttttgagaggccctcgacgggacccctggacgcgtattctcgtggctccagctcgaggacaacagtcaccttgacctatcagtggacgtccggacaggacggacgaggctagactattactgtcagtccgacagacagcgagtggctagttatgtacgtagttcgggacggaggacgtacgctacggaccgtccgtagtccgacgacccgaaggcctcgtcccccgtcgg

SEQ ID NO: 125557 - DNA, 551 bp, Homo sapiens
  misc_feature: GYAE6OF01CK3E2.53.31.C09.1.454.CMB.1.raw
  modified_base (241)..(241): a, c, t, g, unknown or other
  misc_feature (241)..(241): n is a, c, g, or t
  modified_base (376)..(376): a, c, t, g, unknown or other
  misc_feature (376)..(376): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagagccaggccaggcccctgtctggtgtatttaataaagcttttgacgacggcccctagacgggacccctgacgcgtattcctactggcctccgagtctacgaagggaccaaacngtccaccgttgaaccatcaggtggacgtcccggacaggaggacgaggctgaacttattacgngttcaagtccgacagacngacaggtcggacagttagtgtacgtagttcggacggtacgggtactcggtctacggaccgtccttaggacctcgaccgagcctccgccccgtcgg

SEQ ID NO: 125558 - DNA, 546 bp, Homo sapiens
  misc_feature: GYAE6OF01DEWG0.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctctcactctctgcacaggctctgaggcctcctatgagctgacacagtcaccctcggtgtctgtgtcctcaggacagacggccaggatcacctgctctggcgatgcattgccaaaacaatatgcttactggtaccagcaggaggccaggccaggcccctgtcttggtgtatttataaagtctttgagagccctcgacgggacccctggagcgatttctcgtcggcctccgagctaccgaaggggaacaaacgcgtaccaccgtttgaccctatcaaggtggacgtcccggcgaaggacggacgaggctagacttattacgtcgtcacgttccgactaggaccaggcaggtggactaggtttatgtacgtgttcgggacggg

SEQ ID NO: 125559 - DNA, 520 bp, Homo sapiens
  misc_feature: GYAE6OF01EI6P4.53.31.C09.1.454.CMB.1.raw
  modified_base (240)..(240): a, c, t, g, unknown or other
  misc_feature (240)..(240): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaanatatgcttactggtaccagcagaggccaggccaggccccctgtcttggtgatttataaagtactttgagaggccctcgacgggacccctgagcgattctctggctccagctcgagggacaacgagtcaccgttgacctatcgagtggacgtccggacaggaggacgaggctgactattacgtgtcagtccgcagacagcagtggctagttatgtcgtagttcgggcggagggcgtacgtctggccgtccgtaggtcacgacccaaggctcgccccgtcgg

SEQ ID NO: 125560 - DNA, 726 bp, Homo sapiens
  misc_feature: GYAE6OF01AFXYA.53.31.C09.1.454.CMB.1.raw
  modified_base (187)..(187): a, c, t, g, unknown or other
  misc_feature (187)..(187): n is a, c, g, or t
tcagcgcgtatacacacgaccggtgctcgatttagacgtctcatcaaggaaggaagggggtgggtccagggaggcagaactctgggtgtctcaccatggcctggatcccctctacttcctccccctcctcactctctgcacaggctctgacggccctcctatgagctgacacagtccaccctcggtntctgtcgtcctcgaggacaggacggccgaggactccacctgctcgtggcgatgctattacgaaccaaaactatatgtacttacgtcggtaccagcaggacggccgacggccgaccggccccttggttccgtttggtagtaatttaagtaaacggtcgtttaggacggtaccggtccccgtacggaacccggggtacccctagggacgtaccgtactttccgtccgtcgggtccctcgacgtaccgacggaacggaaccaacgtacgtacctaccgtacgacctacgtacggtacggtcggacccgtaccggacgaagggacggacgggtacgtaccgttacgtaacgtttacgttaccggtcgtaccgtaccggttaccaccggaacgacgacggtacgtagggttacgacgtttaggttacgtcgttacggtcggtacggggacgggtaccggtaccgtccggtccgtaccggtcccgttacggtaccgtaccggtacccgtaccggaccggtccccgtccccgttcccggtacccgg

SEQ ID NO: 125561 - DNA, 541 bp, Homo sapiens
  misc_feature: GYAE6OF01DGNXG.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtacagcagaggccaggcaggcccctgtcttggtgtatttataaagactttgagaggccctcacgggacccctgagcgattctcgtgctccagctcagggacaacagtcaccttcgaccatcaagtggagtccggacaggaggacgagctgactattacgtgtcagtccgcagacgagcaaggtggacctagttacgtggtacgttacgttcgggcgggtagggtaccgtacggcttacggacccggttcctagggacacgacccaagggccctcgccccccgtaccgg

SEQ ID NO: 125562 - DNA, 672 bp, Homo sapiens
  misc_feature: GYAE6OF01CXA4D.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctctacttcctccccctctcactctctgcacaggctctgaggcctcctatgagctgacacagtccaccctggtgtctgtcgtcctcgaggacagacggcaggatcacctgctctggcgatgcattcgaccaaaacatatgtcttactggtaccagcagacggccgacggccacggcccctgtcgttacggtagtaatttaagtaaacgtacgtttggaacggaccggtccccgttacggaccgggtaccccttaggaacgtccgtaacgtttccgttaccgtcgggtaccttacccgaacggtcccgttacggaacggggaaaccctaaacggtacggttaccctaacccgttacgaaccctacgtacgtacggttcggacgttcccgggacgttaacgggaacggtaccggagtaccgttagtaaccgttattaaccgtcgtaccgtacggtcccgacgacggaacctggacctagggtcgtacgtaacgttagtcggttcgttaaggttcgggaaccggg

SEQ ID NO: 125563 - DNA, 563 bp, Homo sapiens
  misc_feature: GYAE6OF01BE1IV.53.31.C09.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
  modified_base (390)..(390): a, c, t, g, unknown or other
  misc_feature (390)..(390): n is a, c, g, or t
  modified_base (440)..(440): a, c, t, g, unknown or other
  misc_feature (440)..(440): n is a, c, g, or t
  modified_base (468)..(468): a, c, t, g, unknown or other
  misc_feature (468)..(468): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatgcattcgaccaaaaacatatgacttactggtaccagcagaggccaggccacgcccctgtcttggtntatttanaaagtctttgagacggcctcgacgggaccctgagcgattcncgtcggctccagcctacgaggaacaacgacgttccaacgttcgaacctntacgaggtcggacgtccggacaggacggacgagctgactattactgtacncgtccacagacagacgagtgactagttnggtcgttagtcggacggacgggtactacggtaccgtcggtcccgtaccgtaaggccgtaaccgcccggtaacggccgttcccggcccccgttcgg

SEQ ID NO: 125564 - DNA, 577 bp, Homo sapiens
  misc_feature: GYAE6OF01D68NT.53.31.C09.1.454.CMB.1.raw
  modified_base (295)..(295): a, c, t, g, unknown or other
  misc_feature (295)..(295): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaaacatatgcttactggtaccagcagagccaggccaggcccctgtcttggtgtatttanaaagtactttgagacggccctcgacgggacccctgacgcgtattctcgtggcctccagctacgagggaacaacagtccaaccttgacccatcgaggtggacgtccggcaaggaggacggaggctagacttattactgtcacgtccgcaacgacagcgaggtcggacttagttatggttacgtagttcgggacgggtaacgggtacgtacggccgttacggtacccgttaccgtaggtccgtaaccggaccccgaaggtccctcccggtcccccgttaccggg

SEQ ID NO: 125565 - DNA, 556 bp, Homo sapiens
  misc_feature: GYAE6OF01BUZK2.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttataaagactttgagacggccctcgacgggacccctgagcgtattctctggctccagctcgagggacaacagtccaccttggaccatcgagtggacgtccggccaggacggacgaggctgacttattactgtacacgtccgcagacagcaggtggctagttagtgtacgtagttcgggcgggaagggtactacggctacggtccccgttcggtcgggtacctacggacccgtaagggtccctcccggtcccccgtacccggg

SEQ ID NO: 125566 - DNA, 540 bp, Homo sapiens
  misc_feature: GYAE6OF01BXRWL.53.31.C09.1.454.CMB.1.raw
  modified_base (378)..(378): a, c, t, g, unknown or other
  misc_feature (378)..(378): n is a, c, g, or t
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacatatgcttactggtaccagcagaggccaggccacggccccctgtcttgggtgtatttaataaagtactttgaggacggccctgaacgggacccctgagcgtattctcgtggcctccgagctcgaagggaccaaacncgtccaccttgaccatcaggtcggagtcccggcaaggaggacgaggctgactattactgtccagtccncgtagacagcgaggtgctagttngtcgtagtcgggnggagggactcgctcggccgtccgtaggtcacggacccgaggcctcccggccccgtcgg

SEQ ID NO: 125567 - DNA, 514 bp, Homo sapiens
  misc_feature: GYAE6OF01DIX6V.53.31.C09.1.454.CMB.1.raw
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagagccaggccaggcccctgtcttggtgtatttataaagactttgagaggccctcgacgggacccctgagcgattctcgtgctccagctcgaggaacaacacgtccaccttgaccatcgagtggacgtccggacaggaggacggagctgactattacngtcagtccgnagacngcaggtgctagttangtcgtagtcgggnggagggacgtacgntcgaccgtcgtaggcacgacccaggctccgccccgtcgg

SEQ ID NO: 125568 - DNA, 547 bp, Homo sapiens
  misc_feature: GYAE6OF01BRQNE.53.31.C09.1.454.CMB.1.raw
  modified_base (337)..(337): a, c, t, g, unknown or other
  misc_feature (337)..(337): n is a, c, g, or t
  modified_base (405)..(405): a, c, t, g, unknown or other
  misc_feature (405)..(405): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccaggccccctgtcttggtgatttataaagactttgagaggccctcacgggacccctgagcgattcnctggctccagctcagggacaacgagtcaccttgaccatcgagtggagtccggccagaggacgaggcgngactagttactgtcagtcgcagacagcagtggacgtagttagtgtacgtagttcgggtcgggaggggtacgtagtccccccccgtggtacccgtacccgtacggtccgacggaccccgaaggcccgtcgcccccgtacccgg

SEQ ID NO: 125569 - DNA, 613 bp, Homo sapiens
  misc_feature: GYAE6OF01DOCOV.53.31.C09.1.454.CMB.1.raw
  modified_base (378)..(378): a, c, t, g, unknown or other
  misc_feature (378)..(378): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatccactgctcgtggcgatgctaatttaccaaaaacatatgtcttacgtggtaccagcagaggccaggccacggcccctgtcttggtgtaatttataaagtactttggagacggccctcgacgggacccctgacgcgtattcgtctggctccgagctacgaggaacaacncgtacacttcgaccatcgaggtcggacgtccggaccgaaggacggaacggacggtacgtagtaacgttacttacgtcgtacgtacggtccgacgagtaacgagcgtagtggactaggttatggttaccgtagttccgggacgggtaacggtaccgtacggtcgttaccgggtacccgttccggtacggtaccgacggtacccgaacggccgtacccggtcccccgtcgggtaccc

SEQ ID NO: 125570 - DNA, 629 bp, Homo sapiens
  misc_feature: GYAE6OF01BLBNO.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcccaggacgacgacggccgacggatcacctgctctggcgatgcgatgacaaaacaaatatgcttacttggtaccgagcgagacggccgacggccgacgccccgtcgttcgttggtggtatttaagttaaagtacgtttggtaagacggcccgtccgacgggaccccgtgacgcgtacttctcgtcggctaccacgctacgagggaacgaacgaagtccgtaaccttcgaccgactcgtacgtgggtaacgtccggccgagaacggacggacgcgtgaacttagttacgtcgtcgagtccgtcaacgacgtagcgaacgtgggtactacgtttagtcgtacggttagtcgggtacgggacgggtaacgtaccgtcgcgtacccggttccgtaggggttccaaaccggcccgaacggtccggtcccgcccccgttccggtacg

SEQ ID NO: 125571 - DNA, 743 bp, Homo sapiens
  misc_feature: GYAE6OF01C2EAF.53.31.C09.1.454.CMB.1.raw
  modified_base (184)..(184): a, c, t, g, unknown or other
  misc_feature (184)..(184): n is a, c, g, or t
  modified_base (226)..(226): a, c, t, g, unknown or other
  misc_feature (226)..(226): n is a, c, g, or t
tcagcgcgtatacacacgaccggtgctcgatttagacgtctcatcaaggaaggaagggcacgaccggtgctcgatttagacgtctcatcaaaggaaggaagggggtgggtccaggaggcagaactctgggtgtctcaccatggcctggatccctctacttcctccccctctcactctctgcacnggctctgaggcctcctatgagctgacacagtccaccctggtntctgtcgtcctcaggacaggacggcaggatcactgctcgtgcgatgcatcgacaaaacatatgacttactgtacagcagagccaggccacgcccgtgtcgttggtcgtatttaataaagtctttagacggtacgtcccgtacgaccgggtaccccgtaggacgtcgtaagttccttcgcgggtcctaccgtacgcccgttacggaacggggtaaccaaaccggtacgttacccgtaacccgttttacgtaaccccgagtttacccggtaaacgggttagggggtaacccgggtttaccccgggacccggttaaacggggaacggggtaacccggtaacgggtacccggttaggttaaccccgtttaacgtttaaccggttaacgttaccgtaaccgggttaacccggaccgttaaagggaacccgttaacgggacccggttacgggtaacgggttacgttaaacggttttaaacgtcgggttttaaccggttagggtttacccggggaaaccggggg

SEQ ID NO: 125572 - DNA, 512 bp, Homo sapiens
  misc_feature: GYAE6OF01BNK8K.53.31.C09.1.454.CMB.1.raw
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagctttgagaggccctcagggacccctgagcgattcnctggctccagctcaggacaacngtcaccttgaccatcagtggacgtccggcagaggacgaggctgactattactgtcagtccgcagacagcagtggctagttatgttcgtagttcgggcggagggacgtacggctcggacccgtccgtaggtcacgcccaaggcctcgcccccgtcgg

SEQ ID NO: 125573 - DNA, 533 bp, Homo sapiens
  misc_feature: GYAE6OF01EVT1X.53.31.C09.1.454.CMB.1.raw
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (427)..(427): a, c, t, g, unknown or other
  misc_feature (427)..(427): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtntatttanaaagtactttgagaggccctgacggacccctgagcattctctggctccagctcgaggacaacagtcacttgaccatcgagttggacgtccggcaggaacggagaggctagacttattactgtacagtccgnagacagcagtggatagttatggtacgtagttccgggacgggtaggactacggacgtcgacccggttctacggcctacggacccgaaggcctccggcccccgtacgg

SEQ ID NO: 125574 - DNA, 621 bp, Homo sapiens
  misc_feature: GYAE6OF01BHPAS.53.31.C09.1.454.CMB.1.raw
  modified_base (226)..(226): a, c, t, g, unknown or other
  misc_feature (226)..(226): n is a, c, g, or t
  modified_base (341)..(341): a, c, t, g, unknown or other
  misc_feature (341)..(341): n is a, c, g, or t
tcagcgcgtatacacacgaccggtgctcgatttagacgtctcatcaaggaaggaagggcacgaccggtgctcgatttagacgtctcatcaaggaagggaagggggtgggtccaggaggcagaactctgggtgtctcaccatggcctggatccctctacttctccccatcctcactctctgcacaggctctgaggcctcctatgagctgacacagtcaccctcggtntctgtgtcctcaggacaggaccggccaggatcacctgctctggcgatgcattcgaccaaaaacaatatgacttactggtaccagcagacggccaggccacggccctgtcttggtntatttaagtaaagtcgtttgagacggtccctacgacgggacccctgacgcgtattctcgtcggctccgagtctacgacggaaccaacgtcgtacctaccgttgaaccctagtcgtacggtgggtacgtcccgggacctaagggacgggtaccgagggtcctagtacgtttaacgtacgttacggtctaaccggttcccggaacgtaaggtaacccggaggaccgtaagggtcgggtacctaaggttttacgtcggttaccgggttaggtaccccgggggg

SEQ ID NO: 125575 - DNA, 597 bp, Homo sapiens
  misc_feature: GYAE6OF01C83F7.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttcctccccctcctcactctctgcacaggctctgaggcctcctatgagctgacacagtccaccctcggtgtctgtcgtcctcaggacagaccggccaggatccacctgctctggcgatgcattcgaccaaaacaatatgcttactggtaccagcagcggccaggccacggcccctgtcgttgtgtatttaataaagctttagagcggccctcgacgggacccctggacgcgtactttctcgtcggcctccagcctacgacggaacaacgagtcctacttcgaccacgtcgaggtcggacgtccggccgaaggacggacggtacggctacgtacttattacgtcgtaccgacggttccgacgtaacggaactacggcgtaagggttcggaccttaggtttaacgttgggttaccggttggttccgggggtaaaccgggggg

SEQ ID NO: 125576 - DNA, 539 bp, Homo sapiens
  misc_feature: GYAE6OF01CPR03.53.31.C09.1.454.CMB.1.raw
  modified_base (297)..(297): a, c, t, g, unknown or other
  misc_feature (297)..(297): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccaggccccctgtcttggtgatttaanaaagtactttgagacggccctcgacgggacccctgacgcgtattctcgtggcctccagctacgagggaaccaacagtccaccttgaccatcaggtggacgtccggaccaggacggacgaggctagacttagttactgtcacgtccgcagacagacaggtgctagttatgtacgtgtcgggcggagggtacgtacgctacggacccgtcgtaggtcgacgacccgaggcctccgccccgtcgg

SEQ ID NO: 125577 - DNA, 731 bp, Homo sapiens
  misc_feature: GYAE6OF01EBWZP.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctgtggcgatgctattcgaaccaaaaacatagtgtactttacgtacggtaaccagacaaggacggaccgacggccacgggtcccccttggttccgtttagggtagttaagttttaaagtaaacggttacgtttaggaacggacggtccccgtacggaaccgggtaccccgtaggacggcgtacgtttccgtcgttcggccctcgacgtccgtacggaacggaactaacgtacgtacctaccgtacgactacgtgtaggtacggtaccgtcccgggaccgaagggacgggaacggacggtcgtaggtaacctttacgttacgtcggtaccgtcgtaccgacgtaacggaacgacggacggtagggtacggtacgttaagtttagtacgggttacggttaaccgggttaccggggacgggaacgggttaccgtacggtacggttacccggtacccgggttaccgttaagggcccgaaccggacccggaaggtccccgtcccggcccccggttaccgg

SEQ ID NO: 125578 - DNA, 528 bp, Homo sapiens
  misc_feature: GYAE6OF01B523Q.53.31.C09.1.454.CMB.1.raw
  modified_base (488)..(488): a, c, t, g, unknown or other
  misc_feature (488)..(488): n is a, c, g, or t
  modified_base (517)..(517): a, c, t, g, unknown or other
  misc_feature (517)..(517): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacaatatgcttactggtaccagcagacgcaggccagcccctgtctggtagatttataaagactttgagacgcctcgacgggacccctgagcgattctctggctcagctcaggacaacagtcacttgaccatcgagtgaagtccggacaaggacggacgaggtctcggaacttagttacgtgtacgtacgtcggacaagacgagtacaggtggcctagttacgtgtcgtagttcgggcggagggactacgngtacgccgtcgtagtcacgtccgaagtcncgtcccctcgg

SEQ ID NO: 125579 - DNA, 537 bp, Homo sapiens
  misc_feature: GYAE6OF01EVW6P.53.31.C09.1.454.CMB.1.raw
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (423)..(423): a, c, t, g, unknown or other
  misc_feature (423)..(423): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggccccttgtcttggtgtatttataaagtactttgagacggccctcgacgggtacccctgacgcgattctcgtggctccngctcgaggacaacngtcaccttgaccatcagtggacgtccggccaggacggacgaggctgactattacncgtcagtccgcagacagcagtcggactagttgtagtcgtagtcgggcggacgggtacgtacgtcgtgcccgtcgtacggtcacggacccgaaggccttccgcccccgttaccgg

SEQ ID NO: 125580 - DNA, 635 bp, Homo sapiens
  misc_feature: GYAE6OF01DQH43.53.31.C09.1.454.CMB.1.raw
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
  modified_base (398)..(398): a, c, t, g, unknown or other
  misc_feature (398)..(398): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgagcctcctatgagctgacacagtcaccctggtgtctgtcgtcctcgaggacagacggccaggactccactgctctggcatgcattgaaccaaaactatatgtcttacgtcgtaccagacagngaccaggccacggtcccctgtcgttggatatttaanaagtcttgagtcgcctcgacggccctgagtcgtattctcgtgcctaccgngcgtacgaacggtacaaacgtacgtacctaccgtttacgaaccctacgttaccaggggttaccgtacggtacccgggaacgtagggaacggggtacgacgggtccgttaggtaacctttacgttaacggttcgttacccggtacggtacccggctaaaccgggaagtacggtacccgaaagggttcgaacggttaagtttacgtaggttaccgggtttaggtccggggtaaccgggg

SEQ ID NO: 125581 - DNA, 742 bp, Homo sapiens
  misc_feature: GYAE6OF01AZ74J.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggactcacctgctcgtggcgatgcattcgaccaaaaacatatgacttactggtaccagcagacgccaggccacggcccctgtcttggtgtatttataaagtctttaggacgacggccctcgacgggacccctggacgcgtattctcgtcgctccagtcctcgaacgggtaccaaacgtacgtacctaccgtttacgaacccgtagttcgaacggttacggggaaccggttaccccgggacccgtaacgggtaaacggggtaacccgggtacgggtacccgttacggtaaccgtttaacgtttaccgttacggtaccgtaaccggttcccggaccgtaacggaaccgtaacggacggtacggtacgggtaccttaacggtttacggtacggttaccggttacggttaccggggtacggggtaaccgggtaccggttaaccggtcggttaccgggtaaccccgttacccggtaacgggttacccggtaaccggtaccccggtaaacgggtcccttacccgggtccccccgttacccggg

SEQ ID NO: 125582 - DNA, 707 bp, Homo sapiens
  misc_feature: GYAE6OF01CT541.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgtcttactggtaccagcagagccaggccaggcccctgtcgttggtgatttataaagtactttgagacggccctcgacgggtacccctgacgcgacttctcgtcggctccagtcctacgaacgggtaaccaacgtacgtacctacccgtttcgaaccctataccgaggtcgggacggttcccggaccgaagggacgggaacggaacgggccttagggaacctttaacgtttaaccgttcgttaccgtaacgggttcccgacgaacggaaccgagggaccgtaacggggttacggtacgttaaggttttacgtcggtttaccggttaacggtttaccggggacggggtaacggggtaacccttaccgggtaccgttaccgggtaacccggttacccgttaacgggtcccgtaaaccgggacccccgtaaagggtccccgtcccgggtcccccccgtttacccggg

SEQ ID NO: 125583 - DNA, 630 bp, Homo sapiens
  misc_feature: GYAE6OF01BS0ZK.53.31.C09.1.454.CMB.1.raw
  modified_base (342)..(342): a, c, t, g, unknown or other
  misc_feature (342)..(342): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacaggacggccagggatcacctgctctggcgatgctattcgaccaaaacaatatgcttactggtaccagacaggacggccaggccacggcccctgtcttggtntatttaataaagtacttagagcgccctcgacgggacccctggacgcgtacttctcgtcgcctccacgtcgtacgaaggaccaacgtacgtcctaccgttacgaacctactacgtacggtggaccggtcccggacgaagggaccgggtaacggacggtacgttagtaaccgttacgttacgtacgtaccgtaccggtacccggtacgaaccggtaaccagggcccgaagggttggaacccttaaggtttaccgtgggtttaccgttacgggttccgggtaacccggggg

SEQ ID NO: 125584 - DNA, 605 bp, Homo sapiens
  misc_feature: GYAE6OF01ES98P.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgacttactcggtaccagcagaggccacggccacggccccctgtcttgggtgtaattttaataaagtactttggagacggtccctcgacgggacccctggacgcgtattctcgtggcctccgagtcctacgaacgggaaccaacgtacgtacctaccttcgaccctagtcgaggtcgggacggtcccggacgaggaacgggacggaggtctagtactagtttacgtcgtcgacgtccgacgacgacaggacgaggtcggactagttatcggttacggtagttccgggacgggagggtactacggctacggtacccgtcgtacggaccacggacccgacggccgtccggtcccccgtacgg

SEQ ID NO: 125585 - DNA, 616 bp, Homo sapiens
  misc_feature: GYAE6OF01BG1QT.53.31.C09.1.454.CMB.1.raw
tcagcgcgtatacacacgaccggtgctcgatttagacgtctcatcaaggaaggaagggcacgaccggtgctcgatttagacgtctcatcaaggaaggaaggggtggtccaggaggcagaactctgggtgtctcaccatggcctggatccctctacttcctcccctcctcactctctgcacaggctctgacggcctcctagtgacgctgacacacgtccacccgtggtcgtcttgtacgtcctcgaggacacggaccggacgaggactcaccgtgctcgtggcatgctagtcgaaccaaaactaatgtgtacttacgtcgtacagacagacgcgacgccgacgtcctgtcgttgtactattaacgaacgtcttagacgtacgcccgtacgaccggtcccagacgtcgtacttctcgtcggcctcgtacgcgtacgaacggacaacgtcgtacctaccgttacgaacctacgtacgacggtcggaccgtaccggacgaaggacggaacgtacggtactaagttacgttacgtacggtcgtaccgacggtccgaccgtacgacgacgacggtaggtcgacgtttacgtacgttacggttacggtcggttcggggaacgg

SEQ ID NO: 125586 - DNA, 795 bp, Homo sapiens
  misc_feature: GYAE6OF01CKLN7.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctctacttctccccctctcactctctgcacaggctctgaggcctcctatgagctgacacagtcaccctggtgtctgtgtcctcgaggacaggacggccaggatcacctgctctggcatgcattcgaccaaaacatatgtacttacgtacggtaccagacgaggacggccgacggcccgacggtcccccgttgtccgtttggggttacgtaaagtttttaaacgaaaacggttaccgtttaggaacggtaccggtccccttacggaaccggggtaccccctggaacgtccggtaacttttccgtaccgttcgggtacccttaccgaggtacccttacggaacggggtaacctaaaccgtcgttaacccgtaacccggtttaccgaaacccgtacgttaccggtaagggttaccggggtaacccggttaccccgggaaccccgggtaaaggggtaaccgggggtaaccccgggtagggttacccgttaacgtaaacccgtttttaagtttaaccccggttacgggttaccgaacccgggttaccccggaacggtaaacggtacccgtacgggtacccggtaaggttcgggtacccttaaagggttttccgtagggttaccgtttaacgggttcggggaaacccgggg

SEQ ID NO: 125587 - DNA, 719 bp, Homo sapiens
  misc_feature: GYAE6OF01BFLFM.53.31.C09.1.454.CMB.1.raw
  modified_base (297)..(297): a, c, t, g, unknown or other
  misc_feature (297)..(297): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacaatatgcttactggtaccagcagaggccaggccaggcccctgtctggtgatttanaaagtctttgagacggtccctcgacggggacccctggacgccgtatttccgtctcgggcctccgacgtcctacgaaggggaaccaaaccgacgttcctaacccgtttgaccctaagttaccgtaaggttacgggtaacggtcccccgggaccgtaacggaacggggaaccggtaacggggtaccttacgtaacgttaacgtttaccgtacggttccgtaacggttccccgtacgaacggtaccgaacggaccgtaagggttacgggaccgtaaggtttaacgttcggttaacggtaggtttccggggacgggtaacggggtaccgtaaccgggtcgtacggtaccccgttaccggttaacgggttaccgtaccggacccccggtaaacgggtcccttacccgggtcccccccgttacccggg

SEQ ID NO: 125588 - DNA, 685 bp, Homo sapiens
  misc_feature: GYAE6OF01DHLNK.53.31.C09.1.454.CMB.1.raw
  modified_base (221)..(221): a, c, t, g, unknown or other
  misc_feature (221)..(221): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgnggcatgcattcgaccaaaacatatgcttaatcggtacagacagaggccacggccacggcccctgttcgttggtacgtaatttaataaaagtactttggaacgcggccctacgaaccgggccctagacgcgtatttctcgtcggcctcgagtccgtacgaacgggtaaccaaacgtagtaccgtaaccttacgaaccgtactacgtaacggttcggggaaccgtccgggaaccgaaaggacgggaacggaacgggtacgtacgtaacctttaagttaaccgtcgtaccgtaacggttcccgaaccgaagaaaccgacggtacgaacgggttcgggacgttaaggtttaagtacgttacgggttaacgttcggggacgggtaacgggaacgtacggtacgtcgggtaacccgttacggtacgtacccgtacgaaccccgtaaggcctcccggtcccccggttacgg

SEQ ID NO: 125589 - DNA, 656 bp, Homo sapiens
  misc_feature: GYAE6OF01CCE94.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaacaatatgtacttactggtaaccagcgagacggccgacggccacggtccccctgttccgttggtacgtattttaataaagtacgtttggagacggcccctcgaccgggtacccctgacgcgtattcgtcgtcggcctccgacgtctacgaacgggaaccaacgtacgtacctaacccgttcgaaccctacttacgagggtcgggtaccggtccccggaccgaagggaacgggaacggaacgggtccgttaacgaacctttaacgtttacgtacgttacgacgttcccggacgaacggaaccgacgaccgaggttcggacttaacgtttagtcgttacggttacgttcgggacgggtaacggtaccgtacgtcgtacggacccgttcgtacgcgacgaccaaggccgtccgccccgtacg

SEQ ID NO: 125590 - DNA, 669 bp, Homo sapiens
  misc_feature: GYAE6OF01E11PA.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctcccccctcctcactctctgcacaggctctgaggcctcctatgagctgacacagtccacccttggtgtctgtgtcctcgaggacagacggccaggatccacctgctcgtggcatgctattcgaccaaaaactatatcgacttacgtcggtaccagcgagacggccaggccacggccccttgtcgttggtatatttaagaaagtcgtttaggacgtaccggccctacggaccggtacccgtggacgtacgtacttcgtacgtcggtccctaccgtacgccgttacggaacggaacctaacgtacgttaccgtaccgttacgacccgtagtacggacgggttacggaccggtaccccggaacggtacgggaaccgggtaacggtcggtaccgttacgtaaccgtttacgttaccgtacggtacgtccggtacccgacgaacggtaccgagtacgtagggtcgtacgttagttgtacgttggtacggtcgggacggacggacgtcgtcgacgtcccgttacgagtccgaccggcgacgcccgtcccgcccggttcg

SEQ ID NO: 125591 - DNA, 732 bp, Homo sapiens
  misc_feature: GYAE6OF01BUJFD.53.31.C09.1.454.CMB.1.raw
  modified_base (222)..(222): a, c, t, g, unknown or other
  misc_feature (222)..(222): n is a, c, g, or t
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctctacttctccccctctcactctctgcacaggctctgaggcctcctatgagctgacacagtcaccctggtntctgtcgtcctcgaggacaggaccggccaggactcacctgctcgtggcgatgctattcgaccaaaacaatatgtacttactcggtaccagacaggacggccacggacccgtacggcccccgttggtccgtttgggtacgttaagttttaaacgtaaaacgttacgttttacggaaacggtaccgggtaccccgttaccgggaaccgggggtaccccccgtaggaaaccggtaccggttaacgtttcccgttaccgttacgggtaccccttcccgaacggtaccgttacccggaaacggggtaaccaaaccgtacggttaccctacccgtttaacgacccttaagtccgaacggttacgggaccggtacccgggacgaacgggacgggtaacccggagggtacgttacgaactttacgttaacgtcgtacgtaccggtaccgccgaaggaccacggtcgtaacggtcggacgtacgttacgtaggttcgggttacgtcggggtaaccgggg

SEQ ID NO: 125592 - DNA, 750 bp, Homo sapiens
  misc_feature: GYAE6OF01COZX7.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctctacttctccccctcctcactctctgcacaggctctgaggcctcctatgagctgacacagtccaccctggtgtctgtgtcctcgaggacaggaccggccaggatcacctgctcgtggcgatgcattacgaccaaaacaattatcgtacttacgtacggtaacccaggcgaaggacggccgacgggcccgacggtcccccgttggttcgtttgggttagttaaagttttaaagtaaaacgttacgttttagggaacgtacgggtccccttacggaacccggggtaaccccccgttagggaaccggtaccgtaacgttttcgtacccgttcgggtacccttacccgacgtccgttaccggaacgggtaaaccctaaaccgtacgttaaccctacccgtttaccgaaccctacgtaccgacggttacgggaccggttcccgggaccgaagggaacggacgggtacgggtaccttaacggaactttacggttaaccgtggttaccgtacggtaccccggtagaaccggacgtaggtaccggtagggtacggtacgttaggttaacgttcgggttaccggttacggttcccggggtaacgggg

SEQ ID NO: 125593 - DNA, 539 bp, Homo sapiens
  misc_feature: GYAE6OF01E4YPC.53.31.C09.1.454.CMB.1.raw
  modified_base (520)..(520): a, c, t, g, unknown or other
  misc_feature (520)..(520): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaacaatatgcttactggtaccagcagaggccaggccacggcccctgtcttggtgtatttataaagactttgagcggccctcgacgggacccctgagcgattcctcgtcggctccgagtcctacgagggacaacgacgtcctaccttgacccatcgagtggacgtcccgggccaaggacggacgaggtctgaacgtattactgtccagtccgacgacgtacagtccagtggcctaggttanggtcgtgttccgggacggg

SEQ ID NO: 125594 - DNA, 688 bp, Homo sapiens
  misc_feature: GYAE6OF01DME7V.53.31.C09.1.454.CMB.1.raw
tcagcgcgtatacacacgaccggtgctcgatttagacgtctcatcaaggaaggaagggcacgaccggtgctcgatttagacgtctcatcaaaggaaggaagggggtggtccaggaggcagaactctgggtgtctcaccatggcctggatccctctacttcctccccctcctcactctctgcacaggctctgaggcctctatgagctgacacagtcaccctggtgtctgtcgtcctcgaggacagaccgcaggatcacctgctcgtggcgatgaccattcgaaccaaaaactaatatcgtacctttaacgtcggtaaccagacgaaggacggaccgacgggcccgacggcccccttggttacgtttggtacgtttaaattttaagtaaacggttacgtttggaacggtaccggtacccttacgggaacccgggtaccccgtaggacggtacgttacttcctcgttacggccctaccgtacggacttacggaacgggtaaccaactaccggtacctaccgttagaccctattaccgaaggttcgggacgtcccggacgaagggtaacgggacgacgggtctagtaacttacgtacgttacgcgtacggtccgcgtaaacgaccgaggtcggtaaggtcggtaaccttaggttaacgttacggttacggttaacgggtcgggtaaacgggg

SEQ ID NO: 125595 - DNA, 613 bp, Homo sapiens
  misc_feature: GYAE6OF01CQ8HB.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctctacttctcccctctcactctctgcacaggctctgaggcctcctatgagctgacacagtccacccgttcggtgtcctgtcgtcctgaggacaggacggccaggactcacctgctcgtcggcgatgcattcgacaaaacatatgtcttacgtcgtacagcgagacgcacggccacggtccctgtcttggtatattaagtaagtacttgacgtcggtcctacgacggtccccgtaggacgtcgtacttcgtcgtcgcctaccgagtaccgtacgaacgggaacaacgtacgtaccgtaccgttacgaccctagtaccgaggtacggaccgtaccggaccgtaaggaccgggtaaggacgtacgtacgtaaccgttagtaccgtcgtaccgaccgttccgacgacgaaccgagtccgaggttagtacctaggttacgttagtacggtacgttccggggaacggg

SEQ ID NO: 125596 - DNA, 780 bp, Homo sapiens
  misc_feature: GYAE6OF01DGX9P.53.31.C09.1.454.CMB.1.raw
  modified_base (128)..(128): a, c, t, g, unknown or other
  misc_feature (128)..(128): n is a, c, g, or t
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (645)..(645): a, c, t, g, unknown or other
  misc_feature (645)..(645): n is a, c, g, or t
tcagcgcgtatacacacgaccggtgctcgatttagacgtctcatcaaggaaggaagggcacgaccggtgctcgatttagacgtctcatcaaggaaggaggggtggtccaggaggcagaactctgggtntctcaccatggcctggactccctctacttcctccccctctccactctcgtcgcacgaggcctctggaggtccctcctatggagtctggacacgacgtccacccgttgggtntccgtggtcgtccctagaacggaccagggaaccgcctaagggtactcctaccgtcgctcgtacggcgtagtcgngtatacgaaccaaaactagttacgtcgtaccttacgtacggtaaccagacgacggacgggacccgacgggacccgtaccggtacccgtacgttcggtttaccggtagttaacgtttaaacgtaaacgtacggtttaggaaacgtaccgggtaccccgtaaggtacccgggtaccccgtggtaaccgtaccggttacttccgtcggtacggtacccgttaccgacggtcggttaaacggaaccgggtaactaaacccgtaggttacccgtaaccgttacggaaccccgtagtaccggtaaccgggtaggtaccggtaccgggacgtaacgggnggaacccggtacggtgttaaccgttcttaacgtcgttacggtcgtaaccggtcggtacgaacggtacggactccggttaacggcgtaaccgtttagttaccgggacggtttccgtacgggtccgggtaaccgggg

SEQ ID NO: 125597 - DNA, 769 bp, Homo sapiens
  misc_feature: GYAE6OF01AJXID.53.31.C09.1.454.CMB.1.raw
  modified_base (181)..(181): a, c, t, g, unknown or other
  misc_feature (181)..(181): n is a, c, g, or t
tcagcgcgtatacacacgaccggtgctcgatttagacgtctcatcaaggaaggaagggcacgaccggtgctcgatttagacgtctcatcaaggaaggaaggggtggtccaggaggcagaactctgggtgtctcaccatggcctggattccctctacttctccccctctcactctctgcacnggctctgaggcctcctatgagctgacacagtcaccctggtgtctgtcgtcctgaggacaggaccggccaggactctaccgtgctctggcgatggcattcggaccaaaactaatacgtggtactttaccgtagggttaacccgagtacgacgggacgggacccacgggaccccgaacgggtccccccttaggttccgtttcgggtagttaacgttttaaagtaaaacgttacttttagggaacggtaccgggtcccctaccgggtaaccggggtacccccgttaggtaaccggtcggtacgttttacccgtcgtacggtccgtaccgtacggtacccttacggtaacgggaaccaaaccggttacgttaccgtaccctttacggaaccctataccggtaacgggtcgggtaccggttacccgggaccgtaacgggaacgggaacggggtacgggtccgttaacgggtaacctttacggttaccgttacggtccgttacgggtacccgtacggaaccggtacgaacggtcgtaagggttacggacgttagttacgttacgggttcgtttaacgggtccggtaaccggggg

SEQ ID NO: 125598 - DNA, 517 bp, Homo sapiens
  misc_feature: GYAE6OF01A9XAS.53.31.C09.1.454.CMB.1.raw
  modified_base (367)..(367): a, c, t, g, unknown or other
  misc_feature (367)..(367): n is a, c, g, or t
  modified_base (457)..(457): a, c, t, g, unknown or other
  misc_feature (457)..(457): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagacttttgagaggccctcagggacccctgagcgattctctggctccagctcaggacaacagtcaccttnaccatcgagtggagtccggcagacggacgaggctgacttatactgtcagtccgcagacgagcgagtggcagttatgtacgtagttcgggnggagggactacgctacggccgtcgtaggtccgacgacccaagggcctcggtcccctccgg

SEQ ID NO: 125599 - DNA, 729 bp, Homo sapiens
  misc_feature: GYAE6OF01EZUS2.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatccacctgctctggcgatgcattcgaccaaaaacatatgacttacgtggtaccagcagacggccacggcccgacggccccttgtcgttggtagtatttaagtaaagtactttgagcggccctcgacgggtacccctgacgcgtattcctcgtcgcctccgacgtcgtacgaacggaaccaaacgtacgtaccctaccgttacgaaccctaatcgtacggtacggaccggtaccggacgaagggacggaacggacggcgtacgtaacttaacgttacgttcgtaccgacgttcccggacgacggtaaccacgggtaccgtagggtcgggtacgttaacggttttacgtacggttaccggttacgggttacccgggtacggggtaaccgggttacccggttaacggtccccggttaacgggtaaccccgtttacccgggttaaacccgggtaccgtaacccggggtacccccggtaaagggtccccggtttaaccccccggtcccccccgggttacccgggg

SEQ ID NO: 125600 - DNA, 808 bp, Homo sapiens
  misc_feature: GYAE6OF01CJ42H.53.31.C09.1.454.CMB.1.raw
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggccctcctatgagctgacacngtccacccgtggtntctgtcgtcctgaggacagacggccaggatccacctgtctcgtggacgtatcgactagttacgaaacctaaaaactaattatcgtaccttaacgtacgggtaaccagccgaaggacggccgaacgggcccgtaccggtccccttggttaccgtttggtagttaaacttttaaagtaaacgtaccgttttaggaacggtaccgggtcccctaacggaacccgggaccccgtaggaccggtacgttacgtttccgtcgtacgggtccctacgtacgtcgttaacggaaccggaacaaaccgtacggttacctaaccgttacgaacctacgttacggtaacggtcgggtaaccggtccccggaacgtaaggggtaacgggacggtaaccggtccgttaacgaaccgtttacgttaccgtacgttacccgtacgcccggtaacgagaaccgtaggacggtaacggtggtaacgttaggtttaagtccgggttaacgggtttcgggaccggggtacggggtacggtaaccttaaccggggtccgttaacccggtacccggttaccggtacccgggtaacctacccgggtaaccgacccgggttcccctcccccggtccccggttacccgg

SEQ ID NO: 125601 - DNA, 656 bp, Homo sapiens
  misc_feature: GYAE6OF01BODBG.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacactagtccacccttggtgtctggtcgtcctcaggacaggaccggccaggactcacctgcctcgtggacatcgcattcgaaccaaaaacatatgtcttacgtgtaccagcagacggccgaggccacggcccctgtcgttggtatatttagtaaagtactttagagtacggtccctcgacgggtccctgacgcgtacttcgtcgtcggctccgagtcgtacgacgggtaacaacgtacgtacctacccgttacggaccagtcgtaaggtcgggaaccggtaccggacggtaaggaacgggacgaacggtccgttacgtactttaagttaccgtgttacgacgtccgacgtaagaccaggtacgacggttgacgttaacgttagtcggttacgttacggttcgggtacgggtaacggtcgtaccggcttacgggtacccgtaccggtacgtaccggtaccgtaccgtaacggtccgtccccggtccccgtccgg

SEQ ID NO: 125602 - DNA, 776 bp, Homo sapiens
  misc_feature: GYAE6OF01BIHDB.53.31.C09.1.454.CMB.1.raw
  modified_base (139)..(139): a, c, t, g, unknown or other
  misc_feature (139)..(139): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacnggctctgaggcctcctatgagctgacacagtccacccgtggtgtctgtcgtcctacgacggacacggaccggccaaggactccgacctggccttcgtggcgtagtcgacctaagttccgaaaccaaaaaactattatcgtacgttaacgtacggtaccagacgaggacggcccgacggccgaccggtcccccgttggtttccgtttagggtagttaacgttttaaacgtaaacggttacgttttacgggaacggtaccggtcccctaccggaccgggtaccccgtaggacgtaccgtacgtttccgtcgtacggcctaccgacgtaccgtacgaacggacaacgtcgtacctacgtcgactacgtacgacggtaggaccggtaccgacgtaacggaccgggtacgaacggtccgtaagttaccttacgttaccgtcgtacgtaccgtacccggtaacgacgacgaacggtcgtagggtccggtaagttacggttacgtacggtttacggtaccggttacggggaccggtacgggtaccgttaccgggtcctaccgggttacccggttaaccggtaccggtaccgacccgttaaccccgggaggtcccccgttacccccggtccccggttaacccggg

SEQ ID NO: 125603 - DNA, 817 bp, Homo sapiens
  misc_feature: GYAE6OF01DLIS2.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctagacacagtccacccgtggtgtctgtcgtcctcgaggacaggacggccaggactcacctgctcgtggcgtatcgctagttaccgaaaccaaaaactattaattcgtacctttaccgtacgggtaaccaggacgacggaccggccgaacggcccgtacccgggtccccttggttaccgtttggtacgttaattttaaagtaaacggtcgttttaggaacgtacggtcccctacggaccgggtaccccgtagacgtacgttacttccgtacgtcggtaccaccgtaggtacccgtaacggaacgggtaacctaaaccgtacgttacccctaacccggttacgaaccccgtagttaccggtagggtaccgggtaaccgggtcccccgggtaacgggacgggtaacggggaacggacgggttacgtaacgtaccgttaacttaccgtacgtccgtacgtacccggataacggtacacgggtacgacgggttacgtaacgttacggtttacgtacgggttacgttacgggttaccggggaaccggggtaacgggtaaccctaccgggtacgttccccggtaacccggttacggtaacccggttaccgaacccggtaccccggaaccgggttccccggtccccggttacccccgggttccg

SEQ ID NO: 125604 - DNA, 625 bp, Homo sapiens
  misc_feature: GYAE6OF01DNR51.53.31.C09.1.454.CMB.1.raw
  modified_base (110)..(110): a, c, t, g, unknown or other
  misc_feature (110)..(110): n is a, c, g, or t
  modified_base (254)..(254): a, c, t, g, unknown or other
  misc_feature (254)..(254): n is a, c, g, or t
  modified_base (518)..(518): a, c, t, g, unknown or other
  misc_feature (518)..(518): n is a, c, g, or t
tcagcgcgtatacacacgaccggtgctcgatttagacgtctcatcaaggaaggaagggggtgggtccaggaggcagaactctgggtgtctcaccatggcctggatccctntacttctcccccctcctcactctctgcacaggctctgaggcctcctatgagctgacacagtcaccctggtgtctgtcgtcctacgaggacaggaccggccaggatccacctgcctcgtggacgatgctattcgaacccaaaaanatatgcttacgtcggtaccagcagacgcgacggccacggcccccttgtacgttggtagtatttaagtaagtactttggagacgtcccttaggaaccggcccctagagcgtacttctcgcggcctcgagcctaggacggaacaactcgtaccaccgttacgaacctagtacgtaggtcggtaccggtcccggacgaagggacgggaacgacgtcgtagtaaccgttatttaacgtcgtacgtacggtccacgaagaccgagacgnggttacgactagttagtcgttacgtagttcgggacgggaaggtccgacgtccgccggtacgttccggtagtaccgacgacccgtaagtcccgaccgtccccgtaccg

SEQ ID NO: 125605 - DNA, 744 bp, Homo sapiens
  misc_feature: GYAE6OF01CLW16.53.31.C09.1.454.CMB.1.raw
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
tcagcgcgtatacacacgaccggtgctcgatttagacgtctcatcaaggaaggaagggggtgggtccaggaggcagaactctgggtgtctcaccatggcctggatccctctacttcctccccctcctcactctctgcacaggctctgaggcctcctatgagctgacacagtcaccctggtntctgtcgtcctcaggacaggacggccaggactccacctgcttcgtcggngatggacattcgaaccaaaaactaattatgtaccttacgtacggtaacccagacgaacggacggacccgaaggaccgtacggtcccccgtgttaccgttaggtagtacttttaaagtaaaaggtacgttttagaacggacggtcccctacggaccgggtacccctaggacggtacgtacttcgtacgtcggccctaccgacgtcgtaaccgacgggaacaacgtacggtcctaaccttcggaacctactacgtaaggtcgggtacgtccggaaccgaggaccggtaacgggaggtccgtacgtaacgttaacgttacgttacggtaccgtacggtcccgagaacgaactacggacgaggtcggtacgtaacgtttagtcggttacgttacgggttaccgggcgggttaaacggtccgtaccggtaccgttacgggtacccccggttacggtaccggtacccgtacccgggaccccgtaaagggtcccccgttccggtacccccccgttaccggg

SEQ ID NO: 125606 - DNA, 607 bp, Homo sapiens
  misc_feature: GYAE6OF01BCFPI.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggactcacctgctcgtggcgatgcattgaccaaaacatatgcttactggtaccagcagaggccaggccacgccccttgtcttggtgtatttaataaagtactttgaggacggcccctcgacgggacccctgacgcgtacttctcgtggctccaggcctacgagggacaaacgacgtaccaccttgacccataccgtaggtcggacgtaccggcgaggacggacgaggcgtagtacttattacgtcgcacggtccgacgacgacgagtcgaggtagacgtagttacgtgttacgtaggtttcgggacgggtaacgggaccgtaccgggcgttaccgggtaccgttacccgtacggttaccgtacgaccccggaacggtccgtccccggtccccggtacccgg

SEQ ID NO: 125607 - DNA, 636 bp, Homo sapiens
  misc_feature: GYAE6OF01D7N65.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccaccctcggtgtctgtgtcctcaggacagacgccaggatcacctgctcgtggcgatgctattcgaccaaaacatatgtacttactcggtaccagcaggagccacggccacggcccctgtcttggtgtaatttaagtaaagtactttgagtacgtccctcgacgggtacccctagacgtcgtacttctcgtcggtacctccgagtccgtacgaacgggactaaaccgtcgtacctaccttacgaccctagtacgtaggtcgggacgtccggactaacggacggacggacggctacgtaactttaacttacgtgtaccacgtccgacgagaacgacgtcgagtacggtagtagttcttacggtcgttaaggtccgggtacggtaacgggtacgtaccggtacgttacggtacccgtaccgtaaggcccgtacgacccggaacggtcccgtaccgcccccgttaccgg

SEQ ID NO: 125608 - DNA, 794 bp, Homo sapiens
  misc_feature: GYAE6OF01E4ZWY.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccacccgtggtgtctgtcgtccctcgacggacaggaccggcccaagggacttccaccgtgccttcgtgggcgattcgactatttacggaaacccaaaaataagttcgtacgaccgttttaacgtacggttaacccaacggtaccgaacgggtacggacccgacgggtccccgaccgggtccccccgtttgggttaccgttttagggtacgttaaagtttttaaacgtaaaacggttacgttttaggaacggtaccggtaccccgtacggaaccgggtacccccgtaggacggtacgttaccgtttccgtccggtacggtccctacccgtacggtaccgttaccggaaacggggaaccctaaaccgttacggttaccccgtaacccgttacggaaccctacgttaccggtacgggtacgggtacccgggtacccgggaccgaacgggaacgggtaacggtacgggtaccgttacgtacgtttacgttacgtcgtaccgtacggtccgacgaacgaccgacgcgtaggtgtactagttacgtcgttacgtcgtcgggacggacgtcgtcgtcgtcggtaccgtcgaggtaccgacgacccgtaggcccgtaccgtccccgttacgg

SEQ ID NO: 125609 - DNA, 732 bp, Homo sapiens
  misc_feature: GYAE6OF01BET5F.53.31.C09.1.454.CMB.1.raw
tcagcgcgtatacacacgaccggtgctcgatttagacgtctcatcaaggaaggaagggggtgggtccaggaggcagaactctgggtgtcgtcaccatggcctggatccctctacttctccccctcctcactctctgcacaggctctgagacctccgtatgagctgacacagtcaccctggtgtctgtgtcctcaggacaggaccggccaggactcacctgctcgtggcatcgcattcgaaccaaaaacgtatctgtcttactggtaaccagtcaagacggccacggccgacggtccccctggtcgttggtgtactttaataaacgtcgtttagagtacggccctacgaacgggtcccctgagccgtattccgtcgtcggccttccgacgtccctacggaacgggaactaacgacgtactacccgttgaccctagtaccgaaggtcgggaccggtcccggacgaacgggaacgggtaccggaacggtccgttagtaacgtttacttaaccgttcggtaccgtaacggtccccggaccgtaaccggacgaacggtacggtaacgggttccgggaactttacgggttagttaccggttaccggttagggttaccggggacggggtaacgggttaaccctacgggttaccgtcccggtacccggttcccggtaaacggttcccggaacccggaccggtaaccgggtcccgttccccggtcccccgggtttacccgg

SEQ ID NO: 125610 - DNA, 777 bp, Homo sapiens
  misc_feature: GYAE6OF01CO413.53.31.C09.1.454.CMB.1.raw
  modified_base (140)..(140): a, c, t, g, unknown or other
  misc_feature (140)..(140): n is a, c, g, or t
  modified_base (172)..(172): a, c, t, g, unknown or other
  misc_feature (172)..(172): n is a, c, g, or t
  modified_base (188)..(188): a, c, t, g, unknown or other
  misc_feature (188)..(188): n is a, c, g, or t
  modified_base (235)..(235): a, c, t, g, unknown or other
  misc_feature (235)..(235): n is a, c, g, or t
  modified_base (739)..(739): a, c, t, g, unknown or other
  misc_feature (739)..(739): n is a, c, g, or t
tcagcgcgtatacacacgaccggtgctcgatttagacgtctcatcaaggaaggaagggggtgggtccaggaggcagaactctgggtgtctcaccatggcctggatccctctacttcctccccctcctcactctctgcacnggctcgtgacggccctactagtgagctgacanacgtccacccgtggtntctgtctccagacgacgaggaccggccaagctccactgctacgtggnacgtgactagtaccaaaacctaaaatattagttacgtacctttacggtacggaaccaacggacgtaacggaccggacccgaacgggtcccctaccggtccccgtttggttccggtttaggttaattacgtttaaacgtaaaacgttcggtttacggacggtacccgggtaccctacgggtaaaccccggtcccggttaaggaccggttactactttccgtccgtacgttccctacgacgcgtaacggaacgtaacctaacgtcgtaccttcggtaaccgaacgtcgtaacgtagggtaccgggtacccgaccgggtaacgtaaaggggacccgtaacggggtacgttaccggtattaaacccgtttagtacgtaccggtactacccgggtacaacgttaacgacgacggtaggtacggtcgaagtttacgtaggttcggtacggttacggcggggaccggtaagtccgtaaccgtggtaacccgggtacttacggtcggacccncgggaaccttcccggtccgtcccccggttcccggtacg

SEQ ID NO: 125611 - DNA, 760 bp, Homo sapiens
  misc_feature: GYAE6OF01B6268.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctctacttctccccctcctcactctctgcacaggctctgaggcctcctatgagctgacacagtccaccctggtgtctgtctcctgaggacagaccggccaggactcaccgtgctccgtggcgatcgcattacgaacctaaaaacaatactacgtacctttaacgtcggtaaccagaccgaggacggaccgacgggacccgaacgggtcccccttaggttcgtttacgggttagttaacgttttaaagtaaaacggttacgttttaggaacggtaccggtaccccgttaccggaacccgggtacccccgtaggaccggtaccgtacttttccgtccggttcggtaccttcccgaaggtccctaccgggtaaacgggaaccctaaacgtaccgttacccttacccgtttacgaacccctaagttaccggtagggtcggtaccgggtacccggaccggaacggggtacgggaacgggtacgggtaccgttcggtaaccgtttacgttaacgttccgtacgtaccgggtacccgtacggaaggtaacccggcggttacggaggttcggtacgttagttaacgttcggttaccgttagggttcccgggtacgggg

SEQ ID NO: 125612 - DNA, 753 bp, Homo sapiens
  misc_feature: GYAE6OF01DUEH1.53.31.C09.1.454.CMB.1.raw
  modified_base (110)..(110): a, c, t, g, unknown or other
  misc_feature (110)..(110): n is a, c, g, or t
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
tcagcgcgtatacacacgaccggtgctcgatttagacgtctcatcaaggaaggaagggggtgggtccaggaggcagaactctgggtgtctcaccatggcctggatccctntacttctccccctctcactctctgcacaggctctgaggcctctatgagctgacacacgtccaccctggtntctgtcgtcctnaggacagacggccagctcactgctcgtggcgtatgactagttcgaaccaaatatctgtactttacgtacggtaccagacgaacggtcggacccgacgggacccgtaaccggtcccccgttaggtttaccggtttagggttaacggtttaactttttaaaacggttaaaacggttaccggttttaggaaccgggtacccgggttaccccgtaacggtacccggggtaacccccttagggacccggtacgtttaacgtttccgttacgccgggttacctaccgtagtcctaacgggacggtaacctaaacgtcgtaacctaccggttcgacctagtacggtaggtacggtaccggtcccggacgaacggtacggaaccggtcgtacgttcgtaaacgtttacttaccggttacgtaccggtaccgtaccggaaccgaacgtaacggacggtacgtagggttaccctaggttacgttacggtcgtaacgggttcgtcgggacggtacgtcctacggtctacgtccgttccgagtccgacgaccgacggtcctcccgtcccgtcg

SEQ ID NO: 125613 - DNA, 970 bp, Homo sapiens
  misc_feature: GYAE6OF01DCPN7.53.31.C09.1.454.CMB.1.raw
  modified_base (140)..(140): a, c, t, g, unknown or other
  misc_feature (140)..(140): n is a, c, g, or t
  modified_base (189)..(189): a, c, t, g, unknown or other
  misc_feature (189)..(189): n is a, c, g, or t
tcagcgcgtatacacacgaccggtgctcgatttagacgtctcatcaaggaaggaagggggtgggtccaggaggcagaactctgggtgtctcaccatggcctggatccctctacttcctccccctcctcactctctgcacnggctctgaggcctcctatgagctgacactacgtccaccccgttcgggtntcgtgtcgtcctcgagggacacggaccggccgaggtactcctaccgttgccgttccgtgggccgtattcggacctaactttacggaaaacccctaaaaatagttactcggtacctttaccggttacggtaacccaggactaacgggaaccgggacccgaaccgggtaccccgtccccgggtccccccgtttaggtttccgggttttagggttacggtttaaattttaaacggttaaaacggtaccgttttacgggaaacggtcccgggtacccccgttaccgggaaacccgggtacccccgtagggtacgtaccgttacggtttcccgtaccggttcgtacccggtaccgtaacgtccggtaaccggaaccgggttaaccaccggttactaccccgttaccgtaccgtaacctacggttacgaagggttaccggggccggtacggacgggaaacggtcgggaacggtacgggtccgttaacgtaacctttaacggtttaccggttggtaacccgtttaccgggtccccggaaatacggggaaacccgcgtttacccggggttaaggttccccggggtaacgttttagggttaaccggtttggggtttacccgggttaaggggttaccccgggggacggggtttaaacccgggtaccgtttaacccgggacccggttttaccggaaacccccggggttttttccggaacgttaccgggaaaacccgggtcccccgttaaaccgggggtccccgttacccccgggtccccccggtttaccggg

SEQ ID NO: 125614 - DNA, 827 bp, Homo sapiens
  misc_feature: GYAE6OF01AWAOO.53.31.C09.1.454.CMB.1.raw
  modified_base (181)..(181): a, c, t, g, unknown or other
  misc_feature (181)..(181): n is a, c, g, or t
tcagcgcgtatacacacgaccggtgctcgatttagacgtctcatcaaggaaggaagggggtgggtccaggaggcagaactctgggtgtctcaccatggcctggatccctctacttctcccccctcctcactctctgcacaggctctgaggcctcctatgagctgacacagtcaccctggtntctgtgtcctgaggacaggacggccaggatccacctgctcgtggcgatgctattgaccaaaatatatgcttactggtaccagcagacggccaggtccgacggtcccccttggttcgtttcggtaggtacttttaagtaaacggtacgttttaggaaggtaccggtcccccttacggaaccggggaccccccttaggaacggtccgtaacgttttccctccgttcgggtccccttacccggaacgtcccgttaccggaaccggggaaccctaaacgtacggttaacccgacccgtttacggaaccctagtaccgtacggtcgggtaaccgtaccccgggacgaacgggtacggaaccggtaacgggtccgttacggtaacctttaacgtttaccgtagggttaccccgagggtttaccccggagaaccggaacgtacggaccggttacggtacggggtaccttaagggttttacgtacgggttaaccggtttacgggttaccggggacccgggggtaaacggggttaccgtacccgggtaccggttaacccggtcccggtttaacccgggtaacgggtttaccccggaacccgggacccgtaaacccggggtcccgtttacccccgggaccccccggtttccccggg

SEQ ID NO: 125615 - DNA, 623 bp, Homo sapiens
  misc_feature: GYAE6OF01E0DY5.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctcgtggcatgctattcgaccaaaaacatatgactttacgtggtaccagcgagacggccaggccacggcccctgtcgttggtgtaatttataagtacttgagcgcctcgacggaccctgagcgtattctcgtgcctcgagctacgacggacaacgagtcctacgttacgacctagtcgacggtaggaccgtccggacgaaggacggacggagtcgtagacttaattcgtacgtcgtacgtcccgagaacggacgacgcgtaggtcggacgttagttagtaggttacgttaggtccggggtagggtaacggggttaccgtaccggtaccggtacggtaaccccggttaccggtacgtcccgtaaccgggaccccgttaagggtcccttccccggtccccccggttacgg

SEQ ID NO: 125616 - DNA, 766 bp, Homo sapiens
  misc_feature: GYAE6OF01AQLCB.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatgcattcgaccaaaaacaatatgcttactggtaccagcagacggccaggcccacgggccccctggtccttgggtactattttaataaaagtacttttggacgacggcccctcgaacgggacccccttgacggccgtatttccgtacgttcgggcccttaccgacggtccgtacggaacggggtaacccaaaacgtacggttaccctaacccgtttacggaacccctaagttaccgtaagggttacggggtaaccgggttacccccgggacccgaacggggtaacgggaaccgggtaacgggtaccgtacggtaaccgtttaacgtttaaccgttcggttacccgtaacggttccccggacgaacggaacgtaccggtaccggtaagggttacgggtacgttaacggtttacgtcggttacggttacgggttccgggtacgggtaacgggtaccgttaccggtcggttaccggtacccggttacccgtacgggtaccgaccggtacccgaacggtcccgtcccggtccccccggttaccgg

SEQ ID NO: 125617 - DNA, 817 bp, Homo sapiens
  misc_feature: GYAE6OF01A5ALE.53.31.C09.1.454.CMB.1.raw
  modified_base (181)..(181): a, c, t, g, unknown or other
  misc_feature (181)..(181): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccaccctggtntctgtgtcctcaggacagacggccaggactccacctgctcgtggcgtatgactattcgaaccaaaaacattagtagtccttacgtacggtaccagcgaggacggccgacggacccaaccgggtcccccttggttccgttttagggttacgttaatttttaaacgtaaaacggttaccgttttaggaacggtacggtaccccgtaccggaaccgggtacccccgtaggacggtaccggttaacgttccgtacgtccggtccgttacccgaacggttcccgtaaccggtaacgggggaaccctaaaacgtacggttaacccaaacttaacgtttaccggaaccttaacgtaccggtaaacggttaccggggtaacccgggttacccgggaaccggtaacggggaacgggtaaccgggtaagggtaccgttaacggttaaactttacgtttacgttacggttaacgtaccggtaccgtaccgaagaccgacggtaccgtaggtacggtaccgtaggttacgtacggtacggttacggttaccggggacgggtaacggtacgtaccggtccgtaaccgggtacccgttaccggtacggtacccgaaccggcccgtaacgtcccgtccccggtacccccgg

SEQ ID NO: 125618 - DNA, 647 bp, Homo sapiens
  misc_feature: GYAE6OF01D3M8K.53.31.C09.1.454.CMB.1.raw
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (256)..(256): a, c, t, g, unknown or other
  misc_feature (256)..(256): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctctatgagctgacacagtcaccctggtntctgtcgtcctnaggacaggacggccaggtactccaccttgccttcgtgggcatcgctattcgaaccaaaaactatntgtacttacgtcggtaccagcgagacggcgaacgccgacggcccccgttagtcgttggtgtaatttaataagtactttgagtacggtccctacgacgggtaccctagacggtctacgtttctcgtcggctccgacgctcgacggaacaacgtacgtacctaccgtttacgaacctagtacgtacggttcgggacggtcccggaccgaggtaacgggtaccgacggtcgttagacctttaagttaacgtcggtacacggtccgagacgacgtacgcggtaagttcggacttagtttaacgtcggttacgtaggttaccgggaccggtaagggtcctaacggtccttacggcccgtccgtacggtcacgacccggtaagccctcgccccgtcg

SEQ ID NO: 125619 - DNA, 782 bp, Homo sapiens
  misc_feature: GYAE6OF01CFV6P.53.31.C09.1.454.CMB.1.raw
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggactccctctacttcctccccctcctcactctctgccacagctctgacggccctctatgacgtcacgacactacgtccacccgtggtntctgtctcctcaggacaggaccggcaggctccacgtcgtctcgnggcgtancgctacgttaccgaaacctaaaataacttagtcgtactttacgtccggaacacgacgacggacggaccgacggtccccgacgtccccgttgtttcgttaggtacgtaaagttttaaagtaaacggtcgtttacggaacggtacccgtcccgtaccggaaccgggtacccgtaggacgtcgtacgtttcctacgtcggtcctacgacgtaccgtaacggaaccgggtaacctaaaggtccaacccgttacgttaacgacccgttgaccggagggtacgggtaccccggtacccggaggaacgggaacgggtacggaccggtttctaacggtttaaaccttacgtaccggtttacggacccgtaaacgggttccccggaaaccgtacgggaacccgtaaggtcccggttaacggggtaccgttaaacgttttaaccgggtttaaccgggtttggggttaaaaccccgggttttgggaaccccccggggggtaaacggggg

SEQ ID NO: 125620 - DNA, 820 bp, Homo sapiens
  misc_feature: GYAE6OF01CT997.53.31.C09.1.454.CMB.1.raw
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (568)..(568): a, c, t, g, unknown or other
  misc_feature (568)..(568): n is a, c, g, or t
tcagcgcgtatacacacgaccggtgctcgatttagacgtctcatcaaggaaggaagggggtgggtccaggaggcagaactctgggtgtctcaccatggcctggatcccctctacttctcccccctcctctactctctgcacgaggcttctggaggtcccttcctaagtcgagctgacacncgtccacccgtggtntctgtcgtcctgaggacacggaccggccaggtactcccgaccgtgccttcgtagggccgtaagtcgactaagttaccgaaacctaaaactattactacggtacctttaacggtaccggtaaccgagaccgtaaggacgggaccgaccggcccgtaccggtcccccgtttaggttaccggtttaggttaacggttaaactttttaaacgtaaaacgtttacgtttacgggacggtaacccggtaccccggtaaccggtaacccgggtaccccgtagggaccgttacggttaaccttccggttaccgtacggtccctacccgtagtccgtacgaacgggaaacacgtacgtacccgtacgttacgactagtacgnggtaccgaccggtacggacgagggaaggccggagtgtacacgtttactacgtacgtccgtacgtccgagacgtacacggtacgcggtagtaccgtagtttacgtacggttcgttacggtacggggtacggtacggtaccgttacccgggtacgttacccgggtacccgttaaccgggtacccggtaaccggtacccccggtaaaacccgggtcccggttaccccgttcccccccggggtccgtttacccggg

SEQ ID NO: 125621 - DNA, 721 bp, Homo sapiens
  misc_feature: GYAE6OF01CXS7N.53.31.C09.1.454.CMB.1.raw
  modified_base (183)..(183): a, c, t, g, unknown or other
  misc_feature (183)..(183): n is a, c, g, or t
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (422)..(422): a, c, t, g, unknown or other
  misc_feature (422)..(422): n is a, c, g, or t
  modified_base (628)..(628): a, c, t, g, unknown or other
  misc_feature (628)..(628): n is a, c, g, or t
tcagcgcgtatacacacgaccggtgctcgatttagacgtctcatcaaggaaggaagggcacgaccggtgctcgatttagacgtctcatcgaaggaagggaagggggtggtccaggaggcagaactctgggtgtctcaccagtggcctggactcccttctaccttcctcccctcctcactctcngcancgctcgtgacgcctctatganctgacacacgtccaccggtgtcgtctgtcgtccacgacggtacgacggaccgaccgaaggctccgacctcgtctcggacggactactcgacttacgtaccgaaactaaaacgtactacgttacgtacgtttaacgacggaactacgacggacggacgtccgaaccggccgacggtaccctggtacttgggtaaattactttaaacgtaacgttntaaccggaacggccggtacccttaaccgggacgacccgttaaggacctacgtacgtttcctcgtaccgtaccgtacgtaccgaccggtaacgaacggaactaccgtacgtacctacggtacaacgtacttacggacgttcgggaccgtaccggaccgtaaggcggtaacggtacgacgttacgaactttacgttacgtaggtaccnccggtaacgtacggaacgtacggacgtacggtaccggtagttaccgttaacggtttacgttacgggttccggtagggtcggggttaacccggg

SEQ ID NO: 125622 - DNA, 588 bp, Homo sapiens
  misc_feature: GYAE6OF01E4SBR.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacaatatgcttactggtaccagcagaggccaggccacggcccctgtcttggtgtatttaataaagtacgtttgagcggccctcgacgggacccctgacgcgtatttcctcgtcggcctccgagtcctcgacgggaacaacgtacgtcctaccttcgaccctacgtcgaggtggacgtcccggaccgaaggacggaccgggaggcttacgtaaccttacgttaccgtgtcgaccgtcccggacgacgaccgaggcgaggtcggtacgtaacggtttagttaggttcgttagttccggggtaacgggg

SEQ ID NO: 125623 - DNA, 792 bp, Homo sapiens
  misc_feature: GYAE6OF01AVTMF.53.31.C09.1.454.CMB.1.raw
tcagcgcgtatacacacgaccggtgctcgatttagacgtctcatcaaggaaggaagggcacgaccggtgctcgattttagacgtctcatcaaggaaggaagggggtggtccaggaggcagaactcgtgggtgtctcaccatggcctggactccctctacttcctcccctctcactctctgcacagctcgtgacggtcctctagtgacgctacgacacacgtcctaccgttggtcttctgttcgtccgtacgaacggacaccggacggaccgaaggtctacctacgtcggtccgtacggtacggcgtaacgtcgtactaacgtaaccgaaaacctaaaacgttacgttaacgttaccgtttaaccgttaaccggtacggtaaccggacggaacggacggaaccggacccgaaccggtacccggtacccggttcccgttaggttacggtttacggtttaactttaaacggtttaaacggttaacgtttacggtaacgggtaccggtacccggtacccggtaccgggtaacccggtacccgtacggtacgttaccgtttacgttccggtccgttaccgtacccgtaccgtacgtaccggaacggtaacggtaacctaacgtaccgtaacctaccgtacgaccgtcgtaccggtcgggtaccgaccggtaccgaacggacggacggacgtacgtagttaccgttacttacgtacgtacgttccgacgtaccggacgtcgagtacgtcggacgttacgtacgttcgtacggttacggtacgttccgggaggtaccgg

SEQ ID NO: 125624 - DNA, 685 bp, Homo sapiens
  misc_feature: GYAE6OF01DT0CL.53.31.C09.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (335)..(335): a, c, t, g, unknown or other
  misc_feature (335)..(335): n is a, c, g, or t
  modified_base (525)..(525): a, c, t, g, unknown or other
  misc_feature (525)..(525): n is a, c, g, or t
  modified_base (612)..(612): a, c, t, g, unknown or other
  misc_feature (612)..(612): n is a, c, g, or t
tcagcgcgtatacacacgaccggtgctcgatttagacgtctcatcaaggaaggaagggcacgaccggtgctcgatttagacgtctcatcaaggaggaaggggtggtcaggaggcagaactctggtgtctcacatggcctggactccctctacttcctcccccctctcacgtctcgtgcacaggctctgaggcctctatgagctgaccacngtccaccctggtntctgtccgtcacgagacgagaccggtacgagtactaccacgtcgcctggtcgacgtatcgacttacgtaacaaaccctaaatactacgttacgtcttacggttcggaacccngtacgacgggaccgacccgtacgacccggccgtccccgttggttacgtgttaagttaactttaaagtaaacgttcgttacgggaacgtaccgttcccgacggtaccgggccctggctacgtctcgttccgtgtacctaccgcgtaccgtacgacggtaaactacaccgttcgtaccgtacgtaacccgtntacgaacggttcggaccgtcccggaagtaggacggacgccggtattaccgtaattaccgtcgtacgaccgtaccggtccaacggtanacggaccgtggaacggttggaaaccgtttggttaaaccgttgggttaacccgttgggtccggtaaacccgggg

SEQ ID NO: 125625 - DNA, 701 bp, Homo sapiens
  misc_feature: GYAE6OF01EIIBZ.53.31.C09.1.454.CMB.1.raw
  modified_base (245)..(245): a, c, t, g, unknown or other
  misc_feature (245)..(245): n is a, c, g, or t
tcagcgcgtatacacacgaccggtgctcgattttagacgtctcatcaaggaaggaagggggtgggtccaggaggcagaactctgggtgtctcaccatggcctggatccctctacttctccccctctcactctctgcacaggctctgacggcctcctatgacgctgacacagtccacccgttcggtgttctgttcgtacctcgaaggtacaggccggcaaggactccaccgtgcctcgtggactancgaactagtaccgaaaaccaaaatattagtcgttaccttacgtacggtacctaagacgacggacggaccgacggccgaccggtccctcggttcgtggtacttaattaagttaaacgttcgttacgacggtaccgtccgtacggtaccggtacccgtaacggtccgacgttacgtcctcgtacgtcctacggacggtcaacggtacggtaaccaacgttcgaacctagtaccactcgacgtacggacgacggccgacgacggacggacggaacgtctacgtacttactacgtccgcgtacggtacacgacgaacgcgtacgtaggtacgtacgttacgttacggtcggttagtaccgggtaccggtacgggtacggtacggtaccgtaccggtaccggtccgtaacggtaccgtaaccggtacccgaacccggtacccgtccggtccccgtacccgg

SEQ ID NO: 125626 - DNA, 699 bp, Homo sapiens
  misc_feature: GYAE6OF01DZBUI.53.31.C09.1.454.CMB.1.raw
  modified_base (235)..(235): a, c, t, g, unknown or other
  misc_feature (235)..(235): n is a, c, g, or t
tcagcgcgtatacacacgaccggtgctcgatttagacgtctcatcaaggaaggaagggcacgaccggtgctcgatttagacgtctcatcaaggaaggaagggggtggtcaggaggcagaactctgggtgtctcaccagtggcctggactccctctacttcctccccctcctcactctctgcacaggctctcgacggtcctacctatgacgcgtgaacactcgtccaccgttggtntctagttcgtcctagaggacgaacggtaccggccaaggtcctaccgaccgttcgacgttcgacgggtcgtatcgacttaacgttaccgaaccaaaaactatattacgtaccgtttacgtcggtaccagacgtacggacgccgacgcccgtacgtcctgttgttggtattaagtttaagtaacgttcgttaggacgtaccggacccgtaggaccgggtacctaggtacgtacgttacttccgtcgtccgtaccacgttaccggacgtacggaaggaacctaacgtcgtaccttacccttcaacctagtcgtaacggtccgggtaccggaccggacgaagggtacggaacggttcggacgttaagttaaccttagttccgtcggtaccgtaccggtaccgacgtaccgaggaccgtggacggtgtacgttacgttagttaccggtggttccggtagggtaccgggg

SEQ ID NO: 125627 - DNA, 814 bp, Homo sapiens
  misc_feature: GYAE6OF01DA62Z.53.31.C09.1.454.CMB.1.raw
  modified_base (223)..(223): a, c, t, g, unknown or other
  misc_feature (223)..(223): n is a, c, g, or t
tcagcgcgtatacacacgaccggtgctcgatttagacgtctcatcaaggaaggaagggcacgaccggtgctcgattttagacgtctcatcgaaagggaagggaagggggtgggtccaggaggcagaactcgtgggttgtcctcacctatcggcctggactccctactacttcctccccctcctcactctctgcagacgctcgtgaccggtcctctagtgagcncgacacgtcgtaccgtccgttcgggtcgttcttggtcgtacctggaacgacgacggaccgcgacgactccgacctcgtactcggtacggcgaacgtctacttagtaaccaaaccaaaagtacttacgttacgtaccttaccggaaggtaccgagaccgaaggaccgtacgaccgggtaccgtcccgtaccgtttagtcgttaggtacgtttaactaaaggtaacgtttgtacggaacgtccggtacctaccgggaaacccgttcggaacgttaacccggtattccgtttcgtcggtaccgaccgtaccgtacgtaccgaacggtaacgaacgtaaccgtacgtacctaaccgttcaccggtacgacggtaacgggtaccgggtaccgtaccgggaccggaaggaccggggtaacgtacgggtacgttacgttaaacgttccgggttaagtcccggtaaccgtacggaacccgtaccggtaaacaacccgggtacggtttaacggtaccgggttaacggttacggtttaaacggtttaaccgggtttacccgggtttaaaggtccgggggttaaccgggtttaaaccggggg

SEQ ID NO: 125628 - DNA, 783 bp, Homo sapiens
  misc_feature: GYAE6OF01B7XH6.53.31.C09.1.454.CMB.1.raw
  modified_base (87)..(87): a, c, t, g, unknown or other
  misc_feature (87)..(87): n is a, c, g, or t
tcagcgcgtatacacacgaccggtgctcgatttagacgtctcatcaaggaaggaagggggtgggtccaggaggcagaactctgggtntctcaccatggcctggatccctctacttctccccctcctcactctctgcacaggctctagacggcctctatgagctgacacagtccacccgtggtgtctgtcgtcctgaggacaggacgaccgagtatcacgtgcgtcgtggacgtatgactacttacgaaaccaaaaagtattagtacgtacttacgtacggtaaccagacgaaggacggaccgacggtaccgacggtaccccttcggttagttaggtaagtttacttttaaagtaaaacggttacgtttaggaaccggacgacccgttaccggacggttacccgagtaacggctacgttccgtagtccggtacctacgaacggtccgtacggtaaccggaactaacgtacggttacaaccgtttacaacgttactacggtacggtacggtaacggtacccggacgagggaaccggaacgtacggtacgtaggtaacttactttacgtaccgtaacgttaacggaccaaggacgtaacggaacggacttaacgggtaccgtagtttaaacggtacgttaacgggtcggtttaaccggtacggggtaacgggtaacgggttaaccccgtaggttaccggtaaccggttaacccggttccgttaaaggccccgttaaacggaaaccccgggttaaggttaccccctccgggtacccccggtttaccg

SEQ ID NO: 125629 - DNA, 676 bp, Homo sapiens
  misc_feature: GYAE6OF01AWEZC.53.31.C09.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (618)..(618): a, c, t, g, unknown or other
  misc_feature (618)..(618): n is a, c, g, or t
tcagcgcgtatacacacgaccggtgctcgatttagacgtctcatcaaggaaggaagggcacgaccggtgcctcgatttagacgtctcatcaagggaaggaagggggtcggtccgaggaggcagaactcgtgggtgtctcaccatcgggcctaggacttccctcttaccttcctccccctctcactcgtctgccacgngtcctctcggacgtcccttctatcgagtctgaccactacgtccacccgtggtnttacgtcgtctccgtacgaggacaccggacggctaaggactccgtacctgctcgtgcgtatcgactatacgaacaaacttatctagtacctttacgaccgtacaacgcgacggaccggtacacgggtaccccgtcggtcccgttaggttccgttaggttaacgttaactttaaagacgttacggttacggacgtaccgacccgtagtacccgggacctggaacgttgtactttctcggctctcccgtgacgtaccgacgtaactacgtcgtacctcgtacactctaggcgtagtaccgcgaacgaggacgtaccggtagtccgaatttacccgttagtccttacggctaccgcgtaccggaaacgtcncggtcgacggttacgtactttcggaggtttacccgaggttcgggtaaaccgggtcggg

SEQ ID NO: 125630 - DNA, 724 bp, Homo sapiens
  misc_feature: GYAE6OF01AHC4K.53.31.C09.1.454.CMB.1.raw
  modified_base (203)..(203): a, c, t, g, unknown or other
  misc_feature (203)..(203): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctctatganctgacacagtccacccgtggtcgtctgtctcctcagggacaggaccggccaggtactcacctgctcgtggcgatcgactattcgaacctaaaaacattactgtccttacgcggtaccagacgaaggacggacctagggccccgaccggtccccttggttcgttggttacgtaattttaaacgtaaacggttacgtttaggaacggtacgggtccctacggacccggggtacccctaggaccggtacgtttacttccgttccggtggtacccttacggacgtccgtaaccggaacggggtaactaaaccggtactaccgtaacccgtttacgaccctaacggttcggacggttcgggaaccgttccccggacgaacgggtacgggaccggtacgtaccgttacgtaacccttagttacctggttaccgtaaccggtccgacgtacggaaccgtggtacgtccgggtaacgtaccgttaagtttacggttacggttcgggttaacgggttcggggaaccgggg

SEQ ID NO: 125631 - DNA, 922 bp, Homo sapiens
  misc_feature: GYAE6OF01EOM75.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctggtgtctgtgtcctcaggacagacgcaggatcacctgctctggcgatcgactattacgaacctaaaaaacaagttacttggtacctttaaccgtacggggttaacccaaggaccgtaaagggaacggcccgaaacggggcccctaaaccggggtccccccctttaggttaccggtttagggttagttaaaacgttttttaaaagtaaaaaacggttccgttttagggaaacgggtacccgggttacccccttaacgggtaaacccggggtacccccctagggaaccgtaccggtaacttttccgtaccggttcgggtacccttacccggtaacggtcccgttaaccgggaaaccgggggaaacctaaaaaacccgggtacggtttaacccctaaaccccgttttacgggaaaccccttaagttaccgaacgggtttaacggggtaacccgggttaccccgggaacccggtaaacgggaaaccggggaaccgggtaacgggtaccgttaaccggtaactttaaaccgtttaacgtacggttaacccggaccggttaccccggacgaaacggtaaccgaacggtacgtaacgggttggtaaccgttaagttaacgttcggttacggttaccgttacggggaccggtaagggtaacccgtaacggtccggtaacggtcccggttaccgttaacgggacccgtaacgaacccccgtaaagggtcccgttacccggcccccgttaaccggg

SEQ ID NO: 125632 - DNA, 906 bp, Homo sapiens
  misc_feature: GYAE6OF01BBUSX.53.31.C09.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
  modified_base (381)..(381): a, c, t, g, unknown or other
  misc_feature (381)..(381): n is a, c, g, or t
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctcttacttctccccctctcactctctgcacaggctctgaggcctcctatgagctgactnagtccaccctggtntctgtntcctnaggacaggacggccaggacncaccgtgctcggtggcatgctattcgaccaaaactagttatcgtactttagcgtaccngtacgaggaccgaccgacgggccctacgggtccccgttggttccgttaggttacgtaacgttttaaanaaaccggttacttttagggaacgtaaccgggttccccctaaccggggtaaccggggtacccccgtttaggaacggtacccgggtttaccgtttacccgttcccggttacggggtacccccttaccggtaaccgggtaccccggttaaccgggtaaaccgggggggtaaaccctaaaaccggtttaacccggtaacccccggtttaaaccccggtttaacccgggtaaaccccgttaaccgttaacccgggttaacgggttccggggttaacccggggtacccccgggttaaccgggaaccggggtaacccggggaaccggggtaccggggtacctttaccgggttaaccgtttaaccgttttaccggtaccgggttacccggttaccgtaacccccgggtttaccaaaccggggttaaccacgggtaaacccgggttacggggttaccggtaaccgtttaaagggtttacccggttaagggtttacccgttaaacgggggtttcccggggtaaaccccggggggg

SEQ ID NO: 125633 - DNA, 687 bp, Homo sapiens
  misc_feature: GYAE6OF01BW515.53.31.C09.1.454.CMB.1.raw
  modified_base (127)..(127): a, c, t, g, unknown or other
  misc_feature (127)..(127): n is a, c, g, or t
  modified_base (225)..(225): a, c, t, g, unknown or other
  misc_feature (225)..(225): n is a, c, g, or t
tcagcgcgtatacacacgaccggtgctcgatttagacgtctcatcaaggaaggaagggcacgaccggtgctcgatttagacgtctcatcaaggagaaggggtggtccaggaggcagaactctgggtntctcaaccatggcctggactccctctacttctccccctctcactctctgcacaggctctgagcctcctatgacgctgaccacagtccacccgtcggtntcctgtcgtcctcgaggacagaccggccaggtactcaccgtgcctcgtggcgatgctattcgaaccctaaaaactaatatcgtactttacgtcggtaacccagacaggacggccgacggcccgacggtcccccttggtccgtttaggtagtaattttaaagtaaaacgttacgtttaggaacggtaaccggtccctacggaacccgggtacccctaggacggtacgtactttccgtcgtcggtccttaccgagtcctacggaacggacctaacgactacccgtaccgtacgaacctagtccgtaggtacggtaccggtccggaccgaaggaccgggtaggaccgggtcttacggtaactttacgttacgtcggttaccacggtcccgtacgacgtacggacgacgtacgggtcgtacttaacggttagttaccggttacgttcgggttccgggtaaccgggg

SEQ ID NO: 125634 - DNA, 813 bp, Homo sapiens
  misc_feature: GYAE6OF01C2BSO.53.31.C09.1.454.CMB.1.raw
tcagcgcgtatacacacgaccggtgctcgatttagacgtctcatcaaggaaggaagggcacgaccggtgctcgatttagacgtctcatcaaaggaggaagggggtggtccaggaggcagaactctgggtgtctcaccatggcctggactccctctacttctccccctctcactctctgcacgaggctcgtgaggcctcctatgagctgaaccactagtccaccctcggttgtcctggtcgtcctcgaggacacggaccgccgaggactcacctgcctcgtggaccgatcgctaagtacgaaccctaaaacatacgtcgtacctttacggtacgtaaccaagcgtaacgggaccggaccgaacgggtaccccgaacccgggtccccccgttttagggttacgttttaccggggttagtttaaaacgtttttaaaacgttaaaaaaccgggtttccgtttttaagggaaaccggttacccggggtcccccctttaaccggggaaccccggggtaacccccgttaagggtaccggtacgtaaccgttttcgaccggtttcggccccgttaccgtaccgtaaccgtaaccgggtaaccgggtaaacctaaaccgtccggttaaccccgtaaccgtttacggaaacccctggtaccgtaagggtaccggtaccggtccccgggaaaccgaggggaacggaccgggtaggtaccgttaacgttaacctttaagttacgtccgtacgtaacccgtcgaaccgtaggaccgtagccgtggtacggtctaacgttcttaggttacgtcgggtaggtaccggg

SEQ ID NO: 125635 - DNA, 763 bp, Homo sapiens
  misc_feature: GYAE6OF01DKRAL.53.31.C09.1.454.CMB.1.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
  modified_base (494)..(494): a, c, t, g, unknown or other
  misc_feature (494)..(494): n is a, c, g, or t
tcagcgcgtatacacacgaccggtgctcgatttagacgtctcatcaaggaaggaagggggtgggtccaggaggcagaactctgggtgtctcaccatggcctggactccctctacttcctccccctcctcactctctgcacgaggtcctctaggacggtccttcctaagtggacgtctgacacacgtcctacccgtggtntctgtcgttccacgaggacgacggaccgaccgagtactccgcctgcctcgcggcgntgtctagtacgaaacctaaatacgtattcgtacgttacggtacgtaacacgaccggaacggacgaccggaccggtaccgccggttcccgttcgttcggtttagttagttaacgtttaaacgtaacggttcggttaaggacgggtcccgtaccggtaaccggaccgggtaccctaggtaccggtacgtttccgtcgttaccggttccgaccttacggacgtaccggtacggacggaaccncgttacgttacctaccgtacgaccctaggtccggagtaccgggtaccgaccggacggaacggtcggacggtacgtactaccgttatttaccggtacgtacgcgtacccggtacgagaaccgtgcgaagttgggacgttattacggtttcgagttcgggtaccggagggaccgggactacccgtcggttaccgaccgggtttaccgaccggtggaccccggtaaacccggccggttaccccgggtccgtacccccgtttcggaaccccgg

SEQ ID NO: 125636 - DNA, 825 bp, Homo sapiens
  misc_feature: GYAE6OF01BLY2S.53.31.C09.1.454.CMB.1.raw
  modified_base (141)..(141): a, c, t, g, unknown or other
  misc_feature (141)..(141): n is a, c, g, or t
  modified_base (185)..(185): a, c, t, g, unknown or other
  misc_feature (185)..(185): n is a, c, g, or t
tcagcgcgtatacacacgaccggtgctcgatttagacgtctcatcaaggaaggaagggggtgggtccaggaggcagaactctgggtgtctcaccatggcctggatcccctctacttcctccccctcctcactctctgcacnggctctgacggcctcctatgagctgacacagtcacccgttggtntctgtcgtcctgagacaggacgcgagctcaccgtgctgtggacgatcgactattacgaaaccaaaactatagtacgtacttaacgtacggtaacgagacgacgacggccgacggaccgacggtccccttggttcgtttaggtagttaatttaaacgtaaacggttacgttttacggacggtaccggtcccgtaccggtaaccgggtacccgttaggaaccggttcgttacgtttcccgtaaccgttcggtacccttaccggtaaacggtacccgttaacggggaaccgggtaaacttaaaccggaccgttacccgttaaaccgttaacgaacccgtttaagtacgggtaacggggtccgggttaaccggtaccccggggtaaaccgagggtaaccgggtaacgggtaaccggtacgttaaccgttaccgtttaacgttacgttaccggtaccgtacggtacccgacgtaaggacccgaaggttaccgacgggttagtaccttaaggttcgtacggttggttaacgggtccgggtaacggaccgggttaccagggttacccttccggtaaacccggttacccgtaacgggtaccccgtaacggccccgtaacggccgtttccccccgacccggttaccggg

SEQ ID NO: 125637 - DNA, 722 bp, Homo sapiens
  misc_feature: GYAE6OF01B1NV3.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctctacttcctccccctcctcactctctgcacaggctctgacggcctcctatgacgctgaccactagtccacccgttcggttatcgttgtcgtcctacgaggacaggaccggcgaggactccacctgtccttcgtgggactagtcgaccttagttaccgaaacccaaaaatattacgtacgtacctttaacgttaccggtaaccacggtacgacgggtaaccggccgaacggtcccgaccggtccccgtggtttcgtaggttcgttaactttaaacgtaagttcgtttaggacgtaccggcctacggaccggtccctggacgtcgtacttcgcgtgcctcgacgtcgtacgaggtaaccagtacctacctaccgtacgtaccctagtacggtacggttacggaccggtaccggaaccggaagggtaccgggaacgggtacgggtaccgtacggtaaccgtttatttaccggtccggaccgtaccggtaccccgaagtaccggacgacggtccgtaaagggtcccgtaagttacggtttacgtccggtttacgtcgggtcgggggtaaccggg

SEQ ID NO: 125638 - DNA, 695 bp, Homo sapiens
  misc_feature: GYAE6OF01E24CI.53.31.C09.1.454.CMB.1.raw
  modified_base (111)..(111): a, c, t, g, unknown or other
  misc_feature (111)..(111): n is a, c, g, or t
  modified_base (239)..(239): a, c, t, g, unknown or other
  misc_feature (239)..(239): n is a, c, g, or t
  modified_base (407)..(407): a, c, t, g, unknown or other
  misc_feature (407)..(407): n is a, c, g, or t
tcagcgcgtatacacacgaccggtgctcgatttagacgtctcatcaaggaaggaagggggtgggtccagggaggcagaactctgggtgtctcaccatggcctggatccctntacttctccccctctcactctctgcacaggctcgtgaggccctactatgagctagacacacgtccacccgtggtactctgtcgtccctagaggtacaggaccggtccaggactccaccgttgcttcgnggactatgactagttacaacccaaaaagtatatcgtcttacgtcggtaccagcgaggacgaccgtacggcccgacggtccccctgttacgtttacggtacttaaagttaactaaacgttacgttttaggacggaccgtacccgttacgaccgggacccctaggacgtntacttcgtcgtacgcttaccagttaccgacgtacggaactaacgtagtacctacgttacgaacctataccggacggttacggaccggtaccggaccgtagaacgggtacgacggtactacgtattaacgtactacgacgtcgtaccgagtaacacgacgacggtaggtacgtacgttaagttaccggttagttccgttaggtcgggtaccgggacgtaccgtcgtacgaccggttccgtacgtacccggacaccgggtaccaacgggtcccttcccgccccggttacg

SEQ ID NO: 125639 - DNA, 503 bp, Homo sapiens
  misc_feature: GYAE6OF02F0Q6G.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacggctgaccgtcgtaggtcaggcccaaggctcgcccctcgg

SEQ ID NO: 125640 - DNA, 498 bp, Homo sapiens
  misc_feature: GYAE6OF02IBGMW.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagacttttgagaggccctcagggacccctgagcgattctctggctccagctcgagggacaacagtcaccttgaccatcagtggagtccggcagaggacgaggctgactattactgtcagtccgcagacagcagtggcagttatgtcgtagttcggcggaggactacgctgaccgtctaggcagccgaagctcgcccctcgg

SEQ ID NO: 125641 - DNA, 502 bp, Homo sapiens
  misc_feature: GYAE6OF02H8AT9.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagctttgagaggccctcagggacccctggagcgattctctggctccagctcgagggacaacagtcaccttgacccatcagtggacgtccggccagaggacgaggctgacttattactgtcagtccgcagacagcagtggcagttatgtcgtagttcggcggagggactacgctgaccgtctaggcagccaggctcgccctcgg

SEQ ID NO: 125642 - DNA, 497 bp, Homo sapiens
  misc_feature: GYAE6OF02G63HZ.53.31.C09.1.454.CMB.1.raw
  modified_base (453)..(453): a, c, t, g, unknown or other
  misc_feature (453)..(453): n is a, c, g, or t
  modified_base (462)..(462): a, c, t, g, unknown or other
  misc_feature (462)..(462): n is a, c, g, or t
  modified_base (482)..(482): a, c, t, g, unknown or other
  misc_feature (482)..(482): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagagccaggccaggcccctgtcttggtgatttaataaagctttgagaggccctgacgggacccctggagcgattctctggctccagctgaggacaacgagtcacttgaccatccagtggagtccgacagaggacaggctgaactatacngtcagtccngaagacagcagtgcagttanggtcgtatcggacgg

SEQ ID NO: 125643 - DNA, 562 bp, Homo sapiens
  misc_feature: GYAE6OF02H9402.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaacatatgcttactggtaccagcagaggccaggccacggcccctgtctttggtgtattttaataaagtactttgaggacggcccttcgacgggacccctggacgcgtattcctcgtggctccagctcgagggacaacagtcaccttgaaccatcaggtcggacgtccggccaggaggacgaggctgacttattactgtcacgtccgcagacagcagtggactagttatgttacgtagttccgggcggaagggacctacggccttcggtaacccgttccgttaacgggtcacggtcccgaagggtccgtcccggcccccgttccggg

SEQ ID NO: 125644 - DNA, 577 bp, Homo sapiens
  misc_feature: GYAE6OF02ITJ3T.53.31.C09.1.454.CMB.1.raw
  modified_base (337)..(337): a, c, t, g, unknown or other
  misc_feature (337)..(337): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctcccctcctcactctctgcacaggctctgaggcctcctatgagctgacacagtccaccctcggtgtctgtgtcctcaggacagacggccaggatcacctgctctggcgatgcattgaccaaaaacatatgcttactggtaaccagcaggacgccagggccaggcccctgtcttggtntatttaactaaagactttggaacgaggccctagacggggaacccctggacgcgtaattccgtctggtctccaggctcgaagggacaaacgtgtacctaaccgttgaaccctatcgagttagggacgttcccggaccgaagacgggacgagggtctagaaccttagttaccgtgtaccaggtcccgagaaggtacaagcctaaggtggacttaggttatggtacggttacgttgggacggg

SEQ ID NO: 125645 - DNA, 515 bp, Homo sapiens
  misc_feature: GYAE6OF02HMGVN.53.31.C09.1.454.CMB.1.raw
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
  modified_base (508)..(508): a, c, t, g, unknown or other
  misc_feature (508)..(508): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacaatatgcttactggtaccagcagaggccaggccaggcccctgtcttggtgtatttaataaagtactttgagacggccctcgacgggacccctggacgcgtattctctggcctccagctcgagggacaacagtcaccttgaccatcagtgagtccggcagaggacgnggctgactattactgtcacgtcccagacngcagtgactagttatgtacgtagttcggnggtacgg

SEQ ID NO: 125646 - DNA, 699 bp, Homo sapiens
  misc_feature: GYAE6OF02JVK8Y.53.31.C09.1.454.CMB.1.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagcgcgtatacacacgaccggtgctcgatttagacgtctcatcaaggaaggaaggggtgggtccgaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaacaatatgcttaactggtaccagcagaggccaggccaggcccctgtcttggtntatttanaaagctttgagaggccctcagggacccctggaacgcgtattctcgtggctccgagcctcgaacgggactaaacgacgttccaaccgtttcgaaccctacgtaccgacggttcgggaacggttccccgggaccgaagggaacgggaaccgggaagggtcccgttaggaaccgttaaagttttaccgtacgtaccgtaacggttcccgacgaacgtaaccgaaggtcccgtaaagggttcgggaccgttaaagggtttacgttacggttaccgttaacggttttccggggacggggtacggggtaaccgttacccgggtaccgttacgggaaccccggtttccgttaacgggttaccgaccggtaccccgtaagggcccttacccggtccccccgttaccgggg

SEQ ID NO: 125647 - DNA, 540 bp, Homo sapiens
  misc_feature: GYAE6OF02F72DW.53.31.C09.1.454.CMB.1.raw
  modified_base (459)..(459): a, c, t, g, unknown or other
  misc_feature (459)..(459): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgatttataaagtctttgagagccctgacgggacccctgagcgtattctcgtggctccgagctcgagggacaacgagtccacttcgaccatcagtggacgtccggccgagacggacggaggctagacttattactgtcacgtccgcgacgacgagcgagtcggctagttntggttcgtagttcggcggacgggtacgtacggcgtcgtaccgtcgtacggtcgacgacccgaggccgtccgcccccgtcgg

SEQ ID NO: 125648 - DNA, 555 bp, Homo sapiens
  misc_feature: GYAE6OF02JO272.53.31.C09.1.454.CMB.1.raw
  modified_base (433)..(433): a, c, t, g, unknown or other
  misc_feature (433)..(433): n is a, c, g, or t
tcagcgcgtatacacacgaccggtgctcgatttagacgtctcatcaaggaaggaagggggtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagacgcaggccacggcccctgtctggtgatttataagtactttgagagtcctcgacgggacccctgacgcgtatctctggctcagctcgaggacaacacgtcacctcgacctatacgagtggaacgtccggcaggacggacgagcgtagacgtaatacgtcgtcgacgtccganacgtacagaccgagtggtactaggttagtacgttcgttagttacgggcgggaaggtaccgtacggcgtcggtaccgtccgttaggacgacggaccgaacgggcctaccggtcccccgttcgg

SEQ ID NO: 125649 - DNA, 532 bp, Homo sapiens
  misc_feature: GYAE6OF02GF0V0.53.31.C09.1.454.CMB.1.raw
  modified_base (339)..(339): a, c, t, g, unknown or other
  misc_feature (339)..(339): n is a, c, g, or t
  modified_base (424)..(424): a, c, t, g, unknown or other
  misc_feature (424)..(424): n is a, c, g, or t
  modified_base (458)..(458): a, c, t, g, unknown or other
  misc_feature (458)..(458): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccaggcccctgtcttggtgatttataaagactttgagaggccctcacgggacccctggacgcgattctntggctccagctcagggacaacagtccacttcgaccatcagtggagtccggcagaggacgaggctgacttatactgtcagtccganagacagcagtggctagttatgtcgttagttcggnggtagggtacgtcggcgtggacccgttcctaagggtccacggtccccgaagggccgttcggccccccgttacgg

SEQ ID NO: 125650 - DNA, 656 bp, Homo sapiens
  misc_feature: GYAE6OF02I9HGE.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccacggcccctgtcttggtgtatttataaagtacgtttgagtacggccctcgacgggacccctgagcgtattctcgtcggcctccgagcctcgaacgggaaccaacgtacgtacctacctttacgaccctactccgaaggtacggacggtcccggaccgaagggaacgggacggacgggtccgtacgtaacttaacgtttaccgttgtaccgtaacggttcccggacgtaacgaccacggacgtaaggtcgggtactaaggtttacgtcggttacgttacgttaccggggacgggtagggtaaccgtaccggtccgtacggtacccggttaccgttacggtaccgacggacccggtaacggccgttacccggccccccgttaccgg

SEQ ID NO: 125651 - DNA, 545 bp, Homo sapiens
  misc_feature: GYAE6OF02IT0JT.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctctcactctctgcacaggctctgaggcctcctatgagctgacacagtccaccctcggtgtctgtgtcctcaggacaggacggccaggatcacctgctctggcatgcattgaccaaaacaatatgcttacgtggtaccagcagacggccaggccaggcccctgtcgttgtgtatttataaagtctttgagacggccctcgacgggacccctgacgcgtattctcgtcggtctccgacgctcgacgggaacaacgagtccaccttgaaccctagtccaggtggacgtccggaccaggacgggacgaggctgaacttatacgtgtcagtccgacagaccagcgacggtggacctaggtttagcggttcgttagtcggacggg

SEQ ID NO: 125652 - DNA, 582 bp, Homo sapiens
  misc_feature: GYAE6OF02GNPEI.53.31.C09.1.454.CMB.1.raw
  modified_base (472)..(472): a, c, t, g, unknown or other
  misc_feature (472)..(472): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgtatttataaagtactttgagacggccctcgacgggacccctgacgcgtattctcgtcggcctccgagtcctacgaacgggaaccaacgacgttaccaccgtttacgaaccctagtacgaggtcggacgtcccggaccgaggacgggacgaggctagtacttattacgtgtaccagtccganagacagcaggtgactagttatcggtcgtagttcgggacggacggtacgtcggcgttacgaccggttccgtaggtccacgtacccggaaggtccctaccggcccccgtacg

SEQ ID NO: 125653 - DNA, 501 bp, Homo sapiens
  misc_feature: GYAE6OF02F6Z1Z.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgctactggtaccagcagaggccaggccaggcccctgtcttggtgatttataaagactttgagaggccctcagggacccctgagcgattctctggctccagctcagggacaacagtcaccttgaccatcagtggagtccggcagaggacgaggctgactatactgtcagtccgcagacagcagtggctagttatgtcgtattcggcggaggacgtacggctgaccgtcctaggtcacggcccaaggcctgccccctcgg

SEQ ID NO: 125654 - DNA, 559 bp, Homo sapiens
  misc_feature: GYAE6OF02IPZQ6.53.31.C09.1.454.CMB.1.raw
  modified_base (192)..(192): a, c, t, g, unknown or other
  misc_feature (192)..(192): n is a, c, g, or t
  modified_base (444)..(444): a, c, t, g, unknown or other
  misc_feature (444)..(444): n is a, c, g, or t
tcagcgcgtatacacacgaccggtgctcgatttagacgtctcatcaaggaaggaagggggtgggtccaggaggcagaactctgggtgtctcaccatggcctggatccctctacttctcccccctcctcactctctgcacaggctctgaggcctcctatgagctgacacagtcaccctggtgtctgtgtcctnaggacagacggccaggatcacctgctctggcgatgcattcgaaccaaaacaatatgcttactggtaccagcagaggccaggccaggcccctgtcttggtgtatttaataaaagtactttagagacggccctacgacgggacccctggagcgattctactggctccagctcgagggacaacgagtctaccttgaccatcaggtggacgtccgacgaggacggacgaggctgaactattacgtgtcacgtccgnaacgacagcgagtcgctagttagtgttcgtagtcgggacggagggtaccgacgtcgtacggtacccgttcgtaggtccaacggcccgaaggtcccgtccggtcccccgttaccgg

SEQ ID NO: 125655 - DNA, 587 bp, Homo sapiens
  misc_feature: GYAE6OF02IVP24.53.31.C09.1.454.CMB.1.raw
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacgccaggatcacctgctctggcgatgcattgaccaaaacaatatgacttactggtaccagcaagacgccaggccaggccctgtctggtgtattataaagtactttgagtacggcctcgacggacccctggacgcgtattctctggcctcgagctacgagggacaacgcgtccaccgttgaacccatccgaggtacggacgtcccggaccgaaggacggacggaggtcctacggtaaacttagtttaaccgtcgttaccgacgttcccggacgtaacggaaccgtagccgtaaggtcgggtactaaggtttacgtcgggttaccgtttagttaccggggacgggg

SEQ ID NO: 125656 - DNA, 550 bp, Homo sapiens
  misc_feature: GYAE6OF02HRB2O.53.31.C09.1.454.CMB.1.raw
  modified_base (285)..(285): a, c, t, g, unknown or other
  misc_feature (285)..(285): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggatccctctacttctccccctctcactctctgcacaggctctgaggcctcctatgagctgacacagtcaccctggtgtctgtgtcctcaggacagacggccaggatcacctgctctggcatgcattgaccaaaaacatangtcttacgtggtaccagcaggaggccaggccacggcccctgtcttggtgtatttaataaagtctttgagtacggccctagacgggaccctgacgtcgtacttctcgtcggctccgagcctacgagggacaacgtgtccaaccgttcgacctattcgaggtggacggtccggaccagggacggacgaggctacgtaacttattacgtgtcacgtccgacagtaccagccgagtcggactagttgtggtacgttagtccgggacggg

SEQ ID NO: 125657 - DNA, 633 bp, Homo sapiens
  misc_feature: GYAE6OF02I8VWG.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctctcactctctgcacaggctctgaggcctcctatgagctgacacagtccaccctcggtgtctgtgtcctcgaggacaggacggccaggatcacctgctcgtggcgatgcattcgaccaaaacagtatcgacttacgtcggtaccagcgaggacggaccgacggacccgacgggtcccccttggttccgtttagggttacgtaaattttaaagtaaaaggttacttttaggaacggtacgggtcccctacggaaccggggtaccccctaggacgcgtactttcgtcgtcggcctccgagctacgaagggaccaacgacgtcctaaccgttgacctatccgaggtacggaccggtcccggaccgaggacggacgaggctagtactacgttacgtgtcgacgtcccgacgacgaacacggacgtaggtcggactaggtttagtacggttcgttacgtccggggtaacggg

SEQ ID NO: 125658 - DNA, 568 bp, Homo sapiens
  misc_feature: GYAE6OF02JE6ZU.53.31.C09.1.454.CMB.1.raw
  modified_base (342)..(342): a, c, t, g, unknown or other
  misc_feature (342)..(342): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggatcacctgctctggcgatgcattgaccaaaacaatatgcttactggtaccagcagaggccaggccaggcccctgtcttggtgtatttanaaagtactttagagacggcctcgacgggacccctggacgcgtattcgtctcggcctccgagctcgagggtacaacagtcctaccgttcgacctatacgaggttcggacgtccggacctagggacggacgaggcgtacgacttacttacgtgtacctaggtccgcgtaacgaccaggcctaggtacggacttaggttatcggttacgttacggtccgggtaaccggg

SEQ ID NO: 125659 - DNA, 521 bp, Homo sapiens
  misc_feature: GYAE6OF02FWENI.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagtactttgagacggccctcgacgggacccctggacgcgattctctggcctcagctcgagggacaacagtcacttcgaccatcagtgagtccggcagagacgaggctgactatactgtcagtccgcagacagcgagtggactagttatgtcgtagttcggacggtaggactacggctcggaccgtcgtaggtcgacgacccgaaggccgtacgccccgtccgg

SEQ ID NO: 125660 - DNA, 520 bp, Homo sapiens
  misc_feature: GYAE6OF02HE103.53.31.C09.1.454.CMB.1.raw
  modified_base (466)..(466): a, c, t, g, unknown or other
  misc_feature (466)..(466): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtcagtgtccccaggacagacggccaggatcacctgctctggagaggcattggacaaaacaatatggatattggtaccggcagaagccaggccaggcccctgtgttggtaatatataaagacagggagacggccccgagggactcccgtgagcgatactctggctcagctcgaggacaacagtcacattgaccatcagtgacgtccgaggacaggaagacgaggctagactagttactgtacaatcgtgacgacacgcagtgttctacgagtggtgtagttcgggnggagggacaggctacggaccgtcgtagtcacgccgaaggcctcgccccgtgtcc

SEQ ID NO: 125661 - DNA, 575 bp, Homo sapiens
  misc_feature: GYAE6OF02H29SL.53.31.C09.1.454.CMB.1.raw
  modified_base (354)..(354): a, c, t, g, unknown or other
  misc_feature (354)..(354): n is a, c, g, or t
  modified_base (390)..(390): a, c, t, g, unknown or other
  misc_feature (390)..(390): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggatccctctacttctccccctctcactctctgcacaggctctgaggcctcctatgagctgacacagtcaccctggtgtctgtgtcctcgaggacaggaccggccaggatcacctgctctggcgatgcattcgaccaaaaacatatgactttacgtggtaccagcaggacggccaggccacggcccctgtcttggtgtatttataaagtntttgagacggccctgacggaccctgagtcgatttcncgtggctccgagtctcgagggacaacgcgtcctaccttcgacctatcgtaggtcggacgtcccggacgaaggacggacgaggtccttagtaaccttagttaccgtgtaccacggtcccgacgaacgaccgacgtcgtacggtcggacttacggttactcgggttacgttaggtccgggtaacggg

SEQ ID NO: 125662 - DNA, 621 bp, Homo sapiens
  misc_feature: GYAE6OF02IT66Y.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatcgcattcgaccaaaaacatatgtcttactggtaccagcagacggccgaggccaggcccctgtcttggtgtatttataaagtactttgagaggccctgacgggacccctgagcgtattcctacgtggcctccgagtcctacgaagggaacaaacgtagttaccaccgtttcgaacctagtcgtaggtacggaacggttcccggaccgaaggacggaacggacggactagaacttaagttaccgttgtaccgacgtcccgacgaacgtaccgacgacgtaggtggacttaaggtttactaggtcgttagttccgggacgggagggtaccgtaacggctacggtacccgttacgtaggtacgacggacccgtaagggcctaccggtaccccgttcgg

SEQ ID NO: 125663 - DNA, 723 bp, Homo sapiens
  misc_feature: GYAE6OF02JMEF3.53.31.C09.1.454.CMB.1.raw
  modified_base (153)..(153): a, c, t, g, unknown or other
  misc_feature (153)..(153): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggatccctntacttctccccctcctcactctctgcacaggctctgaggcctcctatgagctgacacagtccaccctggtgtctgtgtccctcaggacaggtacggccaggactcacctgctctggcgatgcattgaccaaaacaatatagcttactgtaccagcagacgccaggccacggcccctgtcttggtagtactttaagtaaagtactttagaagtacggtcccgtacgaccgggtaccccctaggacgcgtaagtttccgtacgtcgggtccttcccgaagtcccttacggaacgggaacctaaccgtacggtacctaacccgtttacggaaacccctacgttaccgtaaggttccgggaaaccgggttcccgggacccggtaacggaacggggtaaccgaacggggtaccttacgggaaaccgtttaacgtttaaccgttacgggtacctaaccgggttacccggaccgttaaacgggaaccgtaacgggtacccggtaaggttacgggaaccgttacgggtttaacgttaccgggttacccggtttacgggtttacccggggaaccggggg

SEQ ID NO: 125664 - DNA, 565 bp, Homo sapiens
  misc_feature: GYAE6OF02F5YQY.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgttcgttggtgtagttttaataaaagtactttagaggtacggccctcgacgggacccctggacgcgtattctctcggcctccagtctacgacgggacaacgagtccaccttgaccatcgaggtggacgtccggcagacggacggagcgtgacttattacgtgtacacgtccgcagacagctaggtggactagttagtgtacgttacgttcgggacggtaggacgtacggcgtacggtacccgttcgtaggtcgacggacccgacggcctccgcccccgtacgg

SEQ ID NO: 125665 - DNA, 522 bp, Homo sapiens
  misc_feature: GYAE6OF02FYYT3.53.31.C09.1.454.CMB.1.raw
  modified_base (428)..(428): a, c, t, g, unknown or other
  misc_feature (428)..(428): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcacccctggtgtctgtgtcctcaggacagaccggccaggatcacctgctctggcgatgcattgaccaaaacatatgcttactggtaccagcagaggccaggccaggcccctgtcttggtgtatttataaagtactttgagacgccctacgacgggacccctggacgccgattctctggctcagctacgagggacaacagtcaccttgaccatcngtggacgtaccggcagaggacgaggctgactattacgtgtacacgtccgcaagacgacgcagtcggactagttacgtgtcgttagtcggacggg

SEQ ID NO: 125666 - DNA, 549 bp, Homo sapiens
  misc_feature: GYAE6OF02H1S3B.53.31.C09.1.454.CMB.1.raw
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccacccttggtgtctgtcgtcctcgaggacagacggccaggactcacctgctcgtggcgatgcattcgaccaaaaacaatatgtacttacgtcggtaccagacagacgccaggccacggcccctgtcgttggtctaattaataaagtctttagacgacggccctagacggaccctgagcgtattctcgtgcctcgagctacgaggacaacgacgtccacttcgacctatcgagtggcgtccggacagacggacgaggctagaacttataaccgtgtacagtccgacgagaccaggctagtggtactaggttactggttacgttacgtcggacggg

SEQ ID NO: 125667 - DNA, 533 bp, Homo sapiens
  misc_feature: GYAE6OF02G2W91.53.31.C09.1.454.CMB.1.raw
  modified_base (452)..(452): a, c, t, g, unknown or other
  misc_feature (452)..(452): n is a, c, g, or t
  modified_base (471)..(471): a, c, t, g, unknown or other
  misc_feature (471)..(471): n is a, c, g, or t
  modified_base (484)..(484): a, c, t, g, unknown or other
  misc_feature (484)..(484): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccacggcccctgtcgttggtgtatttataaagtctttagaggaggccctcgacgggacccctagacgcgtattctcttcgctccagcgtacgacgggacaacgtacgtcctaccgttagacctatacgagtcggacgtccggacgagaggacgaggctagtacttattactgtacacgtccnacgacagcagtgctagttntgtcgtagtcggnggaggacgtcgacgtgaccgtacgtagcacgccgaggctccgcccgtcg

SEQ ID NO: 125668 - DNA, 519 bp, Homo sapiens
  misc_feature: GYAE6OF02F73PT.53.31.C09.1.454.CMB.1.raw
  modified_base (481)..(481): a, c, t, g, unknown or other
  misc_feature (481)..(481): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctggtgtctgtgtcctcaggacagacggcaggatcacctgctctggcgatgcattgccaaaacaatatgcttactggtaccagcagaggccaggccaggcccctgtcttggtgatttataaagtactttgagaggccctcgacgggacccctgacgcgattctctggctccagctcagggacaacagtcaccttgaccatcagtggacgtccggccagacggacgacggctagactattacgtgtacagttccgcacgtaacncgacaggtgcgtagttagtgtcggttagttcggacggg

SEQ ID NO: 125669 - DNA, 616 bp, Homo sapiens
  misc_feature: GYAE6OF02GYQQB.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccacggcccctgtcttggtgatttataaagtactttggagacggccctcgacgggacccctggacgcgtattctctgggcctccgagctacgaggggaacaacgacgtaccaaccgtttcgaacccatcgaggttacggacggtcccggccgaaggtacgggacggacgggaccgtaggaaccttatttacgtgttaccgacgttcccggcaacggacacggcagggtcggactaaggtttatcggttacgttacgttccgggacgggtagggaccgtacggccgttcggacccgttaccgtacggtccacggacccgaacgggtccgtaccggcccccgttccgg

SEQ ID NO: 125670 - DNA, 546 bp, Homo sapiens
  misc_feature: GYAE6OF02HAZ3F.53.31.C09.1.454.CMB.1.raw
  modified_base (481)..(481): a, c, t, g, unknown or other
  misc_feature (481)..(481): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccacggcccctgtcttggtgtatttaataaagtactttgagacggccctacgacggacccctgagcgtattctctggctccagctacgacgggaacaacacgtaccacgttacgacctatacgagtcggacgtcccggcacggaggacggaggcgtagacttattacgtgtcacgtccgacgagacagcgagtgcgtagttatgttacgtntcggcggtaggacgtacgctcggaccgttcgtacgcgacgaccgaggtcctaccgccccgtacgg

SEQ ID NO: 125671 - DNA, 553 bp, Homo sapiens
  misc_feature: GYAE6OF02GR48V.53.31.C09.1.454.CMB.1.raw
  modified_base (363)..(363): a, c, t, g, unknown or other
  misc_feature (363)..(363): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagactttgagaggccctcgacgggcccctgagcgattctctggctccgagctcagggaacaacngtcaccttgaccatcagtggacgtccggcaggacggacgaggcctaggacttattacgtcgtacacgtccgacagacagcaggtggactagttagtggttacgtagttcgggcggacgggtactacggcgtcggtacccgtaccgttagggacctacggacccgaacgggtcctccggacccccttccgg

SEQ ID NO: 125672 - DNA, 763 bp, Homo sapiens
  misc_feature: GYAE6OF02ILQVG.53.31.C09.1.454.CMB.1.raw
  modified_base (193)..(193): a, c, t, g, unknown or other
  misc_feature (193)..(193): n is a, c, g, or t
  modified_base (311)..(311): a, c, t, g, unknown or other
  misc_feature (311)..(311): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctanaggacagacggccaggatcacctgctcgtggcgatgctagtcgaccaaaaacatatcgacttactacggtaaccagacgaggacggacgacggaccgacggcccctgttacgttggtntaattttaagtaaactaccgttttagaacggtaccggtacccttacggaacggttaccccctaggacgacggttaattcctcgtacggcctaccacgtcctagaacgggacaaacgtaggtaccctacgttacgaccctaacgtactacggtacgggaacggttcccggacccgaagggaacgggaacggtacgggaccgttaggtaaccttaacgtttacgtacggttaccaaccggttaccggaccttaacggaaacacggtaccgtaacgggtacggtaccgttaacgttaagttacggttaaccggttaacggtttccgggaacggggtaacgggttaccggtaaccgggtaccgttaaccgggtaacccggtttaccggttaacgtaaccggtaaccgaaccccggtaacgggtacccgttaccccggtacccccggtttaacccgg

SEQ ID NO: 125673 - DNA, 639 bp, Homo sapiens
  misc_feature: GYAE6OF02IC9C7.53.31.C09.1.454.CMB.1.raw
  modified_base (312)..(312): a, c, t, g, unknown or other
  misc_feature (312)..(312): n is a, c, g, or t
tcagcgcgtatacacacgaccggtgctcgatttagacgtctcatcaaggaaggaaggggtgggtccaggaggcagaactctgggtgtctcaccatggcctggatccctctacttctcccccctcctcactctctgcacaggctctgaggcctcctatgagctgacacagtccaccctcggtgtctggtcgtcctcgaggacagacggccaggatccacctgccttcgtggcgatgctattcgaccaaaaacattatgcttactcggtaccagcagacggcaggccacggcccctgtcgttggtgtatttaanaaagtactttgagacggcctacgacgggaccctgacgcgtattctcgtggcctcgagcgtacgaacgggacaacgtcgtacctaccgttacgacctagtacgaggtacgggacggttcccggacgtaagggaacggacggacggtcgtagtaacttacgtttaacgtgttaccgacgtcccggacaacgacgagacgagggtacggacgttaagtttcgtcgtacgttacggttacgggacgggtacgggtacgtacggccgttacggacccgttacgtacggtaccgacgacccggtaaggtcccgtacccggtccccgttaccgg

SEQ ID NO: 125674 - DNA, 700 bp, Homo sapiens
  misc_feature: GYAE6OF02GYWKH.53.31.C09.1.454.CMB.1.raw
  modified_base (297)..(297): a, c, t, g, unknown or other
  misc_feature (297)..(297): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggcaggatcacctgctctggcgatgcattgaccaaaacatatgcttactggtaccagcagaggccaggccacggcccctgtcttggtgtatttaanaaagtactttgagtacggcccttcgacgggaccccttggacgtcgtattccgtacgtcggcctccgagtccttacgaacgggaccaaacgtacgtacctaacccgtttcgaaccctataccgaggttacgggacggttcccggacccgaagggtaacggaacgggtacggtaccgttacggtaacctttaacgtttaccgttacggttaccgtaacgggttcccgacgtaacggaccgtaacggtccgaagggttcgggtaccgtaaggttttacgtacggtttaccgttacggttccggggtacgggtaacgggtaccgttaccggaccgttacgggtacccgttaccgttacgggtacctacggaccccggtaaggtcccgtcccggtcccccgttaccgg

SEQ ID NO: 125675 - DNA, 581 bp, Homo sapiens
  misc_feature: GYAE6OF02HLC52.53.31.C09.1.454.CMB.1.raw
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcaccggctctgaggcctctatgagctgacacagtcaccctcggtgtctgtgtcctcaggaccagacggccaggatcacctgctcgtggcgatgcattcgaccaaaaacatatgcttactggtaccagcagaggccaggccacggcccctgtcttggtntatttataaagtctttgagacggccctcgacggaccctggacgcgattctctggctaccagtctcgacggacaacgngtaccacgttcgaaccngtacagtcggacgtcccggacgaggaggacgacggctacgtactaattacgtacgtcgtacgtccgacacgacgagcaggtgacgtagttattggtacgtagttcgggacggacgggtacgtaccgcggtaccgtaccggttccgtacggtaccgtacggcccgaacggtccctcccggtcccccgtgttcccg

SEQ ID NO: 125676 - DNA, 499 bp, Homo sapiens
  misc_feature: GYAE6OF02F0OGI.53.31.C09.1.454.CMB.1.raw
  modified_base (339)..(339): a, c, t, g, unknown or other
  misc_feature (339)..(339): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttanaaagactttgagaggccctcgagggacccctgagcgattctctggctccagctcagggacaacagtcaccttgaccatcagtgagtccggcagaggacgaggctgactattactgtcagtccgcagacagcagtggcagttatgtcgtagttcggacggg

SEQ ID NO: 125677 - DNA, 504 bp, Homo sapiens
  misc_feature: GYAE6OF02F6NEV.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcagggacccctgagcgattctctggctccagctcagggacaacagtcaccttgaccatcagtggagtccggcagaggacgaggctgacttatactgtcagtccgcagacagcagtggctagttatgtcgtagtcggcggaggacgtacgctgaccgtcctaggtcacgcccgaaggctcgccccgtccgg

SEQ ID NO: 125678 - DNA, 800 bp, Homo sapiens
  misc_feature: GYAE6OF02G147S.53.31.C09.1.454.CMB.1.raw
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggngtatttanaaagtactttgagacggccctcgacgggtacccctggacgcgtactttcctcgttcgggcctccgacggtcctacgaacggggtaaccaaccgtacggttcctaacccgtttcgaaccccaagttccgaacgggttcggggaacggttccccggggaccgtaacgggaaacgggaaccgggaacgggtacccgttacggtaaccgtttaaacgtttaaccgttacggttacccgtaacgggttcccgtaccgtaacggaaaccgtaacgggtaccgtaacggggttcgggtaaccgttaaagggttttaacgttacgggtttaccgggttaacgggtttaccgggggaccgggggtaaacgggggtaacccgttaacccgggtaccggtttaaccggggtaaccccggtttacccggtttaaacggggtacccgtaaccggggtaaccccccgtaaacggggtccccggttaccccgggtaccccccccggtttaacccgggg

SEQ ID NO: 125679 - DNA, 602 bp, Homo sapiens
  misc_feature: GYAE6OF02F84ZJ.53.31.C09.1.454.CMB.1.raw
  modified_base (456)..(456): a, c, t, g, unknown or other
  misc_feature (456)..(456): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggactcacctgctctggcgatgcattgaccaaaaacaatatgcttactggtaccagcagaggccaggccacggcccctgtcgttggtgtaatttaagtaaaagtcgtttaggaagtacggccccttacgaaccggggtacccctggacgccggtatttccgtcgtcggccttccgagtctcgaagggaaccaacgtacgtcctaaccttcgaacctatcgaggtaggacgtccggaccgaaggaggacgnggactacgaacttagttactgtcacgtccgacgacgacagcgagtggactagttagtgtcgtagtcgggacggacggtacgtacggtcgtacggaccgttacgtacggtactacggaccccgaggcccgtacggcccccgttacgg

SEQ ID NO: 125680 - DNA, 573 bp, Homo sapiens
  misc_feature: GYAE6OF02H7G5A.53.31.C09.1.454.CMB.1.raw
  modified_base (482)..(482): a, c, t, g, unknown or other
  misc_feature (482)..(482): n is a, c, g, or t
  modified_base (562)..(562): a, c, t, g, unknown or other
  misc_feature (562)..(562): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctctcactctctgcacaggctctgaggcctctatgagctgacacagtccacctcggtgtctgtgtcctcaggacagacggccaggatcacctgctctggcgatgctattcgaaccaaaaacaatatgtacctttacgtcggtaaccagcaggacggccaggcccgacggtcccctggttcttggtagtaacttttaagtaaagtctttaggaagtacggccctcgacgggtacccctggacgcgtattctcgtgcctcgagtctcgaggacaactggtccaccttgaccatcagtggacgtccggcaaggcggacgnggctagaacttagttacgtgtacgacgttccgagtagaaccaggccgtaggtcggactaaggttcgtggtcggtttacgngggtaaccggg

SEQ ID NO: 125681 - DNA, 580 bp, Homo sapiens
  misc_feature: GYAE6OF02HBC68.53.31.C09.1.454.CMB.1.raw
  modified_base (222)..(222): a, c, t, g, unknown or other
  misc_feature (222)..(222): n is a, c, g, or t
  modified_base (342)..(342): a, c, t, g, unknown or other
  misc_feature (342)..(342): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctctcactctctgcacaggctctgaggcctctatgagctgacacagtcaccctggtntctgtgtcctcaggacaggaccggccaggactccacctgctcgtggcgatgcattcgaccaaaacatatgcttactcggtaccagacgaggacggccaggccacggcccctgtcttggtntattaataagtcttagagtacggccctacgacgggtacccctgacgtacgtacttccgtcgtcggcctaccgacgtctacggagggaccaacgacgtccaccttcgacctatcgaggtcggacgtccggacgaggacggacgaggtctagtacttattacgtcgtacacggtccgacgaacgtacgacgcgtagggtgtacgttagttacgttggtacggttacggtccgggtacggg

SEQ ID NO: 125682 - DNA, 645 bp, Homo sapiens
  misc_feature: GYAE6OF02IIX9F.53.31.C09.1.454.CMB.1.raw
  modified_base (309)..(309): a, c, t, g, unknown or other
  misc_feature (309)..(309): n is a, c, g, or t
tcagcgcgtatacacacgaccggtgctcgatttagacgtctcatcaaggaaggaagggggtgggtccaggaggcagaactctgggtgtctcaccatggcctggatcccctctacttctcccccctcctcactctctgcacaggctctgaggcctcctatgagctgacacagtccaccctcggtgtctgtgtcctcaggacagacggccaggatcactgctctggcgatgcattcgaccaaaaacatatgcttacgtcggtaccagcaggacggccaggccacggcccctgtccgttggtgtaatttaanaaagtctttgacgtacggcccctagacgggacccctgacgctattcctcgtggcctccagcctacgacgggaacaacgcgttccaccgttagaccctatcgtaggtcgggtacggtcccggccgaaggaacgggaccggacggtcgttaacggtaaccttaacgtttaccgcggttaccacggtcccggacgtaacgaccgagtccgtaggtcggaccttagtttacgtcgtacggttacgttcggggacggtaacgggtaccgtaccggtcgtaccggtaccgtaccgtacggtacgaccgtcccggaaggtcccgtcccggtcccccgttccgg

SEQ ID NO: 125683 - DNA, 661 bp, Homo sapiens
  misc_feature: GYAE6OF02F9T02.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctcccccctcctcactctctgcacaggctctgaggcctcctatgagctgacacagtcaccctcggtgtctgtgtcctcaggacagacggccaggatcacctgctcgtggcgatgcattcgaccaaaaacattatgcttactggtaccagcagacggccaggccacggtcccctgtccttgggtgtaacttttataaagtacgtttgaggtacggccctacgacgggtaccccctaggagaccgtattacctcgtcggtcttcccgagtcctacgagggaacaaacgtacggtcctacccttacgaaccctataccgtaggtggtaacggtcccggtccgaaggtaacgggaacggtacgggccgtacgtaacttatttacgttcgttcgtacgtcccgactagaaccagacgaggttcggactaacgtttgtacggttcgttacgttccggggagggtacgggaccgttacggaccgttacgggtaccccgttccggtacggtactaccggacccgtaacggcccgttcccggcccccggttccgg

SEQ ID NO: 125684 - DNA, 571 bp, Homo sapiens
  misc_feature: GYAE6OF02I06CF.53.31.C09.1.454.CMB.1.raw
  modified_base (222)..(222): a, c, t, g, unknown or other
  misc_feature (222)..(222): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggatccctctacttctccccctctcactctctgcacaggctctgaggcctcctatgagctgacacagtcaccctggtntctgtgtcctcgaggacagaccggccaggactcacctgctctggcgatgcattgaccaaaacatatgcttactggtaccagcagagccaggccagccctgtctggtgtattataaagtctttgagacggtccctacgacgggacccctggacgcgtattctcgtcggcctccgagtctcgaagggacaacgacgtccacgttcgacctatcgaagtcggacgtcccggacacgggaggacgaggcctagtaactagtttaaccgtgtacgacgtccgacgtaacggaccgtaggaccgtaggttaggaccttaaggtttactgggtaccgttaggttccgggaacgggg

SEQ ID NO: 125685 - DNA, 730 bp, Homo sapiens
  misc_feature: GYAE6OF02HZV66.53.31.C09.1.454.CMB.1.raw
  modified_base (489)..(489): a, c, t, g, unknown or other
  misc_feature (489)..(489): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttcctccccctctcactctctgcacaggctctgagcctctatgagctgacacagtccacccgtggtgtcctgtcgtcctcgaggacaggacggccaggactcaccgtgcctcgtggcgatgctagttcgaccaaaactaatactgtacctttacgtacggtaccagacgaggacggtccgaacggcccgtaacggtcccccttggttccgtttgggtacgttacgtttttaaacgtaaacggttaccgttttaggaacggtaccggtacccttacgaaccggggtaccccctgggtaccgacgttactttccgttacgtcggtccttaccgngtacctacggaacggtaaccaaacgtacgttaccgtaaccgttacgaacccctagttaccgtaaggtcggtaccggttacccggaccgtaagggaccggaaccgtacggtccgttaagtaccgtttaacgttaccgttaccggtacgtaccgtcccggacgtaacggtaccgtacggaccgttacgggtcgtacgtaaggtttacgtaccggtttacgtacgggttaccgggtaaccgggg

SEQ ID NO: 125686 - DNA, 572 bp, Homo sapiens
  misc_feature: GYAE6OF02GN53Z.53.31.C09.1.454.CMB.1.raw
  modified_base (292)..(292): a, c, t, g, unknown or other
  misc_feature (292)..(292): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctctcactctctgcacaggctctgaggcctcctatgagctgacacagtcaccctcggtgtctgtgtcctcgaggacaggaccggccaggatcacctgctcgtggcgatgcattcgaccaaaaaaatntgtacttactggtaccagcagacggccaggccacggcccctgtcgttggtgtatttaagtaaagtactttgacgacggccctcgaacgggacccctggacgcgtactttctccgtggcctccgagcctacgagggacaacacgtaccaccttacgaccagtcgtaggtggacgtcccggccgaggacggacgacggctcgaacttattacgtcgtcgcgtccgacacgaacgagcgaggtcgataggttagttcgtacgtaggttccggagggtaacggg

SEQ ID NO: 125687 - DNA, 658 bp, Homo sapiens
  misc_feature: GYAE6OF02JX6U3.53.31.C09.1.454.CMB.1.raw
  modified_base (250)..(251): a, c, t, g, unknown or other
  misc_feature (250)..(251): n is a, c, g, or t
  modified_base (481)..(481): a, c, t, g, unknown or other
  misc_feature (481)..(481): n is a, c, g, or t
tcagcgcgtatacacacgaccggtgctcgatttagacgtctcatcaaggaaggaaggggtagggtccgaggaggcgagaactctgggtgtctcaccatggcctggatccctctacttctcccctcctcactctctgcacaggctctgacggcctcctatgagctgacacagtccacccgtcggtgtctgtctcctacaggacagacggccaggatcaactgctcgtggcgatcgctatgaccaaaatatnntcttactcggtacagctaggacggaccacggccgacggcccctagtcgttcggtagttatttaacgaaacgttccgtttaggaacggtaccggtcccgtacggaccgggtacccgtaggtaccggcgtacttcgtcgtagcctaccgagcttacgacgaacgaactcggtactacccgtagcctactcgaacgtcggtaacgtcccgcgaacggacgggtacaacgggtntaacgacttaacgttcgtacggtaaccgtcgtaccgtacggacgtaaccggtacgtaccgacggttcggaccgttaagttaccggttacggtacggttacgttcgggacgggtacggtcctaacggtcgtacgtaccgtcgtaggtctacgaccgtcgtactcccggtcccttacgg

SEQ ID NO: 125688 - DNA, 728 bp, Homo sapiens
  misc_feature: GYAE6OF02JWZU7.53.31.C09.1.454.CMB.1.raw
  modified_base (225)..(225): a, c, t, g, unknown or other
  misc_feature (225)..(225): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggatccctctacttcctccccctctcactctctgcacaggctctgaggcctctatgagcctagacacagtccaccctggtntctgtcgtcctcgaggacaggaccggccaggactccacctgctcgtggcgatcgctattcgaaccaaaaactaagtaatgtacctttaacgtcggtaaccagacaggacgaccgacggcccgacggtccccttggttccgttgggtattaacgtttaaagtaaacgttcgtttaggaacggtacggtaccccgttacggaacccgggtaccccctgggtaaccggtaccggtttactttaccgtccggtttcgggaccccttaccgtaacggtcccgttaacgggaaacgggtaaaccctaaaccgtacggttaccctaaccggtttccgaaaccccgtacgttaccggaagggtccgggtaccgggtaccccgtacggaaggaccgggaacgtacgggtcttaaccggtacttaagttaccgtgtaccgtaccgtccgacgtagaaccgtgccggtagtcgggacttaggttacttcgggtaccggttaggtccgggaacgg

SEQ ID NO: 125689 - DNA, 739 bp, Homo sapiens
  misc_feature: GYAE6OF02H1SPE.53.31.C09.1.454.CMB.1.raw
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (389)..(389): a, c, t, g, unknown or other
  misc_feature (389)..(389): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccaccctcggtgtctgtgtcctacaggacaggacggccaggatcacctgctcgtggcgatgctattgaccaaaaacatatgcttactggtaccagcagaggccaggccaggcccctgtcgttggtatatttaanaaaagtctttagagacggtccctagacgggacccctggacgcgactttcncgtaggcctaccgagacctgaacggggaacaaaanacggtaccctaaccgtttacggaccctaagtaccgtagggtaggtaaccggttacccggccggaaggtaacgggaaccgggaggggtaccttaaggaaccgttaacgtttaaaccgttcggtaccgttacggtaccccggaacgaacggtaaacccgaaggtaccggtaaggttacggggacgtttaaacggtttagttaccggttacgggttaacgttaccggggtacggggaacccggggtaacgtaaccggtaccggttaccggtaaccccggttaccggttaacgggtacccgaacggaccccgggtaaacggtccgttaccccggtccccccgggttaaccccgg

SEQ ID NO: 125690 - DNA, 641 bp, Homo sapiens
  misc_feature: GYAE6OF02I89F4.53.31.C09.1.454.CMB.1.raw
  modified_base (283)..(283): a, c, t, g, unknown or other
  misc_feature (283)..(283): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttcctccccctcctcactctctgcacaggctctgaggcctcctatgagctgacacagtccaccctcggtcgtctgtcgtcctcgaggacaggaccggccaggactccacctgctctggcgatgacnttcgaccaaaacaatactgtacttactcggtaccgagacgaggacggccgacggccaaccgggtcccctggttcttgggtagtaatttaacgtaaagtactttgacggtacggccctacgaccgggacccctggacgtcgtacttcgtcgtcggctcgacgtctacgagggacaacgtcgtacctaccttgacctataccgtagtacggacgtccggccgtaggaccgggaggtaccggtacgttagtaaccttacgttaccgtacggtccgtacgttcccggacgtaacggaaccgtagtaccgtacggtcggtacgttacggtttattcgggtacgtttacggtccgggtaacggg

SEQ ID NO: 125691 - DNA, 723 bp, Homo sapiens
  misc_feature: GYAE6OF02IUCVZ.53.31.C09.1.454.CMB.1.raw
  modified_base (572)..(572): a, c, t, g, unknown or other
  misc_feature (572)..(572): n is a, c, g, or t
tcagcgcgtatacacacgaccggtgctcgatttagacgtctcatcaaggaaggaagggggtgggtccaggaggcagaactctgggtgtctcaccatggcctggatccctctacttcctccccctcctcactctctgcacaggctctgacggcctcctatgagctgacacagtccaccctcggtgtctgtcgtcctcgaggacaggaccggccaggactcacctgctcgtggcgatgctagttcgaccaaaaactatagtcgtacttaacgtcggtaacccagaccgaaggacggccgaacggcccaaccgggtcccccttggttccgttggtacgttaagttttaaacgtaaaggttaccgttttaggaacgggtaccggtacccccttaggaaccggggtaccccttaggacgccgttaacttccgttcgtcggtcctaccgaggtcctacggaacgggaacctaacgtactcccgtaacctttcggaacctacgtaccgtagggtacggaccgtcccgggacgtagggacgggacggacggtactacgtaacttacgttactacggtacncggtaccgagaacgaccgtagacgtaggccggtacttaagggtttgacgttcgggtagtccggggtacggtagtaacccgtcggtaccgtaccggtaccgtaccggtcgtaccgccggaacctacgggtcccgtacccgtccccggttccg

SEQ ID NO: 125692 - DNA, 712 bp, Homo sapiens
  misc_feature: GYAE6OF02G7HRC.53.31.C09.1.454.CMB.1.raw
  modified_base (243)..(243): a, c, t, g, unknown or other
  misc_feature (243)..(243): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacaggacggccaggatcacctgctcgtggcgatgcattgaccaaaaanatatgcttactggtaccagcagaggccaggccacggcccctgtcgttggtgtatttaataaagtactttgagacggccctcgacgggacccctggagcgtattctcgtcggctccagctcgagggacaacgagtacctaccgttcgaaccatacaggtacggacggtcccgggaccgaacgggaacgggacgggaacgggtccgtacggtaacctttaaacgtttaaccgttcgttaccgtacggttacccggacgtaacggaaccgaacggcgtaacgggttcgggtaaccgttaaggtttacggttacggtttaccggtttaaggttaccggggaccggggtaacggggtaacccgttaaccggtaccggttaccgggtaacccggttacccggttaacggggttacccgtaaccgggaccccggtaaacgggtccccggttacccggtacccccccgttacccggg

SEQ ID NO: 125693 - DNA, 691 bp, Homo sapiens
  misc_feature: GYAE6OF02G3GVB.53.31.C09.1.454.CMB.1.raw
  modified_base (251)..(251): a, c, t, g, unknown or other
  misc_feature (251)..(251): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttacnggtaccagcaggcgcacgcaccggcctgttcgtggtatagtttaagaacgttcgttagacggtccgtcctacggaccgggtcccctaggacgtacgtactttcctcggtcggtacctacgacgtcctacggaacgggaaccaacgtaccggtaccctaaccgttaccgaaccttagtaccgtagggtacgggtacccgggcccggtaaaccgaagggaacgggaaccggtacggtaccgtaacggtaactttaacgttacgttacggtaccgtaccggtaccgagtaacgaacgtacggagtaacgggtcgtacgttaagttagttcggtaacgttacgggtccgggagggtaccggtacctcgggtccgtaccggtacccgttacgtaccggtaccgaccggacccggacggttcccgtccccggtacccgttacccgg

SEQ ID NO: 125694 - DNA, 668 bp, Homo sapiens
  misc_feature: GYAE6OF02H2PJK.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatcccctctacttctccccctcctcactctctgcacaggctctgaggcctcctatgagctgacacagtccacccctggtgtctgtcgtcctcgagggacaggacggccaggactccacctgctcgtggcgatcgcattacgaaccaaaaactattatgacttacgtcggtaccagacgagacggccgacggccgacggcccctgtccgttggtgtatttaagtaaacgtacgttttgaagacggtcccctcgaaccgggacccctggacggaccgtacgtttcctccgttggccttccgacgtccttacggaacgggacaaacacgtacctaccgtcgacccgtagtaccaggtcggtacgtcccggacgaaggacggacggacggcgtagacttaagttacgtacgtcgtacgtccgacgtacgaacgacgagtacggtcggacgttacgttaagttagtacgttagtaccgggagggaacgggttaccgtacggtccgtacggacccgtttaccgtacgggtaccacggacccgtaacgggctcccggtaccccctacccggg

SEQ ID NO: 125695 - DNA, 575 bp, Homo sapiens
  misc_feature: GYAE6OF02GNLFA.53.31.C09.1.454.CMB.1.raw
  modified_base (291)..(291): a, c, t, g, unknown or other
  misc_feature (291)..(291): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtntatttaataaagtactttaggagacggccctacgacgggacccctgacgcgtattctctcgggctccgagcctcgagggaaccaacgagtccaccttcgaccatcgaggtggacgtccggacaggaggacgaggctgtaactacttactgtcacgtccgacacgacagcgagtggactagttatgtagtacgttcgggacggagggtaccgtacgccgtacggacccgttaccgtagggtaccacggtaccccgaaggtccctaccggtccccccgttaccggg

SEQ ID NO: 125696 - DNA, 603 bp, Homo sapiens
  misc_feature: GYAE6OF02F9U5W.53.31.C09.1.454.CMB.1.raw
  modified_base (153)..(153): a, c, t, g, unknown or other
  misc_feature (153)..(153): n is a, c, g, or t
  modified_base (223)..(223): a, c, t, g, unknown or other
  misc_feature (223)..(223): n is a, c, g, or t
  modified_base (340)..(340): a, c, t, g, unknown or other
  misc_feature (340)..(340): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggatccctntacttctccccctctcactctctgcacaggctctgaggcctcctatgagctgacacagtcacccgtggtntctgtgtcctgaggacaggaccggccaggactcacctgctctggcgatgcattcgaccaaaactatatgtacttactcggtaccagcagacggccaggccacggccctgtcgttgtntattataaacgtctttagagacgtcctacgacggtccctgacgcgtattctcgtgctccagctacgaggacaacgtacgtccaccgttgacctatcgtaggtcggtacgtcccgacgagggtacggacgaacggtcgttacgtaaccgttaagttaccgttcgtaccgtacgttcccgaccgtaacggaccgacggtaccgtacgggttaggtaccgttagttttaaccggtcggtttacggttacggttccggggtaacggg

SEQ ID NO: 125697 - DNA, 606 bp, Homo sapiens
  misc_feature: GYAE6OF02IUB7K.53.31.C09.1.454.CMB.1.raw
  modified_base (181)..(181): a, c, t, g, unknown or other
  misc_feature (181)..(181): n is a, c, g, or t
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (476)..(476): a, c, t, g, unknown or other
  misc_feature (476)..(476): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtntctgtgtcctcaggacagacggccaggntccactgctcgtggcgatgcagttgaaccaaaaacatatgcttactcggtaccagcagacggccaggccacggtcccctgtctggtntattataagactttgacgacggccctacgacggtaccctggacgcgtaattctcgtggacctccgagcctacgacggacaacgcgtaccaccgttcgaaccactacgtaggtcggaacggtcccggacgaggacggacggaggaccgtagtaacgttacttacgtcgtacgacgtcccgngacgtacgacgacgtaggtcggactaggttacgttagttcggtacgttcggacgggtacggacgtacgtcgtaccggtaaccggtccgtaaggtccgacggacccgtacggccgtccgcccccgttacgg

SEQ ID NO: 125698 - DNA, 668 bp, Homo sapiens
  misc_feature: GYAE6OF02GM4TD.53.31.C09.1.454.CMB.1.raw
  modified_base (253)..(253): a, c, t, g, unknown or other
  misc_feature (253)..(253): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtcgtcctacgaggacagaccggccgaggactccaccgtgcctcgtcggcgatgctattcgaccaaaanatatcgtcttacgtggtaaccagacaggtacgccgaggccacggtcccctgtcgttaggtcgtaatttaagtaaacgttacgtttaggaacggtccggtcccttacgacgggtacccctaggacgcgtacttcgtcgtaggcctccgagtctacgagggaccaagtacgtcctacttcgaacctacgtcgagtcggactccggacgaggacggacgaggtccacggtaacttagttacgtcgtacgtacgtccgacgtacggaccacggccgtaggtcggtacttacggttaagttcggttactaacgggtcgggtacggtacgggtacccgtcgggttacctaccggttaacccggtcgtacggtacgacccgggtaccggtaacggtcccgttacccggaccccggttaccgg

SEQ ID NO: 125699 - DNA, 690 bp, Homo sapiens
  misc_feature: GYAE6OF02H7EFN.53.31.C09.1.454.CMB.1.raw
  modified_base (615)..(615): a, c, t, g, unknown or other
  misc_feature (615)..(615): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccagtggcctggactccctctaccttcctcccccctctcactctctgcacaggctctggacggtcctcctatgagtctagaccacagtccacccgttcggtgttctgtcgtccctagaaggactacggacggaccaggaccttccacctggccttcgtgggaccgtatcgactattacggaaaccctaaaaacgtatacgttgtaccttttacgacggtacccaggcaaggccggaccgacggccctacggccttggtcgttggtacttaatttaagtagtagttagacgtaccgcctacggaccggacccgtggacgccgttacttcgtacgtcggtcctaccgaggtacccgtaggtaaacggaacctaaaccgtcggtaaccctaaccgttcgaaacctcggtacggtagggtccggaccggtcccggagaacgggacggaacggtcgtacgtaagtacttacgttagtcgtaccncggtccaacggtcaccggtcgtaagtacggtcggtacttaaggttcgtacggttccggttaggtcggggtaacgg

SEQ ID NO: 125700 - DNA, 716 bp, Homo sapiens
  misc_feature: GYAE6OF02GPQL3.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccacggcccctgttccgttggtcgtatttaataaagtactttgagacggccctacgacgggacccctggacgcgtattcctcgtcgtcctccagcgtacgaagggaaccaaacgtacgtacctacccgtttacgaaccctataccgtaggtacgggtacgggttaccccgggacccgaagggaacgggaaccgggtaacgggtaccttacggtaaccttaacgtttaacgttacggtaccgtaacggtcccgaccgtacgaaccgacgtaccgtagggttacggtacgttaaggtttacgttacggttaccggttaacggttccggggtacgggtacgggtaaccgttaccgggtaccgttaccgggtaacccggttaccggttaacgggttaccgaccggtaccccgtaacgggtcccgttcccggtacccccggtttacccggg

SEQ ID NO: 125701 - DNA, 806 bp, Homo sapiens
  misc_feature: GYAE6OF02JIVL0.53.31.C09.1.454.CMB.1.raw
  modified_base (592)..(592): a, c, t, g, unknown or other
  misc_feature (592)..(592): n is a, c, g, or t
tcagcgcgtatacacacgaccggtgctcgatttagacgtctcatcaaggaaggaagggggtgggtccaggaggcagaactctgggtgtctcaccatggcctggactccctctacttcctccccctcctcactctctgcacgaggtctctaggacggcctcctagtgagctcgaacacacgtccacccgttcggtgtcgtgtcgtcctacgaaggacacggaccggcaggtactaccgaccgtgtccgtcgtcgggacgagttcgacttagttaccgaaaaccaaaaatattaatccgttacctttacggtacgtaaccgaggacggaacggaccgggcccgaaccgggtccgtacccggtccccgtttggttacggtttggtagttaacgttttaaagaaaccggtttcggttaggaaccggtaccggtaccccgttacggaacccgggacccgtaggacggtaacttcgttcctcggtcggtaccctacgccgttacacgggtaaggaaccctaagtaccgttcccgtaacgttaccgactacgtacggtacggtcggtaccggtccggaccggtaaggtaacgggacggngtaccgtaggtaccttagttaccgtacgtcgtaccgtacgcgtaacggccacggtaccgtggtacgaggttacttcggttacggtacgttcgggttacggggaccgggtaaacggcccggttacgtacccggttacggtacccgttaccgtacgggtacccggaacccggtacggtaccccggttcccggtacccccggtccccggttacccgg

SEQ ID NO: 125702 - DNA, 593 bp, Homo sapiens
  misc_feature: GYAE6OF02GT14X.53.31.C09.1.454.CMB.1.raw
  modified_base (244)..(244): a, c, t, g, unknown or other
  misc_feature (244)..(244): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcacccctggtgtctgtgtcctcaggacagacggccaggactcacctgcctcgtggcgatgcattagaccaaaanatatgcttactggtaccagcagaggccaggccacggcccctgtcttggtgtatttaataaagtactttgagacggccctcacgggacccctgagcgattccgtctcggctccagtctcgaggacaacacgtacaccgttcgaaccatacaggtaggacgtcccggaccgaaggacggacggacgggctacgtaacttaactttacgtacgttaccgtacgtcccggacgacgacgagccgagtcggatacgttagtcgtagttagtcgggacgagggtacgtcggcgtacggtaccgttaccgtacggtaccgaccggtacccgaaggtcccgtccggccccgttccgg

SEQ ID NO: 125703 - DNA, 692 bp, Homo sapiens
  misc_feature: GYAE6OF02HO22D.53.31.C09.1.454.CMB.1.raw
  modified_base (499)..(499): a, c, t, g, unknown or other
  misc_feature (499)..(499): n is a, c, g, or t
  modified_base (613)..(613): a, c, t, g, unknown or other
  misc_feature (613)..(613): n is a, c, g, or t
  modified_base (631)..(631): a, c, t, g, unknown or other
  misc_feature (631)..(631): n is a, c, g, or t
  modified_base (639)..(639): a, c, t, g, unknown or other
  misc_feature (639)..(639): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggactccctctacttcctccccctcctcactctctgcacaggctctgacggcctctatgagctgacacagtccacctcgggtgtcctgtgtacctcgacggacaggaccggcctaagggactccgaaccttcggcctcgtagggccaattcgacctagtttcgaacccaaaaaactaatattcgtactttaacgtacggtaacccaggccgaaggtaacgggccaaacgggttccccaacgggtcccccttggttaccgtttggggtacttaaactttttaaagaaaacgttattttacgggaacgaacggccccgttacgaaccggggaacccctggaaccgcggtattttccngtcgggtaccttccgaagtcctaggaaccggaacaacgtacgtccaccgttagacctattcgaagttcggaattcccgggaccaaggcgtacgaagtcctagaactagttacgntcgaccgtccaggaaacncgaacggntaaacggtgggaacttacggttagtcggtacggtttccgagggtaacccgggg

SEQ ID NO: 125704 - DNA, 739 bp, Homo sapiens
  misc_feature: GYAE6OF02G172I.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccaccctcggtgtctgtcgtcctcgaggacacggacggccaggatcacctgcttcgtggcgatcgctattcgaaccaaaacaatatgtaccttacgtacggtaaccagacaagacggaccgacggccaccggtccccttggttcttggtagttaatttaagtaaaaggttctttaggacggtacggtccccgtacggaccgggtacccctaggacgtcgtactttccgtcgttaccggcctaccgacgtccgtacgaacgggtaacaaaccgtacgtaccctaaccgttcgaaccctactcgtacggtgggaccgtccggacgagggaacgggacgacgggctacgtaacttacgttacgttcggtacgtacgtacccgacgtacgacgacgtacgtaggttaccggattacggtttacgttacggttacggtttacgggttaccgggacgggggttacggtaacccggttaacggtccggttaccggaaacccggtttcccggttaaggaccccgtaacgggtacccccgtaaggtaccccggttccccggtaccccccgtttcccgg

SEQ ID NO: 125705 - DNA, 630 bp, Homo sapiens
  misc_feature: GYAE6OF02I3ZJB.53.31.C09.1.454.CMB.1.raw
  modified_base (247)..(247): a, c, t, g, unknown or other
  misc_feature (247)..(247): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcacccctggtgtctgtgtcctcaggacagacgccaggatcacctgctcgtggcgatgcattcgaccaaaaacatatncttactgtaccagcacggagacccaggccacggccccttgtcgttggtactatttaataaagtactttaggagacgtccctcgacgggtacccctagacgcgtacttctcgtcggtacctccgaacgtctacgaagggacctaaacgtacgtaccaacctttcgaaccctagtaccgtaggtacgggacgttcccgggcgaacgggaacggtaccggaaggtccgtacgtacttaagtttacgtcgtcgacgtcccgagaacgacgacgacgagttcggacgtagtttaacgtgttacgtacgttcgggacgggtaggaaccgtcggtacgtcgtacccgtctaacggcaccgacccgaacggtctcccggtccccgttaccg

SEQ ID NO: 125706 - DNA, 686 bp, Homo sapiens
  misc_feature: GYAE6OF02G9RXY.53.31.C09.1.454.CMB.1.raw
  modified_base (184)..(184): a, c, t, g, unknown or other
  misc_feature (184)..(184): n is a, c, g, or t
tcagcgcgtatacacacgaccggtgctcgatttagacgtctcatcaaggaaggaagggggtgggtccaggaggcagaactctgggtgtctcaccatggcctggatccctctacttctcccccctcctcactctctgcacaggctctgacggcctcctatgagctgacacagtccaccctcggtntctgtgtcctcaggacagacgcaggatcactgctcgtggcgatgctattcgaaccaaaaactaatatcgtacttaacgtgtaccagcaaggacgccgacggccacggccccttgttcgttggtagtaatttaagtaaagtactttaggaacggacggtcccctacggaaccgggtacccctggaacgtacggtatttccgtcgtcggtcctacccgtacgtcgtaacggaacgggaacaaacgtacggtacctaccgttacgaactacgtacgtacggtcgggtaaccggtcccggacgaacgggaaggaaccggaagggtcctaacgtaacgtttaacttacgttacgtacggtaaccgtcccgacaacgaacctaggcgtaggtacgcgttaagttagtacgtcggttagtccggggaggtacggaaccgtcgacgtacggtaccggttaccgtacggtaccaaccgggaccccgacgggtccctcccggtccccgtcgg

SEQ ID NO: 125707 - DNA, 735 bp, Homo sapiens
  misc_feature: GYAE6OF02HSIL4.53.31.C09.1.454.CMB.1.raw
  modified_base (672)..(672): a, c, t, g, unknown or other
  misc_feature (672)..(672): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctgacggcctcctatgagctgacacagtcaccctggtgtctgtcgtcctcgaggacacggaccggccaaggactccacctgccttcgtggacatggctagttacgaacctaaaaactattagtacggtaccttttaacgacggttaacccaggtaccaagggaccggccaacgggcccaaccgggtccccttgggttaccgttgggtattaaacgttttaaagtaaacgtcgtttaggacggtaccggtccctacgaacggggtacccctaggactcggtactttccgtcgtcggtacctccggtaacgtccgttacgggaaacgggtaacaaaccgtcggttaccctaaccggttaccggtaacctacgttcggaacggtttacggggaacccgtcccgggtaccaaacggggagggtaccggacggtactacgggtaacctttaattccggttcgtaccgacggtacccgacgtaacggaccnggtaccggtagggtcgtacgtaagggtttccttcgggtacggttaccgttcgggggaaccggg

SEQ ID NO: 125708 - DNA, 667 bp, Homo sapiens
  misc_feature: GYAE6OF02FM1RA.53.31.C09.1.454.CMB.1.raw
  modified_base (302)..(302): a, c, t, g, unknown or other
  misc_feature (302)..(302): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatgcattcgaaccaaaaacatatgcttactggtaccagcaggaggccagggccaccggcccctggttccgttgggtntatttaataaagtctttaggagacggccctcgacgggaccccctggacgcgtacttctcgtggcctccagctcgacgggaaccaacgacgtaccaccgttacgaccctacgtacgaggtcgggtacggttccccgggaccgagggaacgggaaccggagggtaccgaggtacctttaacttaccgttcgtaccgtacggtcccgacgaacggcgacggacgagggttcggaaccgttagtttacgtcggttaccgtttaggtccggggtacgggtaacgggtaccgtacggaccggtaccggtaacccggtccgttaccgggtcaaccggtacccgaacggtccgttcccggcccccgttaccgg

SEQ ID NO: 125709 - DNA, 828 bp, Homo sapiens
  misc_feature: GYAE6OF02H9IL3.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacgaggctctggacggtcctcctatgacgctgacacagtccacccgtggtctctggtctcctcgaggaacaggacgccgaggactccactgctcgtggcatcgactattcgaaccaaaaatatactcgtactttacgtacggtaaccacgaccgaaggaccggtaccacgggcccgtaaccggccccgtttggttccggtttggtacggttttaactttttaaaacgtaaaggtttaccgttttggaaacgggtacccggtaccccgtacggaacccggggtaccccgttaggggacgtacggttaactttcccttacggttaacgggtccccttacccggacggtacccgttaacggaaacggggtaacctaaaaccgtacggtttaccgtaacccgttaccgtaaccgtaacgtttacggtaacgggttacggggtaaccgggttaccccgggaaccggaacgggtaacggggaacgggtacgggtaccttaacggtaaccgttaaccgtttacgtccgttaccgtaccggtaccgacgaacgtaacgtaccgacgtaggtacgacgttaacgttcgtaggttacgttacggttacggacggggtaccgtaacggtccgtacgtcggtacccggttacgtacggtaccgacgtacccggtaacggtccgttacccgtccccgttaaccgg

SEQ ID NO: 125710 - DNA, 924 bp, Homo sapiens
  misc_feature: GYAE6OF02IP1N5.53.31.C09.1.454.CMB.1.raw
  modified_base (226)..(226): a, c, t, g, unknown or other
  misc_feature (226)..(226): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtccacccgtcggtcgtctgtcgtcctcgaggacagacggccaggatcacctgctcgnggcgatgcctagttcgaaaccaaaaactaatagtgttaccttaacgtacgggtaacccaaggccgaacggaacggacccgaaccgggacccgaaccggggtccccccgttcggtttccgttttacgggttacggttaaattttaaacgtaaaaacgttaaccgttttagaacggtaccggtaccccgtacggtaacccgggtaccccgtagacgcgtacttcgtcgtacggcctcgacgtcgtacgaacggtaccaaaagtaccgttaccgtaaccggtttacgaaccctacgtacggtaacgggtacggggtaacccgggtcccgggaacccgaaacggggtaacggggaacccgggtaacgggtacccgtaggtaaacccgtttaacgttttaaccgtaccgggttaacctaccgggttaccccggaccggaaaccggaaccggtaaccggaaccggtacggggttacggttaaccgggttaaggttttaaacggttcggttaccgggtttaaaccgggtttcccgggggtaaccgggggtaaccgggttaaccggggttacccggacccggttttaaccgggtaaccccggtttaacccgggtttaccggggttaacccggtaacccggtaacccgggtaaacccggggtttaccccggttacccccgggtaaccccccccgggtttaccccggg

SEQ ID NO: 125711 - DNA, 827 bp, Homo sapiens
  misc_feature: GYAE6OF02IXN3V.53.31.C09.1.454.CMB.1.raw
  modified_base (153)..(153): a, c, t, g, unknown or other
  misc_feature (153)..(153): n is a, c, g, or t
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctntacttctccccctctcactctctgcacaggctctgaggcctcctatgagctagaccacgacgtccaccctcggtgtcgtgtcgtccctacgacggacacggaccggaccaaggtactaccgaccgtgtccgtcgtgggaccgtagtcgactagttcgaaccaaaacgtattacgtcgtaccgttacgtaccgggtaaccacggacgaacggacggtaacccgacggaccccgacggtcccccttggttccgttacgggtgttaaacttttaagttaaacgttacgttttaggacggtaccggtccctaccgggtaaccggggtaaccccctgggtaaccggtccgttaacgttttccgtaccggttccggtaccgtccgtaaggtcccgttaacgggaacgggtaaccgtaaaccgttaccggtacccgttaaccgtttaacgaacccgttacggtaccgtaacgggtttccggggaaccgggttccccgggaacggaaccggggttaccggaaacgggtaccgggtaccgttaacggttaaacgtttaccgtttaacgttaccgttaccggtaccggtaccggtaccggaacgtaaccgtaccggtacgtaacggttcggaaccgtttggttaaccgtacggttaccggtttacggtacccggggtaaccggg

SEQ ID NO: 125712 - DNA, 732 bp, Homo sapiens
  misc_feature: GYAE6OF02F4UUG.53.31.C09.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttcctccccctctcactctctgcacaggctctgacggcctcctangagctgacacagtccacccgtggtgtctgtcgtcctcgagacaggtaccggcaggatccactgctcgtggcgatggactatacgaaccctaaaanaattagtacgtaccttacgtacggtaccagcgaggacgaccggacgacccgcgtaccccttgtcgttcggtagttaattaaacgtaaacgtcgtttacgacgggtacggtacccctacggaaccgggtacccctagggaacgtcgtaccttcgtacgtcggccgtcgagtccgtacggaacggtaccaaccgtacgtccctacgttacgaacctacggtacgtacgggtacggaccggtcccggtaacgaacggggtacggtaaccgggccgggttaccgttaaacgggttaaccttaaccttttaacgggtacccgttcggtacccggttacccgaacggtaccgaacggttaccgggaacttacgggggtactaaccggttaggtttaaccggtgggttttaacccggtttacggggcccggggttaacgggg

SEQ ID NO: 125713 - DNA, 802 bp, Homo sapiens
  misc_feature: GYAE6OF02IKGY0.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacacgtccacccgtcggtgtctgtgtcctcgaggacagaccggccaggactccactgtctcgtggacgatcgctagttaccgaacgaaaaacaattactagtacttacgtacggtaaccgaagtacgacggacgaccgacggaccgaccggcccttgttccgttacggtagttaactttaagtaaacgttacgtttaggacgtaccggccctacggaccggtaccctggactacgtactcgttacgtcggtcctaccgagcctacggaacggaacctaagacctaccgtactacgaacctagtacgtaggtacggcggtccggtaacgaggtaacggacggtacgacgtaacggactttaacgttcgacggtacgtacgacggtacgaacgacgtacgtaccgggtaagtacggtaaccgttaagttaccgggttacgtttacccggggttaacggggtaaccgggttccgggggtaaaaccgggtaccgggttaaccggtaaccccggggttaccggtttaaaaccccgggttacccgggttaacgggggttaacccccgaaccgggggtaaccccccgggttaacgggttaccccccgggttaccccccgggtacccccgggttttaaccccggg

SEQ ID NO: 125714 - DNA, 730 bp, Homo sapiens
  misc_feature: GYAE6OF02IEWAX.53.31.C09.1.454.CMB.1.raw
  modified_base (130)..(130): a, c, t, g, unknown or other
  misc_feature (130)..(130): n is a, c, g, or t
  modified_base (166)..(166): a, c, t, g, unknown or other
  misc_feature (166)..(166): n is a, c, g, or t
  modified_base (233)..(233): a, c, t, g, unknown or other
  misc_feature (233)..(233): n is a, c, g, or t
  modified_base (617)..(617): a, c, t, g, unknown or other
  misc_feature (617)..(617): n is a, c, g, or t
tcagcgcgtatacacacgaccggtgctcgatttagacgtctcatcaaggaaggaagggggtgggtccaggaggcagaactctgggtgtctcaccatggcctggatccctctacttctcccctctcactcnctgcacaggtctctgacggcctctatgagctgacanacgtcacccgtggtgtctgtcgtcctagacgactagacggccaaggtctcactgctctagggctaancgtgacttacgaaccaaaaacgtaatcttcggaccttaactgggttaaaccaccggttgaacggacggacgacggaccgaccgccccgttgtacctttgggatactttaataacggtaacttttggacggaacgtcccttaggaaccggcccgtttgaacggcttaacttaccgtcgtggggttcccaacgacggtttcctacggaacggggacctaaaacggtcgttcctaaacgtttcgaacccgtaaagttccaagggtacggtcggttacgggcccgagggtaacggccggaaaggtcggtaagtacttaagttaaccgttcgcgtaacggtccgtaccgagttaacgtacgacgtacgggtactacgtaagtttaacgnggttacgttaacgttccgggacgggtaaggttaccggtaacgttcgtaaccgtccggtaaccgttacggtacgtaccggaccgttaaccgggtctaccggtccccgttaccgg

SEQ ID NO: 125715 - DNA, 765 bp, Homo sapiens
  misc_feature: GYAE6OF02ID4CV.53.31.C09.1.454.CMB.1.raw
  modified_base (249)..(249): a, c, t, g, unknown or other
  misc_feature (249)..(249): n is a, c, g, or t
tcagcgcgtatacacacgaccggtgctcgatttagacgtctcatcaaggaaggaaggggtgggtccaggaggcagaactctgggtgtctcaccatggcctggatccctctacttctccccctctcactctctgcacaggctctggagcctcctatgagctgacacagtccacccgtcggtgtctggtcgtcctcgaggacagacggccaggactccactgcctcgtggcgatgctattcgaaccaaaanatatgacttacgtcggtaccagcaggacggccgacggtcccgacggtcccccgttggttccgtttgggtacggtttaaattttaaacgtaaaacgttacgttttaggaacggtaccgggtacccctacggtaacccggggtaccccgtaggaacggtcgttaacgtttccgtcggttccggcccttaccgaacggttccgtaacggaacgggaacctaaaccgtacgtaccctaacccgttacgacctaacgtacgtacggtacgggtccggttaccccggacgagggaacgggtacggacggtcgtaacgtaacgtttaaccgttacgttacgtaccgtaccgttacccggagtaaccggaccgtacggaccgtacgggtacggtaccgttaggtttacggtaccttcgggttaacgtccggggacggtaacgggtaccgtacggtccgtaccggtaccggttaccgtaggtaccgtaccggacccgtaacggtcccgcccggttcccctacggg

SEQ ID NO: 125716 - DNA, 634 bp, Homo sapiens
  misc_feature: GYAE6OF02JVGII.53.31.C09.1.454.CMB.1.raw
  modified_base (152)..(152): a, c, t, g, unknown or other
  misc_feature (152)..(152): n is a, c, g, or t
  modified_base (442)..(442): a, c, t, g, unknown or other
  misc_feature (442)..(442): n is a, c, g, or t
  modified_base (457)..(457): a, c, t, g, unknown or other
  misc_feature (457)..(457): n is a, c, g, or t
  modified_base (585)..(585): a, c, t, g, unknown or other
  misc_feature (585)..(585): n is a, c, g, or t
tcagcgcgtatacacacgaccggtgctcgatttagacgtctcatcaaggaaggaagggcacgaccggtgctcgatttagacgtctcatcaaggaggaaggggtgggtccaggaggcagaactctgggtgtctcaccatggcctggatccctntacttctccccctctcactctctgcacaggctctgacggtccctcctaagtgacgcgtacgaccacagttccaccctgggttgtcctgtcgtcctgaacgggtccacggacggccaggatccaccttggctcgtggcgtatgctattcgacaaaacaactgtcgtacttaccgagtacctaagctaacggcggccgaacggcccgacgggtcccctgtcgttacggtagtacttaagtaacgtattacggacgtacggccctacgacggaccctggacgtactcgttacncgttacgtctaccgngtacgtcgagtaccgtaacgtctaccgttactacacctactcggtacggtcgtaccgtccggacgaacgggacggtacgtagtacgttacgtaacttacgttacgacgtcgacgccgtagcgtaacgnggtaccgtaggcgtagtacggttcgtaggtccgttacggcggtaccggg

SEQ ID NO: 125717 - DNA, 635 bp, Homo sapiens
  misc_feature: GYAE6OF02GFX5X.53.31.C09.1.454.CMB.1.raw
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
tcagcgcgtatacacacgaccggtgctcgatttagacgtctcatcaaggaaggaagggggtgggtccaggaggcagaactctgggtgtctcaccatggcctggatccctctacttctcccccctcctcactctctgcacaggctctgaggcctctatgagctgacacagtcaccctcggtgtctgtcgtcctcgaggacagacggccaggactcacctgctcgtggcgatgcattcgaccaaaacatatgtcttacgtgtaccngcaggacggccgaggccacggccctgtcgttggtntatttaanaaagtcgtttaggacgtacgccctagaccgggacccctggacgcgtacttccgtcgtcgcctccgacgctacgacgggtaacaactacgtacctaccgttacgactacgtcgaggtcggtacggtcccggacgaagggaaccggacggacggtacctacggtaacttaacgtcgttcggtaccgacgtccgacacggaccagacgaggtcggacttaggttattcggtacgttacggttcgggacggtacgggtactacggtcgtacggtacccgttacgtacggtacgacccggtacccgaacggttccgccccgtcccggtaccgg

SEQ ID NO: 125718 - DNA, 1018 bp, Homo sapiens
  misc_feature: GYAE6OF02GATRN.53.31.C09.1.454.CMB.1.raw
  modified_base (130)..(130): a, c, t, g, unknown or other
  misc_feature (130)..(130): n is a, c, g, or t
  modified_base (233)..(233): a, c, t, g, unknown or other
  misc_feature (233)..(233): n is a, c, g, or t
tcagcgcgtatacacacgaccggtgctcgatttagacgtctcatcaaggaaggaagggcacgaccggtgctcgatttagacgtctcatcaaggaaggaagggggtggtccaggaggcagaactctgggtntctcaccatggcctggactccctctacttcctccccctctcactctctgcacaggcctcgtgacgtccctcctatgacgctgacacagtccacccgttgggtntcgtgttcgcctcgaaggtaccaggtacccgggaccagggtacgtacctaccgtccgccttccgttcgggtccggtaacgttcggtacccgtaacgtttaccggaaaccctaaaaaaccgtaaacttaacgttaccgttaccgttttaaccggttaccgggttaacccgtacggaaccgaggaaccgggtaccccggtaaccgggaccccgtaaccgggtacccccgtttcggtttaccggtttacggggtttacggttaaacgttttaaacgttaaaacggtttaacggttttaacgggtaacggtaacccggttaccccggtaacccgtaaccggggtaacccccggttagggtaaccgtaccggtttaaccgtttacccgtttccggttaccggtccgtacccggtaaccggtcccgttaaccgggaacccggggtaaaccgtaaacccggtaaccggttaacccgttaaacccgttaccggaacccgttaaccgttaccgggttaacgggtaccggggtaaccgggttaccccgggtaaccgggaaaccgggtaaccggggtaaccggtaaaccgggttaccgttaacggttaaacccggtttaaacggttttaaccggttaccggtttacccgtaaccggggttcccctaacggtaaccggtaaccggtaccggtaaaccggttaacgggtttaaccgggtaaccggttttaacggttttaaccgggttcggggttttaacccgggtttacccggggttacccggggttaaaccgggggg

SEQ ID NO: 125719 - DNA, 663 bp, Homo sapiens
  misc_feature: GYAE6OF02FQ48B.53.31.C09.1.454.CMB.1.raw
  modified_base (240)..(240): a, c, t, g, unknown or other
  misc_feature (240)..(240): n is a, c, g, or t
  modified_base (296)..(296): a, c, t, g, unknown or other
  misc_feature (296)..(296): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaanatatgcttactggtaccagcaggagccaggccacggcccctgtcttggtgatttanaagtcttgagacgccctgacgggacccctggacgcgtacttctcgtggcctccgagtcctcgaacgggacaacacgttaccaccgttgaaccctatcgtacggtcgggtacgtcccgggaccgaaggacggaacggacgggcgtacggtaaccgttaacgttacgttcgtaccgtacgtcccgacgaacggtaccgacggacgtaacgggttggtaccgttaaggttacgttacggttacgttaacgggttccgggtacgggacgggtaaccggttaacggaccgttaccggtaacccggttacccggttacggtacccgtaacggtaccccgaacgggtcccgttacccggtcccccgttacccgg

SEQ ID NO: 125720 - DNA, 670 bp, Homo sapiens
  misc_feature: GYAE6OF02I9SFV.53.31.C09.1.454.CMB.1.raw
  modified_base (277)..(277): a, c, t, g, unknown or other
  misc_feature (277)..(277): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
tcagcgcgtatacacacgaccggtgctcgatttagacgtctcatcaaggaaggaaggggtggtccaggaggcagaactctgggtgtctcaccatggcctggatccctctacttctccccctctcactctctgccacaggctctggacgcctcatgagcctagaccactacgtcctacccgtggtctacctgtcgtccacgagacacggaccgcagctccgcgtcgtactcgtggactagtcgactagtacgaaccaaatctgtctaccgtagcgacngaccgaggccgcgtacggcctccgttcttggttagtagattaagttacgagtttcgagccggacnccgtaagccgacgtnagcttacgtcncgtacncctcgtacgacgaacgacgtaaccncgttacaccgttacgactggtaaccgtcgtacggtaccgtacggaccggaggtaacggtaccgagttaccgtaacgttaccgttaacgttaccgtacggttaccgaccggtacgtacgcgtaacggcggtacgtacggtaacgtccgtttaggtacgtcgggttacgacgggttacgcgtaccggtacgtaccgacggttaccgtaccggtaaccgtcgcccggaaccgttccggacccgttcccgcccggttaccgttccgttaaccccg

SEQ ID NO: 125721 - DNA, 715 bp, Homo sapiens
  misc_feature: GYAE6OF02H3BAL.53.31.C09.1.454.CMB.1.raw
  modified_base (258)..(258): a, c, t, g, unknown or other
  misc_feature (258)..(258): n is a, c, g, or t
  modified_base (412)..(412): a, c, t, g, unknown or other
  misc_feature (412)..(412): n is a, c, g, or t
  modified_base (437)..(437): a, c, t, g, unknown or other
  misc_feature (437)..(437): n is a, c, g, or t
  modified_base (525)..(525): a, c, t, g, unknown or other
  misc_feature (525)..(525): n is a, c, g, or t
tcagcgcgtatacacacgaccggtgctcgatttagacgtctcatcaaggaaggaaggggtgggtccaggaggcagaactctgggtgtctcaccatggcctggactccctctacttcctcccctctcactctctgcacgaggcttctgacggccctcctagtgacgcgtgacacgtacgtacctacccgttcggttgttctggttcgttcctacgaacgggacgacggaccgggaccgaggtactccacgtcgcttcgnggacgtatgaccttagttaaccgaacaaaaactaagttctacgttaccgttaacgtacggtaacacggacaggacgacggacgccgaccggtccctagtcgttgtagttattaacgaagttacgttgacggtacgtccgtacggaccggtaccngacgtacgtattccgtcgtcgtccncgacgtcgacgaacggacaacgtcgtactaccgttacgacctagtacgtacgggtacggccggtccgaacggaacgggtacggacggngtaccgtatacgttacgttactcggtacgacgtcgaacgtagaaccggacgtccgagggtacgtacgttaacgttacgttcggttaaacgggttcgacgggtacggggtacgaaccgtcggtccgttaacgggttacccgtacggttaacgcgttaccggacccgtacggtccgtaccccggctacccgg

SEQ ID NO: 125722 - DNA, 777 bp, Homo sapiens
  misc_feature: GYAE6OF02JSV9A.53.31.C09.1.454.CMB.1.raw
  modified_base (184)..(184): a, c, t, g, unknown or other
  misc_feature (184)..(184): n is a, c, g, or t
  modified_base (271)..(271): a, c, t, g, unknown or other
  misc_feature (271)..(271): n is a, c, g, or t
  modified_base (637)..(637): a, c, t, g, unknown or other
  misc_feature (637)..(637): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctctcactctctgcacaggctctaggacggcctcctatgacgctgacacagtcacccctggtntctgtgtaccctcgaggaccaggaccggtccaggacttccacgtcgcttcgtgggaccgtatcgcctattccgaaccaaaaatactntacgtacttacgtacggtaccgacgtacgaggacggaccgacggacccgaccggtcccctggttcccgtttgggttagttaacttttaagtaaacggttaccgttttacgggaacggtacggtaccccgtccggtaacgggtaccccgttaggaccgtaccgttacgttcgttccgtacgggtccttccgaacgtcgttacggaaccggaacgaaccgtagtaccctaacgttaccgaccgtacgtacgtacgtacgggtacggtaccccggaaccgaacggaccggtaacgggtccggtacgttacgtaaccgttaacgttcggtacgtcggtaaccgtccgaccgacgtacgacggacgtacgngggtacgttaagttcgtcggttaccgtacggttaccggacgggtacggtaccgtacggttccggtacgtaaccgggttcccgtaacgggtacctaccgggtacccgtaacggtcccggttcccggtaaccccgttccggg

SEQ ID NO: 125723 - DNA, 849 bp, Homo sapiens
  misc_feature: GYAE6OF02GFMMW.53.31.C09.1.454.CMB.1.raw
  modified_base (225)..(225): a, c, t, g, unknown or other
  misc_feature (225)..(225): n is a, c, g, or t
tcagcgcgtatacacacgaccggtgctcgatttagacgtctcatcaaggaaggaagggcacgaccggtgctcgatttagacgtctcatcaaggaaggaagggggtggtccaggaggcagaactctgggtgtctcaccatggcctggatccctctacttctccccctctcactctctgcacaggctctgacggcctcctatgagctgacacagtccacccgtggtntctgtcgtcctcgagaccaggaccggcagactcacctgtctcgtggacatcgcattacgaaccaaaactatagtcgtaccttacgtacggtaacccgagaccgaaggaaccggccgtaacgggacccgtaacccgggtcccccgtttagttcggtttaaggtacgtttaaagtttaaacgttaaaaggttaccgttttagggaacggtaccggtcccgttaacgaaccggggtaacccctgggaccggtacgttaactttcccgtacgttcggtaccctaccgtacggtaccgtaccggtaaacgggaaccctaaacgtaccggttacccgtaaccgttaccgtaaccgtaccggttacgttaacgggtccgggtaaacccgggttacccggtaccgtaaagggggtacccgggtaaacgggtaaccgggtaccgtttaacgggtaaccccttttaaagtttaaccccggttacgggtttaccgtacccgggttaccccggaacgttaaaccgggtaacctaaccggggtaccgtaaaggggtttacccgtaaccggtttaacgggttttacggttacccgggtttaaccggtttaccgggtttacccggggtaaaccgggggg

SEQ ID NO: 125724 - DNA, 620 bp, Homo sapiens
  misc_feature: GYAE6OF02I9CEG.53.31.C09.1.454.CMB.1.raw
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
tcagcgcgtatacacacgaccggtgctcgatttagacgtctcatcaaggaaggaagggcacgaccggtgctcgattagacgtctcatcaaggaaggaagggggtggtccaggaggcagaactctgggtgtctcacatggcctggatccctctactctccccctcctcactctctgcacaggctctgacggcctcctatgagctgacacagtccacccctggtntcgtgtcgtcctcgaggacagaccggccaggatccacctgctactggcagnctagttacgaccaaaacaagtactgactttaacgnggtaaccagcaggacggccacggccncggcccctgtcttcggtatattaanaaacttcgttagacgacggtcccagtaccgggaccctgacggtcgtatttccgtcgtcggtaccctaccgagccctaggacgggtaacaaggcctacctccttacgaccacttacggagtcgggacgtcccggaccgagggaacggacgtcggaccgttgaacgttattccgtaggtcccacggttccgacgacggtaccaacggtcgaaggttcggtacttacgggtagttacggttccggtacggtcgggtaaccggg

SEQ ID NO: 125725 - DNA, 853 bp, Homo sapiens
  misc_feature: GYAE6OF02F6Q4W.53.31.C09.1.454.CMB.1.raw
  modified_base (154)..(154): a, c, t, g, unknown or other
  misc_feature (154)..(154): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctntacttctccccctcctcactctctgcacaggctctgacgcctctatgagctgacacagtccacccgtgtgtcttgtcgtccctacgaggactaggacccgggaccagggtactaccaccctgtccgtcgttcgggcgtaacgttcggacctagtttacgaacccctaaaaaacctaaagttaacttacgtaccgttttaaccggttaccgggttaacccgaacgtaccggaacgggaaccgggtacccggacggggaccccgtaaccgggttccccccgttcggttacggtttacgggttacgtttaattttaaacggttaaaacgttacgtttttagggaaacgttaccgggaccccgtaccggtaaccgggtacccccgtacgggtacggtaccgtaactttccggtccgttcgggtacccttacccggacgtccgttaccggaaacgggtaacctaacgttaccgtacccgtaacccgttaccgaccttacgtacccgtagggttaccggaaccggttccggggaacccaacggggtaacggaaccgggtacggtacccgttaacggttaaaccgttaacgtttaacgttccggttaccggtacccggttccgacggaaaccggtaccggagaccgttagggttaccggacggttacgtttaggttacgtaccgggttacgtaccggggtacgggg

SEQ ID NO: 125726 - DNA, 616 bp, Homo sapiens
  misc_feature: GYAE6OF02GJP6S.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttacgtggtaccagcagaggccaggccacggcccctgtcgttggtagtattttaataaagtacgttttggaaggaggccctacgaacgggcccctagacgcgtattctcgtggctccagtcgtacgaggacaacgacgtcgtaccttgaccacgtacgaggtcggtacggtccggacctaagggacggacgacggctgtaacttatttacgtgttaccaggtaccgacagacgagcgtacggtggacttagttgtggttacgttacgtcggggtacggggaacggtaccgtacggtaccgtacgggtacccgttaccggttaacggttcaccggtaccccgtaaggccgtcccggcccccggttacccg

SEQ ID NO: 125727 - DNA, 693 bp, Homo sapiens
  misc_feature: GYAE6OF02F80CQ.53.31.C09.1.454.CMB.1.raw
  modified_base (181)..(181): a, c, t, g, unknown or other
  misc_feature (181)..(181): n is a, c, g, or t
  modified_base (243)..(243): a, c, t, g, unknown or other
  misc_feature (243)..(243): n is a, c, g, or t
  modified_base (314)..(314): a, c, t, g, unknown or other
  misc_feature (314)..(314): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcacccctggtntctgtcgtcctcaggacagacggccaggatcacctgctctggcatgcattcgacccaaaaanattatgacttactggtaccagcaggacggccaggtcccacgggtccccctgttcgttggtagtattttaanaaagtactttaggagacggccctagaccggggtacccctaggacgcgtacttcgtacgtcgggccttccgagtcctacggacgggaacaacgacgttccaccgttacgaccctagtacgaggtcggtaccggtacccggaccgtaaggaaccggtacggaggtcctagtactttaacgtacgtcgtaccgtaacgtccggaactaccgaacgacggaccgtaggtcggaccttaggttactcggttacgtttacgggtaccgggtacgggaacgggtaccgtaccggtccgttaaccgggtaccccgtttccggttaaccggttcccgaaccggttaccccgtaacggtcccgttaccccggcccccggtttaacccgg

SEQ ID NO: 125728 - DNA, 925 bp, Homo sapiens
  misc_feature: GYAE6OF02JNGDW.53.31.C09.1.454.CMB.1.raw
  modified_base (186)..(186): a, c, t, g, unknown or other
  misc_feature (186)..(186): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgagcctctatgagctgacacagtccaccctcggtgtctgtntcctcaggcagcgccaggactcactgctcgtggcgatcgctattcgaaccaaaacatagtcgtacttacgtacggtaaccgacggcgtaacggaccggacccgtacggggaccccacccggggttcccccgttaggtttcccggttttgggttaacgttttaaagttttaaaacgttaaaacgggttaccctttttagggaaaccgggtccggttacccccgtaaccgggtaaccccggggtaacccccggttaggtaaccgggtaccgttaaccgtttacccgtttaccgggttaccggggttaccccttacccgggaaacgttcccgttacccggggaaaacgggggtaaacccttaaaccggttaacccggttaacccgtaaccccggttttaccgaaaccctttacgggtaaccgttaaggggtttaccggaacccggggttaccccgggtaaccggaacgggtaacggggacccgggtaacggtacgttaaaccggtacccgtttaaatttacccgggtcgggtttacccacgggttcccccggaaagtaacgggtacgaaaccggtcgttaccgggtacggtaccgtttaaggtttcgttaccggttaacgggtttaccggttaccggggacgggttacgggaccgtttacggacggtacccggtacccggtttacgtacggttacccggaccggtacccgacgggtccccttaccccggtaccccttccggg

SEQ ID NO: 125729 - DNA, 638 bp, Homo sapiens
  misc_feature: GYAE6OF02FF9JT.53.31.C09.1.454.CMB.1.raw
  modified_base (249)..(249): a, c, t, g, unknown or other
  misc_feature (249)..(249): n is a, c, g, or t
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctccgtatgagctgacacagtcccctaaaacggtgtctgtgtcctcaggacagacggccaggatcacctgctctggcgatgcattgaccaaaacatatncttacgtcgtacagacgacgacggcgacggccgaccggtccctgttcgttggtatatttaagtaacgtacgttagacgtacgaccgtacgaccgggaccctaggacgtcgtacgttcgtcgtcgctccgacgtcgtacggacggaaccaacgtacgtacctaccgttacgacctacgtacgtacggtacggaccggtaccggacgaggaacgggacggaggtactacgtaacttacgttacgttcgtaccgtacgtccgacgacgacgacgtacgtaggtacgtagttagtacgttcgtacggtacgtcgggacggacggtacgtacggcgtaccggtaccgtacgtacggtaccgacggacccgtacggtccctacccgtacccgtcg

SEQ ID NO: 125730 - DNA, 643 bp, Homo sapiens
  misc_feature: GYAE6OF02IAE75.53.31.C09.1.454.CMB.1.raw
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
tcagcgcgtatacacacgaccggtgctcgatttagacgtctcatcaaggaaggaaggggtgggtccaggaggcagaactctgggtgtctcacatggcctggatccctctacttctccccctcctcactctctcgcacagcctcgtgacggcctcctatggacgctgacacagtccnccgtggtctctgtcgtccncaggacagacgccgaggactcactgctgngngangaactgtacgaacctaaaanattatcgtnttacttcggaacncgagacgacggaccacggacctacgtcccctaggtcgttgagtactttaanaaacgttctttagaggtccgtacctcgaccggacccngacggctacttcgcgtancgtaccgngtaccgtcgaaacgggacaaacgttacgaccggtaccttagacctacttacgagttacggacgtaccggacgtacggacgacgggtacgacgttacgaacgttacgtaacgtgttaccgacgttccgacgagacgtaacgacgacgtagtcttaagtcggttacgtacgtagttaccggagggttaacgcgtaacgtaacggtccgtaacgtaccgttacgacaccggtaccaaccggtcgtaccccgtccgtacccg

SEQ ID NO: 125731 - DNA, 761 bp, Homo sapiens
  misc_feature: GYAE6OF02JPBOJ.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggtcctcctatgagctgacacagtcaccctggtgtctgttgtcctcgaggacacggaccgccgaggactccacctgctacgtggacgatcgactattacgaacccaaaaatacttagtcgtacctttacgtaccggtaccgaacgacgacggaacggccgaccggacccgaccggtccccgttacggtttccgttagggttacgtaagtttttaacgtaaaacggttacttttacggaacggccggtacccgttaccggaccgggtaacccccgttaggtaccggtaaccttacggttccgttaacgtccgggttacctaccgtacgtacccggtacgacgggtaacctaaccgacgtcctaccgtacgtacctacgtaccgaggtcggtaccgtcccggaacgacggacggtacggtaccgtacgtacgaacgtttactttaacggccgtacgtacggtcccaacgacggtaacggtacaccggtaggttacggccgtttaagttacggcgttaacggttacgtcggggaccgggtacgtacggtccgtaccggtaggtaacccgttaccggagtaccgaccgtaccgacccggtacgtcccgacccgttacg

SEQ ID NO: 125732 - DNA, 703 bp, Homo sapiens
  misc_feature: GYAE6OF02INS9F.53.31.C09.1.454.CMB.1.raw
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
tcagcgcgtatacacacgaccggtgctcgatttagacgtctcatcaaggaaggaagggcacgaccggtgctcgatttagacgtctcatcaaggaaggaaggggtgggtccaggaggcagaactctgggtgtctcaccatggcctggactccctctacttcctccccctctcactctctgcacaggctctgacgcctctatcganctgacactagtccaccgtcggtnttcgtgtctcctcgaacggacaggtacggccaaggactcactgctcgtcggcgatcgactacgttcgaaccaaaagtatagtacgtacgtttaacgtacggtaccaaggtacgaacggtacgggaccaacggtacccgaccgggtaccccgttggttcgtttacggtacttaaacgtttaaacgttaaacgttacgttttcggaacggtccgggtaccgttaacggaacccggggttaccctaggacgtaccgtttaacgttcgttaccggttcgtaaccgtccgaacgtccgtaaggtaaccggaactaaccgtacgtaccctaacggttcgacctatcggacggtacgggacggtcccgaacgaggtacgggacgtacggtcgtagtaacgtattacgtggttacaccggtacgtcgtaagacgtcggtacgacgtagtacgtacttacggtcgttacggtcgttacgggacgg

SEQ ID NO: 125733 - DNA, 793 bp, Homo sapiens
  misc_feature: GYAE6OF02GF4XX.53.31.C09.1.454.CMB.1.raw
  modified_base (137)..(137): a, c, t, g, unknown or other
  misc_feature (137)..(137): n is a, c, g, or t
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
tcagcgcgtatacacacgaccggtgctcgatttagacgtctcatcaaggaaggaagggggtgggtccaggaggcagaactctgggtgtctcacatggcctggatccctctacttctccccctctcactctctgcacnggctctggacgcctctatgagctgacactagtccacccgtggtctctggtctcctcgaggacaggccgcagcttaccgccgttncctgtacgggactatcgctagtcgaaaccaaaatagtgtcgtacttacgnggtaccagaccgaagccggaccgacggacccncggtcccttgttacgtttggtacttaatttaacgtaaacgttacgtttgaacggtccgtacccgttaggacccgggtacccgttagggacgttaccggttaacttccgttaccggtccggtaccgttacccgaaggtccccttaagggaaaccggtaaccaacgttaccgtaccgtacccgttaacggacccttacgttacggtacggtaccggtacggaccccgggtaactaggggaacccgggtttacgcgggtaccgttactacgggttttaatacccggttacgtacccgttaaccgggttacgtccggaaaacgtccgaacgggtcgtaacgggcgttaccttagggtttccgttaacgttaccgttaacgggtccggggtacggtaccggtaaccgtttccgggaccgttacccgggtaacgttcccggtaaccggtaccgaccgtaaaccggcggttccccggtacccgtcccggttacccgg

SEQ ID NO: 125734 - DNA, 848 bp, Homo sapiens
  misc_feature: GYAE6OF02JSX2F.53.31.C09.1.454.CMB.1.raw
  modified_base (176)..(176): a, c, t, g, unknown or other
  misc_feature (176)..(176): n is a, c, g, or t
  modified_base (230)..(230): a, c, t, g, unknown or other
  misc_feature (230)..(230): n is a, c, g, or t
tcagcgcgtatacacacgaccggtgctcgatttagacgtctcatcaaggaaggaagggggtgggtccaggaggcagaactctgggtgtctcaccatggcctggatccctctacttcctccccctctcactctctgacacaggctctgacgcctcctatgagtctagactcagtccnccgtggtgtctgtacgtcctagaggacaggtaccggcaaggtactccgacgtcnccttcggtggacgtaacttcggaccttagttaccggaaacctaaaaaagtcttattacggtacctttaacggttacgaacccgtaaggtaccgtaacggtaaaccgggccccgtaacgggtaccccgttaaccgggtcccccgtttaggttaccggttaacgggttacggttaactttaaaaccggtaaacgttacgtttaacggaacggtacccggtacccgttaacggaaccgggtaccccgttaggaaccggtcgtaagttcccgttaggccgtctaccgacgtcgtaacggacggaaactacgtctaccgtacggttacacgtacgtcgtaaggacggtaaccgccggtaacgtaacggacggtaaccgtacgtacgtacgtaaccttaacgttacgtaccggtaccgtaacggtccaaacggttcgaaacggttcaacgggtacgttaacggtactttaacggttacgttacggttagtttaaccgggtccggtaacgggttaaccggttccggtaacccgtttacgggttacccggtaaaccgttccgttaaaccggaccgttaacccgtacgggaaccccgttccggttaaccccgtttcccgtaaccggg

SEQ ID NO: 125735 - DNA, 634 bp, Homo sapiens
  misc_feature: GYAE6OF02GTRQ9.53.31.C09.1.454.CMB.1.raw
  modified_base (226)..(226): a, c, t, g, unknown or other
  misc_feature (226)..(226): n is a, c, g, or t
  modified_base (323)..(323): a, c, t, g, unknown or other
  misc_feature (323)..(323): n is a, c, g, or t
  modified_base (589)..(589): a, c, t, g, unknown or other
  misc_feature (589)..(589): n is a, c, g, or t
tcagcgcgtatacacacgaccggtgctcgatttagacgtctcatcaaggaaggaagggcacgaccggtgctcgatttagacgtctcatcaaggaaggaagggggtgggtccaggaggcagaactctgggtgtctcaccatggcctggatccctctacttctccccctcctcactctctgcacaggctctggaggcctcctatgagctgacacagtccaccctggtntctgtcgtcctcgaggacaggaccggccaggactccaccgtgcttcgtggcgtatgctattcgaaccaaaacaattatgtaccttacgcggtaaccngcgaggacggccgacggccacggtccccttgttcgttgggtagttaactttaaacgtaaagttcgtttaggaggtaaccggtccctacggaccgggtaccctggacgtcgtacttccgtcgtcggcctccgagtccgacgacgggaacctacgacgtcctaccgtcgaactcgtcgaggtcggacgtacccggccgaagggacggacgaggtactacgtaacgttacgtacgtcgactcggtccagtaacgacgacgacgttacgnggtaaccttggtaacgttcggtaccgtttagggtacggaccgggg

SEQ ID NO: 125736 - DNA, 901 bp, Homo sapiens
  misc_feature: GYAE6OF02I724T.53.31.C09.1.454.CMB.1.raw
tcagcgcgtatacacacgaccggtgctcgatttagacgtctcatcaaggaaggaagggcacgaccggtgctcgatttagacgtctcatcaaggaaggaaggggtggtccaggaggcagaactctgggtgtctcacatggcctggactccctctacttcctccccctctcactctctcgcacgaggctctacggaggccttcctagtgacgactgaacactacgttaccaacccgttggttacgttccgttggttaccgtccctagaacgggtacaacgggtaccggaccgaaggtactaccgtaaccgttcggaccgtccggtacggtaccgaacggttacggaccttaaacgttaccggaaaaaccctaaaaaaccggtaacgtttaagtaccgttaaccgtttaaccggtaccggggtaaacctaccggtaacgaacgggtaaccgggaacccgtaaccgggacccggttaaccccgggtccccgtttggtttaccggttgggtttaacgttaaacgtttttaaacggtaaaacggtttaaccgtttacgggaacccggttacgggtacccccgttaaacggggaacccgttacccccggttaagggaaacccgttaccgttaagtttcccggtttaccgtaccggtacccttacggaaccggttaccgaaccgggtaaacggtaaaccttaaaacggtaccgttaacccgtaaaccgtttacgaaccctaacggttacggttaaggttacccgggaccggttaaccggtaccgaagggtaacggacgtacggttctaacgtacgttaacgtacgtacgtacgaccgtaccgacgaacgcgtaacggaacgttggaacgtacgttattcccggttagtacgttacgggtaccggacggg

SEQ ID NO: 125737 - DNA, 795 bp, Homo sapiens
  misc_feature: GYAE6OF02IQJ08.53.31.C09.1.454.CMB.1.raw
  modified_base (128)..(128): a, c, t, g, unknown or other
  misc_feature (128)..(128): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
tcagcgcgtatacacacgaccggtgctcgatttagacgtctcatcaaggaaggaagggcacgaccggtgctcgatttagacgtctcatcaaggaaggaggggtggtccaggaggcagaactctgggtntctcaccatcggcctggactccctctacttcctccccctctcactctctgcacaggctcgtgacgcctctatganctgacacagtccaccgtcggtntctgtctcctgaggacaggacggcaaggctccacgtcgctcgtcggctagtcgactacgttacgaacctaaaactatacgtcgttaccgtttacgtaccggtaaccgacggacgtaacgggaccggtaccgtacccggtacccggtacccggtccccgttacggttaccggtttacggttaacgttaacgtttaaacgtaaacggttccgtttaggacggtaccggtacccgtaacggaaccgggtacccgtaggtaccggtaccgttacgttccgttaccggtaccggtacccgtaccgtacgtccggtaaccggaacggtaacctaaccgtaccgttaccgtaccgttaccgaaccgttacgtacgtacgggtccggtaccgggtacccggaccggtaacgggacgggaaccggtacggttaccgtaacggttaacctttacggttaaccgtcgttaacccgtacggtacccgtaacggtaaccggaacgtaccggtacggtaacggtacggtacggttacggtttacggtacgggtttaacccggttacgggtaccgggtaaccggg

SEQ ID NO: 125738 - DNA, 795 bp, Homo sapiens
  misc_feature: GYAE6OF02GVFVG.53.31.C09.1.454.CMB.1.raw
tcagcgcgtatacacacgaccggtgctcgatttagacgtctcatcaaggaaggaagggggtgggtccaggaggcagaactctgggtgtctcaccatggcctggatccctctacttctccccctcctcactctctgcacaggctctggacggtcctctatgacgctgaccacagtccacccgtggtgtccgtgttacgtcctacgacggacacgggaccggaccgaggactccgaccgttcgtacctcgtcggacgtatcgactagttaccgaaaccgaaaatactagtctactttacgtacgtaaccgagacgaacggaccggaccgaccggccggacccgtccgttggttacggttacggtagttaacgtttaagtaacgtaggtttacggacggtccgtacccgtacgggaccggtacccgtgaacgtcgtacttccgtcgtacgtcctaccgacgtccgtaacggaccggtaaactacgtaaccttccgtaacccgtacgaccgtagtacgtacggtacggtccgtacccggacgacggaccggacggtacgtaccgttacgtaacgtttaacgttacgttcggtaccgtccggtaccgacggtaacgaccggttacgacggttaagtcggttaacgttacggggtttaacgtccggtttaacgggttccgggtttaccggggaccgggtttaacggtaccggtaacgggttcccgtaaccgggttaacgttacccggtcggtaacccggcgtaacccggttaccgtccccggttcccggtcccggtacccg

SEQ ID NO: 125739 - DNA, 516 bp, Homo sapiens
  misc_feature: GYAE6OF01DZXC9.52.76.G10.1.454.CMB.1.raw
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaatacccggcaaagtcccaaactcatgatctttgaggtcagtgatcggcccgcaggggtttctcgatcgcttctccggctccaagtctggcagcacggcctccctgaccatctctgggctccaggctgaggacgaggctggattattactgcagctcatacacaaacagaaacacgttgggtgttcggcggcgggaccaaacgtgaccgtctacgtcagcccaaggctcgcccctggtcactctgtccctaccc

SEQ ID NO: 125740 - DNA, 525 bp, Homo sapiens
  misc_feature: GYAE6OF01EV9DS.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaatacccggcaaagtccccaaactcatgatctttgaggtcagtgatcggcccgcaggggtttctcatcgcttctccggctccaagtctggcagcacggcctccctgaccatctcgtgggcctccgaggctggaggacgaggctgattattactgcagctcatacaacaaacagaaacacgttgggtgttcgggcggcggaccaaactggaccgtcctacgtcacgcccaaggcctcgccccctcggtccacctctcccg

SEQ ID NO: 125741 - DNA, 545 bp, Homo sapiens
  misc_feature: GYAE6OF01CZZOO.52.76.G10.1.454.CMB.1.raw
  modified_base (413)..(413): a, c, t, g, unknown or other
  misc_feature (413)..(413): n is a, c, g, or t
  modified_base (530)..(530): a, c, t, g, unknown or other
  misc_feature (530)..(530): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaatacccggcaaagtccccaaactcatgatctttgagtcagtgatcggccgcagggttctcatcgcttctccggctcaagtctgcagcacggcctcctgaccatctctgggcctccgaggctggacggacggaggctgattattacngcagctcatacaacaaacagaacacgttgggtacgttcggccggacgggaaccaaaccgtggaacccgtccgtaccgtacacgccccgtaaaggcccgtccgcccccctagggtccnccgtccgttaccccg

SEQ ID NO: 125742 - DNA, 540 bp, Homo sapiens
  misc_feature: GYAE6OF01C3ND6.52.76.G10.1.454.CMB.1.raw
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttatactctgtctcctggtaccaacaactaccccggcaaagtccccaaactcatgatctttgaggtcagtgatcggccgcgaggggtttctcatcggcttctccggctccaagtctggcagcacggcctccctgaccatctctgggctccaggctggacggacgaggctgtattattactgcagctacatacaactaaacaacgaaactcgttagggtgttacggcggtcggaccaaacgtcgaccgtctaccgtcacgccaacggctaccgcccctcggtaccactcctcgttccctaccccg

SEQ ID NO: 125743 - DNA, 544 bp, Homo sapiens
  misc_feature: GYAE6OF01BVD40.52.76.G10.1.454.CMB.1.raw
  modified_base (339)..(339): a, c, t, g, unknown or other
  misc_feature (339)..(339): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaatacccggcaaagtccccaaactcatgatctttgagtcagtgatcggcccgcaggggtttctcatcgcttcnccggctccaagtctgcagcacggcctcctgaccatctcgtgggcctccaggctgacggacgaggctgtattactactgacagctacataacaacaaacagaaacctacgtttgggtggttcggcggacgggaaccctaaacgtcggacccgttccgtacgtcgacgacccaaggcctccgccccctggtccaccgtcgttacccg

SEQ ID NO: 125744 - DNA, 674 bp, Homo sapiens
  misc_feature: GYAE6OF01ED5A1.52.76.G10.1.454.CMB.1.raw
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgacttatactctgtctctggtaccaacaactacccggacaaacgtcccaaatcatgatctttgagtcagtgatcggcccgtcgtaggggtttctcatccgtcttcgtccggctccaagtctggcagcacggcctccctgaccatcctcgtcggcctccgacggcgtaggacggacgagggtacctaggtaatttacgtttaaccgtgaccgacggtaccttacaacgttaacccaaacgaaaacctaacggtaaaacctacgggtttacggggttcgggtttaccgggccggggtaacccggggtaacctaaaaccgtcggtaaaccccgttacccgttaaccggtaccgtaacggtacccccggtaaagggccccgttacccggacccccccgttcgggtacccttacccgttcgttccccgttcccccgttaaccccccg

SEQ ID NO: 125745 - DNA, 611 bp, Homo sapiens
  misc_feature: GYAE6OF01ECLMU.52.76.G10.1.454.CMB.1.raw
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctcgggctccgaggctgaggacgaggctgattattactgcagctcactacaacaaacaagaaaccgtacgtttacggggtgttccgggacgggaccggggaaccgtaaaaccgtcggtaaccccggtacccgttaccggtccgtaccggaccccgaaacgggtcccgttcccggcccccccgttccggtacccgtacccgtttacccgttcccggttcccccggttaccccccg

SEQ ID NO: 125746 - DNA, 549 bp, Homo sapiens
  misc_feature: GYAE6OF01D3N3M.52.76.G10.1.454.CMB.1.raw
  modified_base (339)..(339): a, c, t, g, unknown or other
  misc_feature (339)..(339): n is a, c, g, or t
  modified_base (388)..(388): a, c, t, g, unknown or other
  misc_feature (388)..(388): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactacccggcaaacgtccccaaactcatgatcttgaggtcagtgactcggccgcagggttctcatcgcttcnccggctcagtctggcagcacggcctccctgaccatctcgtgggcctcgnggctggacggacgaggctgatttactacgtgcagctacgactaaccaacaaaacaagaaactcgttgggtgttccgggcggaccgggaaccaaacgtcgacccgttccgtacgtccacgaccctaaggccctcgaccccctcggtccaccgttcttacccg

SEQ ID NO: 125747 - DNA, 533 bp, Homo sapiens
  misc_feature: GYAE6OF01BFLQ2.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaatacccggcaaagtccccaaactcatgatctttgagtcagtgatcggcccgcaggggtttctcatcgcttctccggctccaagtctggcagcacggcctcctgaccatctctgggctccaggctgacggacgagcctgattatacgtgcagctacatacacaaacagaaactacgttgggtgttcggcggacggacctaaacgtcggtacccgtcgtacgtacacgacccgaaggcctacgcccctacggtccaccgtcgtacccg

SEQ ID NO: 125748 - DNA, 597 bp, Homo sapiens
  misc_feature: GYAE6OF01BC5P5.52.76.G10.1.454.CMB.1.raw
  modified_base (221)..(221): a, c, t, g, unknown or other
  misc_feature (221)..(221): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttatactctgtctcctgtaccaacaactacccggcaaacgtccccaaactcatgatctttgaggtcagtgagtccggcccgcgtaggggtttctctactcgtccttcgtccggcctccgaacgtctaggcagccgaccggtccctccctcgacctactccgttcgtcgggcctccgaggtccgtaggacgggtacggacggtcgtcgtattattacgtgcctagcctacactaacaacaaacgacgaaactacgttgggtcgttcgggcggacggaaccaacgtcgtacccgtaccgtacgtcgacgacccgacggtccgtccgccccgttcgtactacctccgttcccgtccccgtcccc

SEQ ID NO: 125749 - DNA, 824 bp, Homo sapiens
  misc_feature: GYAE6OF01BAUPM.52.76.G10.1.454.CMB.1.raw
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactaccccggcaaacgtaccccaaactcatgattctttgagtcagtgactccggcccgtcgtaggggtttctctacgtcgtccttccgtccgggtccttcccgtaacggttcgttacgggcgtacggtccgaacccgggtccccttcccccgtacggaacccctacgttcccgttaccggttccgggggtcccttacccgtaacggggtccgttacggggaacggggaaccggtaaccggggtacgttaggtaacgttttaacgttaccgttcggtaccctaacggtaccctttaccgttaactttttaacccgaaacggtaccctaacccccgtaaccctaacccgtttacccgttacggtttaaacccgtttcccggtttaaccgggggtccccggggtaaacgggggtaacccctaaaacgggtacccggttcccgggttaaacccccggttccccgggttaaacgggttccccgaacccgggtaacccccggaacgggttccccgttacccccggtcccccccgtttaccgggttccccgtaacccgtttcccccg

SEQ ID NO: 125750 - DNA, 912 bp, Homo sapiens
  misc_feature: GYAE6OF01C6HMT.52.76.G10.1.454.CMB.1.raw
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactgaaccngcaatgacgttgtacttatactctgtctccgtgtaccaanaactacccgacaaacgtacccaactcatgtattctttagaggtcgagtacgacgtccggccgtcggtaacgggtttccctacgtacgttccgtccgtttccgtccccgggtaccttacccgtaacggttcccggttacgggtacctaaccggacccccgtaacccgggggttccccccttaccccccggtaaggtaacccccgtacgtttcccggtttcccgggtccggggtcccccgttaacccggacgggtaccggttacggggaaccgggtaaccgggttaacggaccgtttaggttaacgttttttaaaccgttaaccggtcggtaacccgtacggtacccttaaccctaaacgttaaaacccgtaaaccgtaaaaacccgtaacgggttaaaaaccccggtttcggggtttttacggggggtttacccggggtttacccgggggaaccccgggggttaaaccccggggtaaaaccccgtaaaacccgggttccgggttaacccccccggtttaacccgttacccggggtaaccccggttaaacccgggacccccgggtaaaccgggtccccccgttaccccggttacccccccggtaccggtttaaccccttaccccggttccccgttttaaccccccccggg

SEQ ID NO: 125751 - DNA, 640 bp, Homo sapiens
  misc_feature: GYAE6OF01ERF9B.52.76.G10.1.454.CMB.1.raw
  modified_base (380)..(380): a, c, t, g, unknown or other
  misc_feature (380)..(380): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccaccggaaccagcaatgacattggtacttataattctgtctcctgtaccaacaactacccggacaaacgtccccaaatcatgattctttggaggtcagtgacgtccggcccgcgtaggggtttctcatcgcttcgccggctccgaagtctgcagcaccgcctccgngaccactctcgtcggtcctccgaggtcgtaggacgggacgaggtcctagtactttattacgtgctacgtctactaataactaaccgaacgaccgtaaacgaaaccgttacggttacggggtcggttaccgggaccgggtacccggtaaacccgtaaaccgttcggtaaccccgttacccgtaccggtaccgaaccggtaccccgtaaacgggtccccgttacccggtaccccccgttcggtacccgtcccgttaccccgg

SEQ ID NO: 125752 - DNA, 774 bp, Homo sapiens
  misc_feature: GYAE6OF01AML73.52.76.G10.1.454.CMB.1.raw
  modified_base (198)..(198): a, c, t, g, unknown or other
  misc_feature (198)..(198): n is a, c, g, or t
  modified_base (331)..(331): a, c, t, g, unknown or other
  misc_feature (331)..(331): n is a, c, g, or t
tcagcgcagtacgacacgaccggtgctcgatttagtcactcatacagggggctgggggtctcaggtggcagcgctctcgggacgtctccaccatggcctgggctctgctattcctcaccctcctcactcagggcacagggtcctgggcccagtctgccctgactcagcctgcctccgtgtcgtgggtctccgtggacngtcgatcaccatcctcctgacacgtcggaaccagcaagtgtacgttgtacttatactctcgtctccgtcgtaccaacaccgtacccggactaaaccgtacccctaaactcatcgtacttcgtttaggacggtnacggtagacgtcccgggccgtcgggtacggggtttcctacgtacgtccggttccttaccgtcccggtacgtaccgtaacgtcgacggctacggacctcccggccctccgtacgaccctacgttccgtccgtcggcccgttaccggacggtacgtacgggaacgggaccggtacggtctacgttaaccgtttacgttaccgtcgaccgtactcccgttaacctaacgtaaccctaaaaccaaaccggtaaaccgtaaaccggttacggggttaccgggttacgggtaccgggtaccggggtaacccggtaaacccgttaccgggtaccccggtacccgttaacccggtaccgtaaccggcccggacccgtaaccgggttccccgtaacccgggtaccccccggttaccgggttaccctacccgtttccccgggttaaccccccg

SEQ ID NO: 125753 - DNA, 705 bp, Homo sapiens
  misc_feature: GYAE6OF01B7ESH.52.76.G10.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacngtcgatcaccatctcctgcactaggaaccngacaatgacgttgtactatactntgtctctacgtaaccaacaactacccgganaaccgtcccaactcatntatcgtttgacgtcagtgacgtccggaccgtgtagggttctctacgtccgtctcgtccggactcgtaacgtctacggcacgtccgaccggtccctacccgtacgtaaccctcgttccgtacggtccgggtcccgttaccgggaccgggacgttacgggaacgggacccggtacggttaaccgttagttaaacggttttaaccttacggtacgtaacgtaccggtctttaaacccaacgtaaaccgtaacctaaaacggactaaaaccgtcggtttacggggtacggtcccgggacgggacggtaaacccgtaagtccggtacccgtaccgtacgtacgacccggtaaccgtccggtcccgtaccggcccccggttcgtacccgtacctttcccgtaccgttccccttaccccg

SEQ ID NO: 125754 - DNA, 562 bp, Homo sapiens
  misc_feature: GYAE6OF01B07VS.52.76.G10.1.454.CMB.1.raw
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccagcaatgacgttggtacttataactctgtctcctggtaccaacaactacccggcaaagtccccaaatcatgatcttgagtcagtgatcggccncgagggtttcncatcgtctctccgctcagtcngcagcgacgcctcctcgaccatcctcgtcgggtacctccgaggtctaggacggaccggaggcttagtactttagtacctgcacgtctacgactaccaacaaacgaagtaaactacggttggtggttacggcggacgggtaccaacgtcgtaccgtcctacgacacgcccgaacgcctacccggccccttccggtactccgttccgttaccccg

SEQ ID NO: 125755 - DNA, 678 bp, Homo sapiens
  misc_feature: GYAE6OF01A8PZB.52.76.G10.1.454.CMB.1.raw
  modified_base (221)..(221): a, c, t, g, unknown or other
  misc_feature (221)..(221): n is a, c, g, or t
  modified_base (516)..(516): a, c, t, g, unknown or other
  misc_feature (516)..(516): n is a, c, g, or t
tcagcgcagtacgacacgaccggtgctcgatttagtcactcatacagggggggggtctcaggaggcagcgctctcgggacgtctccaccatggcctgggctctgctattcctcaccctcctcactcagggcacgagggtcctcgggcccagtctgccctgactcagcctgcctcgtgtctgggtctctggacagtcgatcacatctcctgcactggaaccngacaatcgtacggttagtacttaataacttctgtcctccgtacggtaaccaacaaccgtaccccggacaaaccgtaccccaaactctagtacgtacttcgtttaggacggtacaggtcgacgttccggcccgtacggttacgggtttctacgtacgtccgtcttccgccggtacctacgtacgtcgtggactacgccgaccgtccctccgtacgacctacgtcgtcgtcggcccttaccggtacggtcgtacgggacggaccggaggtacttaggttaactttaacgtttaccgnggtaccacggttacctaccgtaactaaccgtaaacaaacgtaacgtaactcggggttacgggtcgtacgggaccgggtacgtaaccaacgtccgaccttccgtaacgccgacgtaccgtacgcctcccgacccgtcggactaccgtctcccgtccgtacccg

SEQ ID NO: 125756 - DNA, 918 bp, Homo sapiens
  misc_feature: GYAE6OF01BY2GX.52.76.G10.1.454.CMB.1.raw
  modified_base (202)..(202): a, c, t, g, unknown or other
  misc_feature (202)..(202): n is a, c, g, or t
tcagcgcagtacgacacgaccggtgctcgatttagtcactcatacagggggctgggggtctcaggaggcagcgctctcgggacgtctccaccatggcctgggctctgctattcctcaccctcctcactcgagggcacgagggtcctcgggcccagtctcgccctgactcagcctgcctccgtgtcgtgggtcctcgtggacngtcgactccacctatcctccgtcgcctacgtacgggaaccagaccaagtcggtacggtttaggtacttactaacttcttgtcctccgtacggtaaccaactaacccgtacccggacctaaaccgtacccccaaactcgactacgtacgttacgtttacggaacggttcgtaacggttacgtaccggttaccccgggcccggtaccgggtacggggttttacctaccgtaccgttacggtcccgtttcccggtccccggtaccgttaacccgtaacggttccgtacgggtccgtaacggcccgtaaccccgggtccccgtaccccgttacccgtaaccgtacccgttccgttaccggtccgggtacccggtaccgtaccggggtacgtacgggtaaccgggtaccggtacgggttacgtacgggtttaaccttaacggttacgtttacccggacgtaaccgttccgtaaccgttaaccaaacccgtaaacctaaaaccggtaaacggttaaacccggttacgggtttaacggggtttacccggggtaccgggtacccgggggtaaccgggttaaacccccggtaaaccttaacccgggtaacccgttacccggttaacccgttaaaccgggccccggtaaccccggtaccgggtaaccccgttcccccgggtacccgttaccccggtcccttaacccggtcccgtttacccccccgg

SEQ ID NO: 125757 - DNA, 739 bp, Homo sapiens
  misc_feature: GYAE6OF01EB6F0.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgccactcggaaccagacaatgacgttggtaacttataactctcgtctccgtaggtaaccaacaacgtacccggacaaacgtccccaaactcatcgtattcgtttaggagtcaggtcgacgtccggaccgtcggtacgggtttctacgtagtccgtccttccgtccggactaccgaagtccgtacggactacgccgtacccggtccctccgtacgaccgtacgttccgttccggtcgggtcccttaccggaggtaccgttagggaacgggtaccgggaacggtacttacgggttaacttttacgttaaccgtgaccgtacgtacctaacctaacgaaaccgtaaccaaaaacgtaaccgtaaaccgttacgggtttcgggggttaccgttaccgggggaccggtaacccggggaaacctaaaccggtaccggttaccccgtaaccgttacgtccggtaaacccgacccggtaaccggtcccgtacccggtaccccccgttacggttaccctcccgttccgtaccccccg

SEQ ID NO: 125758 - DNA, 765 bp, Homo sapiens
  misc_feature: GYAE6OF01AWVUW.52.76.G10.1.454.CMB.1.raw
tcagcgcagtacgacacgaccggtgctcgatttagtcactcatacagggggctgggggtctcaggaggcagcgctctcgggacgtctccaccatggcctgggctctgctacttcctcaccctctcactcgagggcacgacgggtccgtcgggcccagtctcggccctagacctcacgcctgcctcgtgtcgtgggtctcgtggacagtcgactccacctactcctcctcgcacgtacggaaccagacgtaagtacgtacggttacgttaccttaacttactcgttcgtccttccgtacggtaaaccaacgaaaccgttaacccggactaaaccgttaccccaaactactacgttcgtactttcgttacggtacggtacgagttcgacggtccgggtaccggtcggtttacgggttcctactacgtccgtccgttcccggtccgtacgtacctaacggtcgtacggcgtacgacccggtaccggtccccttacgtaccggtaccttacgttcgtaccggtcgggtacccttacggcggtacgtacgggaacgggtaaccggtaggacgtttacggtaatttcgtactcgacgtactgtaacactaaccaagaactaacggtaacgttacggttcgggtaccggtaccggggtacgaccgggaaacctaccggtacccggtacccgtaccgtacggtaccgacccggtaaccgaccggtacccgtccccggtacccttccgggttactacccgtcccgttacccccg

SEQ ID NO: 125759 - DNA, 805 bp, Homo sapiens
  misc_feature: GYAE6OF01ETW50.52.76.G10.1.454.CMB.1.raw
  modified_base (94)..(94): a, c, t, g, unknown or other
  misc_feature (94)..(94): n is a, c, g, or t
  modified_base (351)..(351): a, c, t, g, unknown or other
  misc_feature (351)..(351): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
tcagcgcagtacgacacgaccggtgctcgatttagtcactcatacagggggctgggggtctcaggaggcagcgctctcgggacgtctccaccanggcctgggctctgctattcctcaccctcctcactcagggcacagggtcctgggcccagtctgccctgactcagcctcgcctcgtgtcgtggttcctcgtacgacacgtcactcacctactcctcctcgcgaaccgtaggaaccacgtccgtaaagttcggtacgttttacggtaacctttactaaccgttctacgttccgtacctaccggtaaaccaaaccctaacccgtaacccggaacccgaaacccgtaacccnctttccgaaatttcgtaacgttaccggttcgaaaggttaccagggacccggtcctacggggtttccgttacccgtaacgttaccggacttaccgttccggacctttcccgtaacggtccttcgggaccgtacggtaccgtaccggaccgttaccccgtacggaacccctacggttaccgtaccccggttntnacccgtacccgttaccgggtaccggttacgggtaaccggtacccggtaacgggtaccgttacggtaaacgttaacgtacgtacggtaccgtacgttaccgtaccgtaacgtaaccgtaaccgtaaaccgtaacgtaaccgtaacgtacggtacgtacggtacggtacggtacgtacgtacgtaccggtaccgtaccgtacgtacgtaccgtaccgtaccgtacccgtacccgtaccgacccgtaccgtcccgtcccgtcccg

SEQ ID NO: 125760 - DNA, 722 bp, Homo sapiens
  misc_feature: GYAE6OF01CA9A8.52.76.G10.1.454.CMB.1.raw
  modified_base (481)..(481): a, c, t, g, unknown or other
  misc_feature (481)..(481): n is a, c, g, or t
tcagcgcagtacgacacgaccggtgctcgatttagtcactcatacagggggggggtctcaggaggcagcgctctcgggacgtctccaccatggcctgggctctgctattcctcaccctcctcactcagggcacgagggtcctgggcccagtctgccctgactcagcctgcctccgtgtcgtgggtcctccgtggacagtcgatcacctatcctcctgacacgtacggaaccagactaagtgtacgttaggtacttaatactctgtcctctagaccaacaacgtacccgacaaacgtacccaaactcatgtacttcgtttagacgtacaggtacgacgtcccggcccgtacggttacggggtttccacgtacgtcccgttccgttccggtcccggttacctaccgtaacgttcgtacggtccacggtccgtaccggtccctacccgtacgacctaccttcgtccggtacggtccctaccggnggtccgttaggacggtaacggtacggtattacgttaactttacttcgtacgtaccgtacgtaccttacgaacttaacccaaacgaaactaacggtaaccgtacgggtttacgggtacggttccgggaccgggtaccggaaaccttaaaccgtaccgtaccggtacgaccgtaccgacccgaacggtccccgtaccgtacccgtcggtacctaccttaccgttccctccccgtcccttaccg

SEQ ID NO: 125761 - DNA, 786 bp, Homo sapiens
  misc_feature: GYAE6OF01D5T3Z.52.76.G10.1.454.CMB.1.raw
  modified_base (230)..(230): a, c, t, g, unknown or other
  misc_feature (230)..(230): n is a, c, g, or t
tcagcgcagtacgacacgaccggtgctcgatttagtcactcatacagggggggggtctcaggaggcagcgctctcgggacgtctccaccatggcctgggctctgctattcctcaccctccttactcagggcacgagggtcctgggcccagtctgccctgactcagcctgccctccgtgtctgggtcctccgtggacagtcgatccaccatcctcctgctacgtggaaccngcaagtgacgttggtaacttataactctcgtctcgtacgtaccaactaacgtacccgacaaaccgtacccaactccagtcgacttcgtttagaacggtcgtaggtcggacgttccgggccccgtacgggttacggggttttctaccgtacgttccggttccgttcccgttacccgggaccttacccgtaacggttccgtagggcctacggacccgtacccgggtcccttacccgtacgaccctattcccgtcgtcgggtaccctccggtacggtccgtagggacgggaccgggtacgtcgtagttacgtttacgttccgtaggacctcgtaccacctaaactaacaaaccgtaacgaaaccgtaaacggttcgggtttaccggggttacgggttaccggggacccgggaaccggtaaccgtaaccggtacccgtaccgttcccgtaaggttacccgacccgggtacccgaacgggttccccgttaccccgtcccccggtttaacgtccccgttaccgtttacccctttcccggtcccccttaacccggttaccccg

SEQ ID NO: 125762 - DNA, 882 bp, Homo sapiens
  misc_feature: GYAE6OF01BIN8J.52.76.G10.1.454.CMB.1.raw
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
tcagcgcagtacgacacgaccggtgctcgattttagtcactcatacgtagggggggctgggggtctcaggaggccagcgctcgtcgggacgtcttcctaccatggcctgggctctgctattcctcaccctcctcactcgagggcacgacgggtcctgggcccagtctcgcctgactcagcctcgccctcgtgtcctggtctcctggctagtcatcaccntcctcngcacgtcggaacagcaatgacgttgtactatactgtctctctcgtaccaacactacccgataaccgtacccaaactcctagtatacgttcgttacgtaacgtcggtaacgtacggaccggtcccgggtccccggtaacgggtttaccggggtttaccttacgggtaccttcccggtttccgtttccccggttaacccggttccccgttaaaccgttacggtttccggtacgggcgttacccggaaccccggtccccgggttaccccttccccggttaaaccccggtaccgtttacctttcccgggttcccggggtttaacgggttacccccgttccgggaccgggttacggttaacgggaaacccggggttacgggtaaccggtaggtttaacccggtttaatttaacggttaccggtcaacggttcctaacccttacgaaccttaaaccgaaaaccgtaaaacctaaccggtaaaccggtttcgggttcgggtttacccggggaccggggtaccgggttaacccggaaaccgttaaccggtaccccggtaaacggttcccgaaccggttaccgaccccggaaccgtccggttccccggtacccccgttacccccggttcccgtaaacccggttccctttcccccgttaaccccccg

SEQ ID NO: 125763 - DNA, 745 bp, Homo sapiens
  misc_feature: GYAE6OF01EGKL2.52.76.G10.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (286)..(286): a, c, t, g, unknown or other
  misc_feature (286)..(286): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacgagggtcctgggcccagtctgccctgactcagcctgcctccgtgtcgtgggtctcgtggacngtcgatcacctntcgtcctgcacgtcgaaccngcaatgtacgttagtacttatactctcgtctcgtacgtaccacgtaacctacccganaaccgtaccccgtaatcgtactaggtactttcgtttaggacggtcgtagtggaccgttacccgggccgtacgggttacgggtttcctacgtacgttccgtccttaccgtccggtacctaaccggtacgttccgtcggggaccacggtaccccgtaccgggtaccccttacccggtacgtacccttacgttccgtcggtccgggtaccctccggtaggtacggtaggaacggtaccgggtacggtactaaggtttactttaaccgtacgtccgtacgtacttaaccgtactaaacgaacccgaaactaaacgtaaacgtaacggtttcgggttacgggttccgtaccggggacggtaaccgacccggttaaacgtcccgggtacctaccggtacgtacggtcccgaacccgttacgccccgttacccgcccgttccggtaccctccgttccgtacccccg

SEQ ID NO: 125764 - DNA, 758 bp, Homo sapiens
  misc_feature: GYAE6OF01A8AFR.52.76.G10.1.454.CMB.1.raw
tcagcgcagtacgacacgaccggtgctcgatttagtcactcatacagggggctggggtctcaggaggcagcgctcgtcgggacgtctccaccatggcctgggctctgctacttcctcaccctcctcactcgagggcacgacgggtcctcgggcccagttcctcgccctgactcacgcctcgcctcgtgtcgtggtctcgtggacagtcgactcacctattcctctcgcacgtacggaacctacgacaagtcgtacggtttaggttaacttaatacctcgttcgtcctcgtacgtaaccaaactaccgtaacccggaactaaaccgtaccccaactcgtattacgtaagtttcgtttacggaggttaccgaggtacgccggttcccgggaccgtacggggtttaacgggttttccacgtacgtcccgttccgttccgtaccggtcctaacggtaccgttcggcggaccacgtaccgacccgttccctaccgtactacccgttcgtcccgttcgggtaccgtcccggaccgtcggttacgggcggtaacgggacggtacgttacgttacgttacgtttaaccgtctcgtactcgtacaccttaacaaaccgaacgtaaacaacgttacggtaaccgttcgggttcggtaccggaccggggaccgtacctacgggtaccgttaaccggtaccgttacccgtacccgtcgaccccgtacgaccgtcccggacccgtccgtacggtacccttcccgtaccccg

SEQ ID NO: 125765 - DNA, 720 bp, Homo sapiens
  misc_feature: GYAE6OF01BZL9Q.52.76.G10.1.454.CMB.1.raw
tcagcgcagtacgacacgaccggtgctcgatttagtcactcatacagggggcgtgggggtctcaggaggcacgcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttatactctgtctctcggtaccaaacaactaccccggacaaaacgtcccccaaatcaatcgtattcgtttagacgtcaggtagactccggcccgacggtacggggttttcactacttccgtccgttaccgccgggtcctacccgaagtttccgagggtccaacgccgtacccgggtccccttccccgtacgaaccctcgttacctccggttcgggcccttaccgagggtcctacgggaacggacggacggtcttagtaactttagtaccgtgactacgtactactaacgtaaccaaaacctaaacgtaacgtaaaaccgttacggtttacggggttaccgttccggggaaccgggaccgggtaaaccctaaacggtccggtaacccgttacccgtaacggtacccgaccggaacccctaaagggccccttacccggtaccccccttacgggtactccccgttcccgtttaccccggg

SEQ ID NO: 125766 - DNA, 785 bp, Homo sapiens
  misc_feature: GYAE6OF01ECBW7.52.76.G10.1.454.CMB.1.raw
  modified_base (207)..(207): a, c, t, g, unknown or other
  misc_feature (207)..(207): n is a, c, g, or t
  modified_base (556)..(556): a, c, t, g, unknown or other
  misc_feature (556)..(556): n is a, c, g, or t
tcagcgcagtacgacacgaccggtgctcgatttagtcactcatacagggggctgggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatccaccntcctcctgcactacggaaccagactaatcgacgtttggtacttaataacttcgtgtctccgtacggaccaacaacgtacccgactaaaccgtacccctaaactcatagtacttcgtttggtaggtcgtaggtagtaccgtccgggccccgtcggtacggggtttcctacgtagtcccgtctttcccgtccggtccttacccgtaacgtcgtcggaccacggacccgtacccgggtccccttacccgtacccgtaaaccctccgttaccgtcggttaccggtcccgtaccgtacgggtcgtacgggtacgggaccggtacgtacggttacgtttactttaacgttaccgngtaacctacggtacctacctaaactaaccaaacgtaaaaccaagggttaaaaccgttcgggtttaggggtccgggtacccggggtacgggaaacccgggtaacccgaaaccgtacccggtacccgttacccgttaccggtacccggacccgtaccccgggaaccggttcccgtaccccccgggttaccccgtacccggttaccccttccgttccccggttaccccccgg

SEQ ID NO: 125767 - DNA, 541 bp, Homo sapiens
  misc_feature: GYAE6OF02G60OZ.52.76.G10.1.454.CMB.1.raw
  modified_base (432)..(432): a, c, t, g, unknown or other
  misc_feature (432)..(432): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactaccccggcaaacgtccccaaactcatgatctttgagtcagtgatcggccgcagggtttctcatcgcttctccgctcaagtctgcagcacgcctcctgaccatctctgggcctcgagctgaggacgaggctgtattattactgcagctacatacaacaaacanaaactcgttaggtcgttcggacggtaccgggaacctaacgtcggaaccgtccgtacgtccgacgacccgaaggcctccgccccgtcggtacctaccgtccgttacccgg

SEQ ID NO: 125768 - DNA, 512 bp, Homo sapiens
  misc_feature: GYAE6OF02FHJX2.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgtttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctggctcaggctgagacgaggctgattatactgcagctcatacacaaacagaaacacttgggtgttcggcggcggaaccaactgaccgtccacgtcacgcccaaggctcgccccctggtccacgtcttccg

SEQ ID NO: 125769 - DNA, 537 bp, Homo sapiens
  misc_feature: GYAE6OF02IR9MH.52.76.G10.1.454.CMB.1.raw
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgacccatctctgggctccaggctgagggacgaggctgattattactgcagctcataccaacaaacacgaaacacttgggtgttcgggcgggcgggaccaaacgtgaccgtcctacggtcacgcccgaaggcctgcccccgtcggtccacttcctcgttcccctaccccg

SEQ ID NO: 125770 - DNA, 553 bp, Homo sapiens
  misc_feature: GYAE6OF02H0Z96.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgcactggaaccagcaatgacgttggtacttataactctgtctcctggtaccaacaactaccccggcaaacgtccccaaactcatgatctttgagtcagtgactcggcccgcgtaggggtttctcatcgctttccgtccggctaccaagtctggcagcacgcctccctgaccatctcgtcgggctccgaggctggacggacgaggctagtattattactgcagctacataccaacaaacagaaactcgttgggtcgtcggcggaccgggacctaacgtcgaccgtcctaccgtcaccgacccgaggtcctccggcccccttacggtacctctccttcccg

SEQ ID NO: 125771 - DNA, 550 bp, Homo sapiens
  misc_feature: GYAE6OF02I1WCJ.52.76.G10.1.454.CMB.1.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (360)..(360): a, c, t, g, unknown or other
  misc_feature (360)..(360): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctctgtaccaacaactaccccgganaaacgtcccaaactcatgatcttgagtcngtnatcgccgnagggtttcncatcgctctcgctcagtctgcagcacggcctccngaccatctcgtgggctccgagctgaggacgaggctgtattattactgctgctacgataaccacaaacagaaactacgttgggtcgttcgggaccggacgggaaccctaacgtcggaacccgttaccgtaaccgtcgaacgcccgtaaggccttccggacccccgttacgggtcctaccgtccttacccgg

SEQ ID NO: 125772 - DNA, 524 bp, Homo sapiens
  misc_feature: GYAE6OF02IUHE1.52.76.G10.1.454.CMB.1.raw
  modified_base (318)..(318): a, c, t, g, unknown or other
  misc_feature (318)..(318): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgttacttataactctgtctcctggtaccaacaataccccggcaaagtccccaaactcatgatctttgaggtcagtgatcggcccgnaggggtttctcatcgcttctccggctccaagtctggcagcacggcctccctgaccatctcgtgggcctccgaggctgaggcgaggctgattattacngcagctcatacacaaacagaaacncgttgggtgttcggcggacggaaccaactcgaccgtctacgtcacgcccaaggctcgcccctcggtccactctcgtccctacccg

SEQ ID NO: 125773 - DNA, 561 bp, Homo sapiens
  misc_feature: GYAE6OF02I1I5X.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcactcgcttctccggctccaagtctggcagcacggccctccctgacccatctcgtcgggctccgaggctgagggacgaggctgattattactgcagctcatacaaccaaacagaaactacgtttgggtacgttccgggcgggaccgggaaccctaacgtcgacccgtccgtaccggtcaacgcccgaaggcccgtacgtccccccgtcggtcctaccgttccgttacccg

SEQ ID NO: 125774 - DNA, 524 bp, Homo sapiens
  misc_feature: GYAE6OF02IL8P4.52.76.G10.1.454.CMB.1.raw
tcagcgcagtacgacacgaccggtgctcgatttagtcactcatacaggggggcgtggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccagcaatgacgttggtacttataactctgtctcctggtaccaacaatacccccggcaaagtccccaaactcatgatctttgaggtcagtgatcggcccgcagggtttctcatcgcttctccggctccaagtctggcagcacggcctccctgacccatctctcgggcctccgaggctgaggacgaggctgatttattactgcagctcatacacaacgagaaactacgttgggtgttcggacggacggaccaacgtcgaccgtctacgcacgccaagcctcgccccgtggtccactctccg

SEQ ID NO: 125775 - DNA, 618 bp, Homo sapiens
  misc_feature: GYAE6OF02J19CL.52.76.G10.1.454.CMB.1.raw
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtaacttataactctgtctcctggtaccaacaataccccggcaaacgtccccaaactcatgatcttgagtcagtgatcggcccgcgtaggggttctcagtcgcttctccggctaccaagtctgcacgcaccggcctcccgtcgacccatccgtcgtcgggctcccgagggctggaccggaggacggtcgtagtattacttacgttggctacgtctccgtaataccaacaaaacgacgtaaacctcgttaacgggtcggttacggccgggtacggaaccgtaacgtaccgtacccgtacttaccggtaccaaccggcccgtaacggccgtaccccgtcccccgttaccggtaccctaaccctttccgtccggttccccctaccccg

SEQ ID NO: 125776 - DNA, 544 bp, Homo sapiens
  misc_feature: GYAE6OF02JJCIT.52.76.G10.1.454.CMB.1.raw
tcagcgcagtacgacacgaccggtgctcgatttagtcactcatacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaaactcatgatctttgaggtcagtgatcggcccgcaggggtttctcatcgcttctccggctccaagtctggcagcacggccctccctgaccatctctgggctccaggctggaggacgaggctgattacttactgcagcctcactacaactaaacaacgaaacacgtttgggtgttccggcgggcggaaccaacgtcgaccgtcctacgtcacgcccgaagccgtcgccccgtcggtcctactcgtcgttccccgtcccc

SEQ ID NO: 125777 - DNA, 610 bp, Homo sapiens
  misc_feature: GYAE6OF02G0LWG.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcgaatgacgttggtacttataactctgtctcctggtaccaacaataccccggcaaacgtccccaaactcatgatcttgaggtcagtgatcggcccgcagggttctcatcgcttctccggctccaagtctggcagcaccggcctccctgaccatcctcgtcgggtcctccgacggcgtggacgggacggacggcgtagtaatttaacgttacgtcgacacgtctaccgataaccaacaaacaagtaaacctacgttgggttcgttccgggacggtaccgggaaccctaacgtcggtacccgtcccgttaccggtaccgaaccgaccccgaagggtccctacccggtccccccgttacgggtaccctacccgttccgttacccccgg

SEQ ID NO: 125778 - DNA, 655 bp, Homo sapiens
  misc_feature: GYAE6OF02GC0EO.52.76.G10.1.454.CMB.1.raw
  modified_base (331)..(331): a, c, t, g, unknown or other
  misc_feature (331)..(331): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttataactctgtctctggtaccaacaactaccccggacaaagtccccaaactcatgatctttgaggtcagtgatcggccgcgtagggtttcncatcgcttcgccgctcaagtctggcagcacgcctcctgacctatcctcgtcggcctccgaggtctaggacggaccggacggtccgtagtaactttaacgttacgtgaccgagtcctactaaacttaaccgaaacaaaaccgaaacgtaaaaccgtaacggttttacgggggttacgtttaccgggaccggggaacccgggtaacctaaaccggtcggtaaccccgttacccgtaaccggttaaccgaaccggtaaccccgaaggggtcccttacccgggtacccccccgttacgggtaccctaccgttcccgtttacccccggg

SEQ ID NO: 125779 - DNA, 561 bp, Homo sapiens
  misc_feature: GYAE6OF02I3H6K.52.76.G10.1.454.CMB.1.raw
  modified_base (403)..(403): a, c, t, g, unknown or other
  misc_feature (403)..(403): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacgccctccctgaccatctcgtggctccaggctggaggacgnggctgtattattactgcagtctacgatacaacaaacagaaacctacgttgggtgttcggcggaccgggaaccaacgtcggacccgttccgtaccgttaccaccggtacccgaaggtccctaccggcccccgttcgggtacctaccgtccgttaccccg

SEQ ID NO: 125780 - DNA, 558 bp, Homo sapiens
  misc_feature: GYAE6OF02GBK58.52.76.G10.1.454.CMB.1.raw
  modified_base (433)..(433): a, c, t, g, unknown or other
  misc_feature (433)..(433): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcaatgacgttggtacttataactctgtctcctggtaccaacaataccccggcaaacgtccccaaactcatgatcttgaggtcagtgatcgccgcagggtttctcatcgcttctccggctccaagtctggcagcacggccctccctgaccatcctcgtcgggcctccgaggctggacggacgaggctaggatttacttctcgcgagtctnaactacaacaacagaaacctacgttgggtcgtcgggacggccgggaacctaacggtcgtacccgtccgtaacggtccgaacgtacccgaggccgtaccgccccgtcggtcctactcgtaccccgg

SEQ ID NO: 125781 - DNA, 657 bp, Homo sapiens
  misc_feature: GYAE6OF02GF7F3.52.76.G10.1.454.CMB.1.raw
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (333)..(333): a, c, t, g, unknown or other
  misc_feature (333)..(333): n is a, c, g, or t
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
tcagcgcagtacgacacgaccggtgctcgatttagtcactcatacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttggtacttataactctgtctcctggtaccaacaactaccccgganaaacgtccccaaactcatgatctttgaggtcagtgatcggcccgcgtagggtttcncagtcgtcttcgtccggctccgaagtcgtggcagcaccggccctccngaccatcctcgtgggcctccgaggtctggacggacgcggnttcgtaatttactacgtgcgtacgtcctactaacgtaaccaacaaaacgaacgtaaacctacggtttacggggtcgttaccgggaccgggtaccggtaaacccgtaaacgtccggtaaccccgttaccgtaccggtaaccgtaaccggtaccccgtaaacgggtcccgttacccggtaccccccgttacgggtaccctacccgttaccgtttaccccggttacccccttaacccccg

SEQ ID NO: 125782 - DNA, 759 bp, Homo sapiens
  misc_feature: GYAE6OF02JT3B8.52.76.G10.1.454.CMB.1.raw
  modified_base (225)..(225): a, c, t, g, unknown or other
  misc_feature (225)..(225): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccngacaatgacgttggtacttatactctgtcctcctggtaccaactaacgtaccccggactaaaccgtcccccaaactctaatggaacttcgtttacgacggtcaagtgacgtccgggacccgtggtacggggtttcctcgacgtccgtccttccgtacccggtccttaccgtaacgtcgtcggacctacgccgtacccgggtccccttcccgttacgaccctagttcccgttcgggtaccggtcccgttaaccggacggtcccgtagggtaacgggaaccgggtacggtcgttaacggttacgtttaaacgttttaccgacggtaccgtacgtaccttaaccgtaacgtaaaccctaaaccgaaaacaacgtaaaacccgttacgggtttacggggttcgttaccggggaccgggtaacccgggtaaacctaacgttaccggtaacccggttaccttaaccggtacaacccggtacccgtaacgtcccggttacccggtcccccgttaggtaccttaccgtttcggttacccccg

SEQ ID NO: 125783 - DNA, 540 bp, Homo sapiens
  misc_feature: GYAE6OF02I27O5.52.76.G10.1.454.CMB.1.raw
  modified_base (212)..(212): a, c, t, g, unknown or other
  misc_feature (212)..(212): n is a, c, g, or t
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccngcactggaaccagcaatgacttggacttataactctgtctcctggtacaaccaataccccggcaaaagtccccaaatcatgatctttgaggtcagtgatcggccgcaggggtttctcgatcgcttctccggctcaagtctggcagcacggctccctgaccatctctggctcagctgagacgaggctgattatactgcagctnatacgaacaaacagaaacacgtttacngggtacgttacggacggacggaccgaaactacgaccgtaccgtaaccgtaccgacgacccgtaacggtaccgtaccgtcccccgtaccggtacctaccg

SEQ ID NO: 125784 - DNA, 801 bp, Homo sapiens
  misc_feature: GYAE6OF02IW5EP.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacgagggtcctgggcccagtctgccctgactcagcctgcctccgtgtctggggtctccgtggacagtcgatcaccatctcctgcactggaaccagcaagtgacgttggtacttataactctgtcctcctggtaccaacaacgtaccccggacaaacgtccccaaactcatgacttcgttgaggtaccagtcgagtcccgggcccgtcggtacggggtttcctcgacgtcgtccgtttccgtcccgggtaccttacccgtaacgttccgttcgggaccacggtcccgaaccgggtcccccttccccgtaggtaaccctacttccgttcccggtcggggcccttacccggtagggtccgttacgggaacggggaaccgggtacggggtaccttacgggtaacttttacgtttaaccgttcggaaccgtacggtcctaccgtaacttaaacccgaaaccaaaacgtaaacggtaaaaccgtaccggttttacggggttaaccgggtttaccgggacccggggtacccgggggtaaaccccgtaaccggttaccggtaaccccggttccccgttaacccggttaccgaacccggacccggtaaaccggtcccggtacccccgtaccccccgggttaggttacccccgttaccgttcccgtttaaccccccgg

SEQ ID NO: 125785 - DNA, 628 bp, Homo sapiens
  misc_feature: GYAE6OF02H76JO.52.76.G10.1.454.CMB.1.raw
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
tcagcgcagtacgacacgaccggtgctcgatttagtcactcatacagggggggggtctcaggaggcagcgctctcgggacgtctccaccatggcctgggctctgctattcctcaccctcctcactcagggcacagggtcctgggcccagtctgccctgactcagcctgcctccgtgtcgtgggtcctccgtggacagtcgatcaccatctcctgcacgtggaaccngcaatgacgttgtacttatactctgtctcctggtacaacactaccccggnaaacgtccccaaatcatgatcttgacggtcagtgatcggcccgngtagggtttcncatcgtcttctccggctccaagtctggcagcacggccctcctgaccatcgtcgtggctccgagcgtgacggacgaggctaggtatttaatcgtgacagtcctacgataaccaacgaaaaccaacgtaaaccgtaccgtttggggttaacgttccggggaccgggaccgggtaaacccgaaacgtccggacccgttcccgttaaacggcgtaaccggaccccgtaaacggtcccgttcccggccccccgtttacgggccccttaaccgtttcccgttacccggttcccccgtaccccc

SEQ ID NO: 125786 - DNA, 577 bp, Homo sapiens
  misc_feature: GYAE6OF02JTN7X.52.76.G10.1.454.CMB.1.raw
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
tcagcgcagtacgacacgaccggtgctcgatttagtcactcatacagggggggtcgtcaggaggcagcgctctcgggacgtctccaccatgcctgggctctgctattcctcaccctcctcactcaggcacaggtcctgggccagtctgccctgactcagcctgcctccgtgtctggtctcctggacagtcgatcacatctcctgcatcggaaccagcaatcgacgttggtacttataactctgtctccgtgtaccaactaacgtaccccgacaaacgtaccccaaactccaatcgtatcttgagtcatcgatccgacgcagggtttctcgatcgctctccggctcagtctgcagcacgtcncctancctatcctgcggctcgagctgacgcgagntcgtacttatactgacngtcctanactacaacaanacgaaactcgtaacgggttgttcggacgcggaaacaacgtcgacccgttcaaccgggtctaaccggacccgtaaaggtcccgtaccggtaccccccgttacgggtacccttaaccgttccccgtaccggttcccccgttaacccccg

SEQ ID NO: 125787 - DNA, 522 bp, Homo sapiens
  misc_feature: GYAE6OF02IUHYA.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcaatgacgttgacttatactctgtctctgtaccaacaataccccggacaaacgtccccaaactcatgatctttgacggtcagtgagtcggcccgcgtagggtttctcatcgcttctccgctccaagtctggcagcacggcctcctgacctatctcgtcggcctccgaggctgaggacgaggtctgtatttatactgcagctacactacaacaaacacgaaactacgttggtgtacggcggacggaccaacgtcgaccgtctacgtcgacgccagccgtcgcccgtcgctcgtctcccg

SEQ ID NO: 125788 - DNA, 558 bp, Homo sapiens
  misc_feature: GYAE6OF02FF2OI.52.76.G10.1.454.CMB.1.raw
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
  modified_base (417)..(417): a, c, t, g, unknown or other
  misc_feature (417)..(417): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatatcctgcactggaaccagcaatgacgttggtacttataactctgtctctggtaccaacataccccggcaaagtccccaactcatgatctttgagtcagtgatcggccncgaggggttctcgatcgcttctcggctccaagtctggcagcacggcctccngaccatctctgggctcgaggctgaggacgacggctggtattatacgtgacncgtctccataacactaaacgagaaactacgttagggtcgttacgggccgggcgggtaacccaacgtcgacccggttccttcgtaccgaccgtacccgaacggccttccggccccccttcggccctaccgtcctttacccgg

SEQ ID NO: 125789 - DNA, 799 bp, Homo sapiens
  misc_feature: GYAE6OF02JIMN5.52.76.G10.1.454.CMB.1.raw
  modified_base (269)..(269): a, c, t, g, unknown or other
  misc_feature (269)..(269): n is a, c, g, or t
tcagcgcagtacgacacgaccggtgctcgatttagtcactcatacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcaatgacgttgtacttatactctgtctctgtacaacataccccgganaacgtcccaactcatgtatctttagaggtcagtagtacgtccggcccgtcgtacggggtttctacgtacgtccgtaccttcgtcccggtctaccgtaacggtccgtacggtaccgacgccgtaccgggtaccccttcccgtacgacccttactccgttcgtcgggtccctaccggtacggtcgtacgggaacgggaccggtaggtacgttagtaacgttttacgttaaccgtggtaccgtacggtacctaacctaacgttaaacccaaaacgtaaaaccggtaaacttaaaacccggttaccgggttttaagggggttaccgggttccgggggtaacccggggtaacccggggttaaaaccgtaacccggttaacccgggttaaccccggtttacccgtaacccgggttaacccggaaccggttaaccccggtaacgggttacccggttaccccggtaccccccggtttaccgggtacccgttaaccccggttttcccgtttaccccggttacccccccttaacccccgg

SEQ ID NO: 125790 - DNA, 601 bp, Homo sapiens
  misc_feature: GYAE6OF02J16W7.52.76.G10.1.454.CMB.1.raw
tcagcgcagtacgacacgaccggtgctcgatttagtcactcatacaggggcgtggggtcgtcaggaggcagcgctctcgggacgtctccaccatggcctgggctctgctattcctcaccctcctcactcaggcacaggtcctggcccagtctgccctgactcagcctgcctccgtgtctgggtctcctggacagtcgatcaccatctcctgcacgtggaaccagcaatgacgttggtacttataactctgtctctggtaccaacaataccccggacaaacgtccccaaactccatgactctttagagtccagtgatcggcccgcgtacggggtttctcgtaatcgtcttcgtccggtctacctaagtcgtcgctacgcacgtcccgtccctcgaccactcctcgtcgggtcctccgaacggctcgacggtacgacggctagatttactacttcgctagtcctactacgtacaaactaaacgaacaaacgtacgttagggtcgttacggcgggtaccggaaccaacgtcggacccgtaccgttacgacgaccgtacccgaacggacgttccgacccccgtggtccctaccgtcttaccccgg

SEQ ID NO: 125791 - DNA, 690 bp, Homo sapiens
  misc_feature: GYAE6OF02IJRLU.52.76.G10.1.454.CMB.1.raw
  modified_base (279)..(279): a, c, t, g, unknown or other
  misc_feature (279)..(279): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactcggaaccagcaatgacgttggtacttataactctgtctcctggtaccaacaactaccccgganaacgtaccccaaactcatgattcgtttgaggtcaggtagacgtccggcccgtcggtacggggttttctcgattccgtcttcgtcccggcttacccgtaagttctggacgacgccgtaccgccctacccgtcgacctactctacgtcggtcctccgaggcgtaggacggacggacggtcgtagtaatttacttacgtgacacgtcgtacacttaaccaaacaaaaccgtaacgaaaccttacggtttcggggtacggttaccgggaccgggtaccgggaacccgtaaaccgttccggtaaccccggttaccgttaacccggtaccgtaacccggaacccgtaaaccgggtcccgtcccgggttacccccccgttaccgggttaccctacccggtttcccgtttaccccccgg

SEQ ID NO: 125792 - DNA, 759 bp, Homo sapiens
  misc_feature: GYAE6OF02G2ZJA.52.76.G10.1.454.CMB.1.raw
  modified_base (275)..(275): a, c, t, g, unknown or other
  misc_feature (275)..(275): n is a, c, g, or t
tcagcgcagtacgacacgaccggtgctcgatttagtcactcatacagggggctggggtctcaggaggcagcgctctcgggacgtctccaccatggcctgggctctgctattcctcaccctctcactcagggcacagggtcctgggcccagtctgccctgactcagcctgcctccgtgtctggtctcctggacagtcgatcaccatctctgcactggaaccagcaagtgacgttgtacttataacctctgtcctctagtaccaacactaccccganaacgtcccaatcatgacttcgttgacggtcagtcgtacgtccggaccgtcgtagggtttcctctacgtccgtcttccgtccggcctaccgtagttcgacggtccacgtaccgtacccggtccccttcccgtacgaccctacgtttccgtccggttacccgggtcccgttaccggtacgggtaccgttacgggaacgggtacgggtacgggtaccgttacggttaacgtttaacgtttaccgtccggtacgtaccgtacctaacgtaacgtaaacctaaaccgtaaacgaaacggttaacccgttacgggttttacggggttaccgggttaccggacccggggtaaccggaaccgttaacccggtccggttaaccccgggttacccgttaaccggtacccgtaacccggtaaccccggtaacggttcccctaccccgggttcccccggtacccgttaccgttacccgttccccgtttaacccccg

SEQ ID NO: 125793 - DNA, 624 bp, Homo sapiens
  misc_feature: GYAE6OF02F203C.52.76.G10.1.454.CMB.1.raw
  modified_base (363)..(363): a, c, t, g, unknown or other
  misc_feature (363)..(363): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccagcaatgacgttggtacttataactctgtctcctggtaccaacaataccccggacaaacgtaccccaaactcatgatcttgaggtcagtgatccggcccgctagggtttctcatcgcttctccggctccaagtctggcncgcaccggtcctcccgtgacccatcctccgtgggcctccgacggtctggaacggacggaaggcctagtatttattaccgtgtacagtctactataaccaaaccaaacaacgaaacgtcggtttaggggttagttccgggaccggggtaccgggaaccgtaaccgtcggtaacccgttaccgtaaccggttaccaacccggtaccccgtaacgggccgttcccggaccccccgttcggtcccgtaccgttcctttacccccg

SEQ ID NO: 125794 - DNA, 676 bp, Homo sapiens
  misc_feature: GYAE6OF02G0Z2S.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttatactctttctctggtaccaacaactaccccggacaaacgtaccccaaactcatgattctttgaggtcaggtgacgtccggcccggcgtacggggtttctcagtccgtctttccgtccggtctacctaagttccgtcgggacacggcctaccgggtccctcccgtcgacccgtacttccttcggtcgggcctaccgacgggtctcgggacggaacggacgggtctaggtactttaacttacgtcgacgcgtactactaacgtaaccaaaccgaaaactaacggaaaaccttacggtttacggggttacgtttccggggaccgggtaaccgggaacctaaaccgtccggtaaccgtacccgtacggtaccgacgtacccgaacggtacctcccgtcccccgtcgggttacccaccgttccgtacccgttccccgg

SEQ ID NO: 125795 - DNA, 854 bp, Homo sapiens
  misc_feature: GYAE6OF02HP106.52.76.G10.1.454.CMB.1.raw
tcagcgcagtacgacacgaccggtgctcgatttagtcactcatacagggggggtcgtcgggaggcgagcgctctcgggacgtctccaccatggcctgggctctgctattcctcaccctcctcactcagggcacgagggtccgtcgggccccagtctcgccctagacctcagcctgcctccgtgtcgtgggtccttccgagggacagtcgactacaccagtcctcctgccatcgggaaccagacaatggtaccgttaggttactaactagtccgttgtctccgtacggtaccaaaccaaccgtacccggacaaacgtaccccaaactaccactagtacttcgttagtacgtcgagtacgacgtccggtaccggcggttacggggtttctaccgactccgtcttccgtcccggttctaccccgtaaggtccgtacggacgtaccgaaccggtccggacccgttcccgtacgtaaccctaccgttcgtcccggtccgggtacctaccggacggtacgttacgggggaacggtaccggtacgggtacctacgggttaaacgtttaacgttaccgtacggaaaccggtctaaaccggttccaaacgttaaccaaaccggtaaaaacttaaaccgaaaccggttaccggttttaggggtacccgggtttacccgggggtaaccgggtaaaccccgggggaacctttaaaacccgggaccggtttaaaccccgggtaccgttaacccggtaccgtaaacccggaccccgggtaacggtacccccgaacccggggtttcccccgtaaccggttccccgtaccgtttaccccgtccccggttacccccccttaccggtacccc

SEQ ID NO: 125796 - DNA, 750 bp, Homo sapiens
  misc_feature: GYAE6OF02IYKXN.52.76.G10.1.454.CMB.1.raw
  modified_base (284)..(284): a, c, t, g, unknown or other
  misc_feature (284)..(284): n is a, c, g, or t
tcagcgcagtacgacacgaccggtgctcgatttagtcactcatacagggggctggggtctcaggaggcagcgcgtctcgggacgtctccaccatggcctgggctctgctattcctcaccctcctcactcagggcacagggtcctgggcccagtctcgccctggactcagcctgcctccgtgtctgggtctccgtggacagtcgatcaccatctctgcactggaaccagacaatcggtacgttggtacttaatactctgtctctgtaccaacaactaccccgganaacgtaccccaaactccatagattctttagacggttcagtacgacgttcggccccggaggttacggggtttctcgacgttccgtccttccgttcccggaccttacccgtaacggttccgtacgggaccgtacgacccgtaacccggtccccttaccccggtaccggaacccttaacgttcccgttccggttcccggggtacccttccgggacgggtaccgttacgggaacgggtaacgggacggttacgtacggttaacttttaacgtttaccttaggctaacggtaccttaccgaacttaaacgaaacccaaacgtaacgtaaaaccgttcggttcggggttcggttacggggacccggaaccggtaaccgtaccgtacggttacccgtaccgtaccgtacggaaccgtaacccggagttcccgtacccggttccccggacgtaccctacgtccgtttacccccg

SEQ ID NO: 125797 - DNA, 754 bp, Homo sapiens
  misc_feature: GYAE6OF02HD41J.52.76.G10.1.454.CMB.1.raw
  modified_base (271)..(271): a, c, t, g, unknown or other
  misc_feature (271)..(271): n is a, c, g, or t
tcagcgcagtacgacacgaccggtgctcgatttagtcactcatacagggggggggtctcaggaggcagcgctctcgggacgtctccaccatggcctgggctctgctattcctcaccctcctcactcagggcactagggtcctgggcccagtctgccctgactcacgcctgcctccgtgtcctgggttcctccgtaggacagtccgataccacctatcctcctgtacaccgtacggaaccagacaatagcggttacgtactagtaactcgtntactccgtacggaacctaacgaacctacccgaactaaaccgtacccaaactcatagtacttacgttagtacggtacagtcgtacgaccggcccgtacggtaacgggttctacgtaagttccgtaccgttccgtaccgtcctaaccgtacgtacgttacgacgacgtcccgaccggtcccttaccgtacgtaacctactccgtcgtcggaccgttacgacggtaccgtagaacgggtacggtacgggtacgtaagttaacgttaacgttacggttcaaccgtacgtcctaaaccgtactaaaacgaaccaaaacggttaacctaaaacggttccgggtttagtacggggtttaccgaccggggttaaccggaaaacctacggtaccccggtacctcggtaacggtaccgaccggtaaccggcccgtaccggtccgtaccccggttacggaccttacccgtccgttacccgtccccttaacccgg

SEQ ID NO: 125798 - DNA, 820 bp, Homo sapiens
  misc_feature: GYAE6OF02F1IWK.52.76.G10.1.454.CMB.1.raw
tcagcgcagtacgacacgaccggtgctcgatttagtcactcatacaggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgtacgttggtacttataactctgtctcctacggtaaccaacaacgtaccccggacaaacgtacccccaaaactcactagtacttctttaggacggtctaggtgtacgtccgggacccggacggttacgggggttttcctacgtacgttccggttcctttcccggttcccggtaccttacccgtaaccgttccgtcgggtaccgtaaccggccgtacccgggtacccccttccccgtacgtaaacccccgtagttcccggttccggttccggggtcccttacccgggaccggttaccggtaggggaaccgggttaacggggtacgggtacgttagttaaccgttttaacgttccgttacgaccgtacgtccgtactaacgtaaacccgaaaactaaaccgtaaacggtaaacccgttagggttttacggggttaccgggtttaccgggggaacccggtaccggggaaaccctaacggtaccggttacccgtacccgttaacgggtccgaaccgtacccggaacgggtccccttacccgggtccccttacgggttccctaccggtcccgttcccgtacccccgtttaacccccg

SEQ ID NO: 125799 - DNA, 686 bp, Homo sapiens
  misc_feature: GYAE6OF02GORS4.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacgagggtcctgggcccagtctgccctgactcagcctgcctcgtgtctggtctctggacagtcgatcaccatctcctgcacgtggaaccagcaatgacgttgtacttataactctagtctcgtgaaccaactaactaccccgacaaacgtcccaaactcatagacttcgtttagaggtcaggtcgacgtccggcccgcggttagggtttctacgtactcgtcttccgtcccgggtacttacccgtaaggtccgtggaccgacgtaccggacccggtcccctaccctcgtaaccctcgttacccgttccggtacggtacccttaccggtacggaccgttgggaacgggacgggaggtaccgtaggtaactttaagttactcgactcgactacgaactaacgaacctaaacgaacgtaaacgtacgggtttacggttacgggttaccgggacggtaaccggaaccgtaaccggtaccgtacccgtacgtaaccgtcgaaccgacccgtacgtacccgtccgtaccccggttcgtaccgtaccttccgttaccccg

SEQ ID NO: 125800 - DNA, 804 bp, Homo sapiens
  misc_feature: GYAE6OF02HAD0Z.52.76.G10.1.454.CMB.1.raw
  modified_base (576)..(576): a, c, t, g, unknown or other
  misc_feature (576)..(576): n is a, c, g, or t
tcagcgcagtacgacacgaccggtgctcgatttagtcactcatacaggggggggggtctcaggaggcagcgctctcgggacgtctccaccatggcctgggctctgctattcctcaccctcctcactcagggcacagggtcctgggcccagtctcgccctgactcagcctgcctccgtgtcgttcgggtcctccgtggacacgtcgatccaaccattcctcgtcgctacgtacggaaccaggaccaaagttcggacggtttacggtaacttaataaccgtcttacgtccttcccgtagggttaacccaaacgtaaaccgtacccccgggacaaaaccggtaccccccaaaactccaagttacgtaactttccgtttaggagggttacctaaggtttcgaacgtcccggggaccccgtcggttaaccgggggttttcctaccgtaacgttccgtccgttttccgtcccggtaccttacccgtaagttcctcgggacacgaccgtaccggtccctccctacggacctactcgtccgtacggggcccttaccgacgggtcgttaggacgggacgtacggngttacgtacgtttaagtacgtcggacgtacgtacttctaaacaacctaaaccgaaacgtaaacgtaaaccgttcggttacggggttacggttaccgggggtaccggtaccggttaaaccctacggtaccgtacccgtacccgttagacccggtacgtacccgtaaggtcccgtaaccggttcccccctcggttaccgtacctttacccgtcccgttcccctaaccccg

SEQ ID NO: 125801 - DNA, 713 bp, Homo sapiens
  misc_feature: GYAE6OF02HM1NR.52.76.G10.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (346)..(346): a, c, t, g, unknown or other
  misc_feature (346)..(346): n is a, c, g, or t
tcagcgcagtacgacacgaccggtgctcgatttagtcactcatacagggggggggtctcaggaggcagcgctcgtcgggacgtctccaccatcggacctgggctctgctattacctcaccctcctcactcagggcacagggtcctgggcccagtctgccctgactcagcctgcctcgtgtctgggtctccgtggacngtcgatcactatctctgcactggaaccngacaatgtacgttgtacttatactctgtctctggaccaacaacgtacccgacaaacgtacccaatcatcttattttagacgtacaacgtacgccggcctcggacgggtcctgactcgtctntcgtggtctacgtacgtcgtacggtacaaccgacccggtcccttaccgcggtaccgttcgtccggtccgggtacctccggtacggtcgtaggacgggtactacgggcgtacgtaacgttacgttactaacgtccgtacctaacccgttagtaacttacgcggaccgtaagggacctaaacccggttaaaggttttaccgggggttttacggggggttaccggaacggggttaaccggggtacgtaaacggttccgtacccggttaccgtaccgtacggaccggtacctaaccgggtccctacccggttccccgtacggtacccttaccggtcctttaacccggtcccccttacccttccttaaccgg

SEQ ID NO: 125802 - DNA, 727 bp, Homo sapiens
  misc_feature: GYAE6OF02G7ED7.52.76.G10.1.454.CMB.1.raw
  modified_base (204)..(204): a, c, t, g, unknown or other
  misc_feature (204)..(204): n is a, c, g, or t
tcagcgcagtacgacacgaccggtgctcgatttagtcactcatacaggggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatccacntctctgcactcggaaccagcaatcgtacgtttggtacttatactctcgtctctcggtaaccaacgaactaccccgacaaccgtaccccaaactacactacgattcgttaggtaggtcgagtagtaccgtccggcccgtacggttagggtttccacgtaacgtccgtccttccgtcccggtctacccgtaagtcgtcgacgacgtcgacccgtcctacccgacgaccctacttccgttaccgtcgggtaccctccgtacggtccggtacggacgggaccgggtaaggtaccgttacggttaaacttacgttaccgtacgtacgtaccttcgtacaacttaacgaaactaaaccgtaactaacgtacgggtttacggtaccggttacccggggaacgggtacccggtaaacccgtaacgttaccgtacccggttccctacggtcccgtaaccgtacccgtaccggtccgtccccgtcccggttaccgtaccgtacccgttacccgttcccgtaccccttaccccg

SEQ ID NO: 125803 - DNA, 896 bp, Homo sapiens
  misc_feature: GYAE6OF02I9Z0H.52.76.G10.1.454.CMB.1.raw
tcagcgcagtacgacacgaccggtgctcgatttagtcactcatacagggggctggggtctcaggaggcagcgctctcgggacgtctccaccatgcctgggctctgctattcctcaccctcctcactcaggcacgagggtcctgggcccagtctgccctgactcagcctgcctccggtgtcgtggtctccgtggctagtcgatccacctatcctcgtgactacgtacggaacccagtacgaaattcgtacggtttacggttaacctttaacttaacctcgttacggttccctccgttaacggtaacccaaaccgtaaaccggtaccccccggtaactaaacccggtaccccctaaaaccttcccgtattaacggttacgtttaccggttttagggaccggttccggagtttacggaccggtccccggtaccccgggtacggggtttaccggggttttaccgccgttacgttcccgggttcctttacccggtccgtaccgttaaccgtacggttcggtggacccttaccgggccgtaacccggtccccttcccggtacgtacccgtagttcccgtacgggttcccggtacccttaccggacgggtacgttagggaaccgggttagggccgttacgtcgttttaaagttaaccgttacgtaccgtaccggtacctttaccgtacctaaacgttaaacgaaaacccgtaacgtaaacgtaacggtttacgggtttcccgggggttaacgtccggggtaaccgggaacccgttaacccgtacgttaacccgggttccgttaaacccggtaccggttaaccggtaaccgtaccccggtaaacgtccccggttcccccggacccggttaccgttcccggttaaccccgtcccgtttcccccgg

SEQ ID NO: 125804 - DNA, 775 bp, Homo sapiens
  misc_feature: GYAE6OF02JPF1K.52.76.G10.1.454.CMB.1.raw
  modified_base (208)..(208): a, c, t, g, unknown or other
  misc_feature (208)..(208): n is a, c, g, or t
  modified_base (301)..(301): a, c, t, g, unknown or other
  misc_feature (301)..(301): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcaggcacagggtcctgggcccagtctgccctgactcgagcctgcctcgtgtctgggtctcctggactagtcgatccacctntcctacctgccacgtcggaacctagcaagttgacgtttgacttacgtactctgtctcacgtacaactaaccgtaccgacaaccgtaccaactntacgtactacgttcttacgacgtcagtgacgtccggaccgtcggtacggtttcactcgtacgtccgtacgtcccgtacgtacccgtaagtcgtgtaccgtacgtacccgtaccggtccctacccggtaccgtaccgtacgttccgtacggtcggttaccctaaccggtcggtaccgtacgggtaccggtaacgggtacccggtagttaccgtttaacgtttaaccggttaccggttacgtaccgtaacgttaccgtaaccgtaactaaccggttaaacccgaaacggtaaaccggtaaccggtttacgggttacgggtttccggggtaccggtacgggtaacccgggtaaccgtaacgttcccggtaccggtttaaccgttacccgtaaccggtaaccgaccccggtttaaacgggtccccgttcccggtaccccgtttaccggaaccctttccgggtaacccttccccccggg

SEQ ID NO: 125805 - DNA, 928 bp, Homo sapiens
  misc_feature: GYAE6OF02FT5PD.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcagggcacgagggtcctgggcccagtcctgccctgactcacgcctgccctccggtgttccgttgggtcctccgtaggactacggtcgaacttccaaccctattccctcccgtaggccctaacgttacgggaaccccaggactaaacgtcgggttacggtttacggtaacctttactaacgttctcgttccgttaccgttacggtaacccaaacgtaaccgtaccccccggaactaaaccgtacccccgtaaaccttacaacgtacgtattaccgttttagggtaccggtacgtacggtacgtaccgtccccgggtcccggtacgggttttaacggggttttccccttgtacccgtttccccggttccgtttacccgtacccggtacccttaacccggttaacggttcccgggtacggaaccggtacccggacccgtaacccgggtccccttccccgtaccgacctaccgttcccgttcggtaccgggtccgtccggtccggtacggtacgggacggtaaccggtacggtacgttacgtaacgtttacggtaaccgttcggtaacgtaccgtccgttaacctaacgaaaccctaaaccgaaaacgtaaaccgtaaaccgggttcgtttaccggggttccgggttaaccgggacccgggtaaacccggtaacccggtaaccgttacccggacccggtttaaccgtcccggtaaccgtaaccccggtacccccgtaacgggttccccggtaaccccgttcccccggttaccgttaaccccgttccctttaaccccgtccccccg

SEQ ID NO: 125806 - DNA, 901 bp, Homo sapiens
  misc_feature: GYAE6OF02HNGTY.52.76.G10.1.454.CMB.1.raw
tcagcgcagtacgacacgaccggtgctcgatttagtcactcatacagggggctggggtctcaggaggcagcgctctcgggacgtctccaccatggcctgggctctgctattcctcaccctcctcactcaggcacagggtcctcgggcccagtctgccctgactcagcctcgcctccgtgtctgggtctccgtggacagtcgactcaccactcctctcgcacgtacggaaccagacaacgtgtacggttaggttacttaataaccttcgtagttctccgttacggtaaccaaacaaccgtaaccccggaactaaaaccgtaccccccgaaactactaagttacgtagttcctttagggacggtccgtaggtcgtaccgtacccgggaccgcggtttaaccggggtttctccgtaacgttccgtccgtttccgtacccggtccgtacccgtaacgttccgtacggtaccgacgtaccgtacccgggcccctttacccggacgtaacccgtacttccggtaccggtcggggtccctaccgtacgggtacccgttcgggaaccgggtaacgggtaccggtacggttaacgttaacgttttaaccgtttaccgccggttaccgaccgtacgttaacctaaccgtttaaaccgaaaccgtaaaaccgaaaccgtaaaacggtttaccgggtttaacgggggtccggttaacccgggggtaacccgggtaccccggggttaaacctaaaccccgtttacggggaaccccccggtttttaaacccggacccggtttaaccggaacccgtaccccgggttaaacccgtaccccgggttacccccgggtttaccccccgttaacccgggtttaacccccttacccggtttacccccgtttaaccccccggg

SEQ ID NO: 125807 - DNA, 723 bp, Homo sapiens
  misc_feature: GYAE6OF02HMHVO.52.76.G10.1.454.CMB.1.raw
  modified_base (53)..(53): a, c, t, g, unknown or other
  misc_feature (53)..(53): n is a, c, g, or t
tcagcgcagtacgacacgaccggtgctcgatttagtcactcatacagggggcnggggtctcaggaggcagcgctctcgggacgtctccaccatggccgtgggctctgctattcctcaccctcctcactcagggcacagggtcctgggcccagtctgccctgacttcagcctgcctccgtgtctggtctctggacagtcgatcaccatctcctgcactggaacagcaatgacgttgtacttataacttctgtctccgtaggtaaccaacaactaccccggactaaacgtcccaaatcatgattctttgagtcagtgactccggccgtgtacgggtttctcgagtctcttcgtccggtctaccgtaagttctaggcacgtccgaccggtcctaccgtcgaccctgttccgtcgtacgggccttacccgggaggtaccgtagggaacgggtaaccgtagggtccgttaggtaaatttttacgtttaccgtacggtaccgtaaacgtcccgtactaacgttaaacccgaaacgtaaaaccgtaaccgtaaacgtttaccgggtttacggggttccggtttaccgggaaccgggtaccggggtaaaccctaaacggttcgggtaaccccgttacggttaaccggtaccaaccgggtacccccgtaagggcccctttaccccggaaccccccgtttacggtacccgttacccgttacccgttaccccgg

SEQ ID NO: 125808 - DNA, 505 bp, Homo sapiens
  misc_feature: GYAE6OF01CQRBE.41.75.G09.1.454.CMB.1.raw
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagtctatactatcacgaccggtgctcgatttagtatagacatcagggacttaggggctttgccaggctcctgctgctctttttgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgcagcctggagatttcgcgacttatactgccaactaatattcttttttatccgttactagttttggcctaggggaccaagctggagatcaaaggactgtggctgcaccatctgtcttcactccttcccgctactctgatatntatgtctgagcggctggnaggcngag

SEQ ID NO: 125809 - DNA, 498 bp, Homo sapiens
  misc_feature: GYAE6OF01AETP6.41.75.G09.1.454.CMB.1.raw
  modified_base (495)..(495): a, c, t, g, unknown or other
  misc_feature (495)..(495): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttattactgccaacaatattctttttatccgtactagttttggccagggaccaagctggagatcaaaggactgtgctgcaccatctgtcttcatccttcccgccatctgatatactatgtctgagcgggctggcaggcgntag

SEQ ID NO: 125810 - DNA, 501 bp, Homo sapiens
  misc_feature: GYAE6OF01C6MS4.41.75.G09.1.454.CMB.1.raw
  modified_base (496)..(496): a, c, t, g, unknown or other
  misc_feature (496)..(496): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctgacaaagcccctaagtccctgatcttttctggatccactttgaagagtggagtcccagccaggttcagcggcagtggttctgggacacatttcactctcaccatcagcagcctgcagcctggagatttcgcgactttatactgaccaaataatattctttttatccgtactagttttggccgagggaccaagctggagatacaaaggactgtgctgcacatctgtcttcatctcccgctatctgatatatactgtctgagcgggtctggcaaggngctag

SEQ ID NO: 125811 - DNA, 511 bp, Homo sapiens
  misc_feature: GYAE6OF01ECRFM.41.75.G09.1.454.CMB.1.raw
  modified_base (488)..(488): a, c, t, g, unknown or other
  misc_feature (488)..(488): n is a, c, g, or t
  modified_base (507)..(507): a, c, t, g, unknown or other
  misc_feature (507)..(507): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaactaattattctttttatccgttactagtttggccgagggaccaagtcgtggagatacgaaaggactgtgctgcacatctgtcttcacttctcccgccatctgatatactactgtctgnggcgggtctggacaggcgngtag

SEQ ID NO: 125812 - DNA, 512 bp, Homo sapiens
  misc_feature: GYAE6OF01EMLC8.41.75.G09.1.454.CMB.1.raw
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtcctgcgtctattggggacagagtcaccagtcacttgccgggcgagtgccgacattaggacttttttggccttggtttcagcaggagcctggcaaagcccctaaagtccctgatcttttctggatccactttgaagagtggagtcccagccaggttcagcggcagtggttctgggacacatttcactctcaccatcagcagcctgcagcctggagattttcgcgtactttattactgccaaacaattattcttttttatccgttactagttttggcaggggacaagctggagatacaaagactgtagctgcaccatctgtcttcattcttcccgcatctgatatatactgtctgagcgggtctgganaacggcgntag

SEQ ID NO: 125813 - DNA, 514 bp, Homo sapiens
  misc_feature: GYAE6OF01CMXTK.41.75.G09.1.454.CMB.1.raw
  modified_base (267)..(267): a, c, t, g, unknown or other
  misc_feature (267)..(267): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattctttctggatccactttgaagngtggagtcccagccaggttcagcggcagtggttctgggacactatttcactctcaccatcagcagctgcagcctggatatttcgcgtactttattactgacctaataattatttctttttatccgtactacgtttggcgtagggaccaagctggagtatacgaaagactgtgctcgacacatctcgtcttcacttcctcccgctatctgatatatactgtctgacgcggtcgtggacgaggcgctag

SEQ ID NO: 125814 - DNA, 547 bp, Homo sapiens
  misc_feature: GYAE6OF01D3M91.41.75.G09.1.454.CMB.1.raw
  modified_base (522)..(522): a, c, t, g, unknown or other
  misc_feature (522)..(522): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctgggacacatttcactctcaccatcagcagcctgcagcctggagtatttccgacgtactttattacctgacccaaactaattatttcttttttaatcccgttactagttttggccgtaggggacctaaggcgtaggagtatacgaaaggtacgtgtggctgacaccatctcgttcttctacttccttcccgccattctagtattactatacttgtctagnggcggtcgaggacgacggcgcgtag

SEQ ID NO: 125815 - DNA, 548 bp, Homo sapiens
  misc_feature: GYAE6OF01C2RP6.41.75.G09.1.454.CMB.1.raw
tcagtctatactatcacgaccggtgctcgatttagtatagacatcagggacttaggggctttgccaggctcctgctgctctgtttccccggtgccaggtgtgacatcgagatgaccccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctggggacacatttcactctcaccatcagcagcctgcagcctggatatttcgcgtacttattactgaccaactaattatttctttttatccgtactagtttggccgagggaccaagctggagatacaaaggactgtggctgcaccatctcgtcttcacttccttcccgcctattctacgtattacgttacttacttcggttcgtaggtacggtcgggtccgtagggaccgtaacgggccgtcgtaag

SEQ ID NO: 125816 - DNA, 619 bp, Homo sapiens
  misc_feature: GYAE6OF01EFRTS.41.75.G09.1.454.CMB.1.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtcgccgactattaggtacttttttggccttggtttcagcaggagcctggacaaacgcccctaagtccctgtattcttttctggactccacgtttgaaggagttggacgtcccagccgtaggttcaggcggctaggttggttcgtggggacactatttccactctacacatcagcagcctgcacgctggagtctttcgcgtacttacttacctgacctaaataatttactttctttttactaccgttattagtttggtacgtagggtacaagtcgtaggacgtagtaacgaaaggtactggtcgtactcgacaccgtactcgttgtccttctaccgttcccttcccgtacctacttccgtagtaacttagttaaccgttacgttcgttcgtacgggtacgggtccgggtaccgtacggaaccggaacggtccgtgtaacg

SEQ ID NO: 125817 - DNA, 789 bp, Homo sapiens
  misc_feature: GYAE6OF01CBIYB.41.75.G09.1.454.CMB.1.raw
tcagtctatactatcacgaccggtgctcgatttagtatagacatcaggggaggaatcagacccagtcaggacacagcatggacatgagagtcctcgctcagctcctgggctcctgctgctctcgtttccccggtgccaggtgtgacatcgagatgacccagtctccgtcctcactgtctgtctctagttggggacagagtcacatcacttggccgggcgagtcgaccgatagttaggttacttttttggccttggtttcagcgaggacgccgtaggaccaaaacgcccccgttaagtccccgtagtactttccttttcgtcggtacttaccctagtttaggaaggtagtcgggaaccgtcccgaggtccgtacggttcgaacggccgggtactacgggtttcggggttcgtacggggaactaacgttactttccaccttccctacaacctactcacgtccgacggtcctacgacctacgggtcccttagggtaacgttacgttttaccggaccgtttaaccttttacgttaaccgttaccgaaacccttaaacttaacttttaacttttaccctttttttaacgtacccgtttaacgtttaccgggtttttcgggaacccgggtaaacggggttaaccccgtaggtaaccggttacggggtaaacgttaccgtaaaaccggttaaacggggttaaccttggggacccgggttacctaccgggtaaccccttaacgttacccgttacgtttaaccggtttcctttaacccgttacgttttaccccccggg

SEQ ID NO: 125818 - DNA, 645 bp, Homo sapiens
  misc_feature: GYAE6OF01DZRVZ.41.75.G09.1.454.CMB.1.raw
  modified_base (264)..(264): a, c, t, g, unknown or other
  misc_feature (264)..(264): n is a, c, g, or t
  modified_base (325)..(325): a, c, t, g, unknown or other
  misc_feature (325)..(325): n is a, c, g, or t
tcagtctatactatcacgaccggtgctcgatttagtatagacatcagggacttaggggctttgccaggctcctgctgctctgtttccccggtgccaggtgtgacatcgagatgacccagtcctccgtcctcactgtctgcgtctagttggggacagagtcaccatcacttgccgggcgagtgccgactattaggtacttttttggccttggtttcagcaggacgcctggaccaaacgcccctaagtccctgtacttcttttcgnggactccacttttgaagagtggactcccagccaggttcagcggcagtggttctgggacacntttcactctcacctatcagcagcctgcagcctggatatttcgcgtacttacttactgaccaactaactttatttccttttttattacccgttacttaggttttcggaccggtacggggaacctaaggccgtaggacgtaactacgaaaaccgtacttggtcggtctcggaccacctaacttccttacgtttcttaccttccttcccgttccccgacccgtacttcgttagtaatttaacgttacgtttacttacggttcccgtaggtaccggggtccggggtacggttaccgggtacgtaaccggggccgtcgtaaacgg

SEQ ID NO: 125819 - DNA, 720 bp, Homo sapiens
  misc_feature: GYAE6OF01CEX3Y.41.75.G09.1.454.CMB.1.raw
  modified_base (273)..(273): a, c, t, g, unknown or other
  misc_feature (273)..(273): n is a, c, g, or t
  modified_base (369)..(369): a, c, t, g, unknown or other
  misc_feature (369)..(369): n is a, c, g, or t
  modified_base (466)..(466): a, c, t, g, unknown or other
  misc_feature (466)..(466): n is a, c, g, or t
  modified_base (710)..(710): a, c, t, g, unknown or other
  misc_feature (710)..(710): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtcgccgactatttaggttacttttttggccttggtttcagcgaggacgccgtggtaccaaaacgtcccctaagtccctgtactttcttttcgnggacttcctacgtttgaagtaggtggacgtcccaggtcctaggttcgacggcggtcgtaggttggtcgtgggactactatttccactctccacctntacgacgcaggtccctagccgacggtccgtaggtacgtactttccgacgtactttatacgtacgacctaattaacgtttcttttacgttttttaacnccgtttacgttacggttttaccgggaccggtaacggggacctaaggtaccgtagggacgtaacgtaaccgaaaggtacttacggtcggtaccgttacgaccgttaaccgtacgtttacgttcgttacccgttacttaccgttaccccgttaccgtacccttacgtccttaacggtacttacttaacgttacgttccggttaccgtagggtaccggtaccgggtcggtacgggaggaaccgggtntaacggtacg

SEQ ID NO: 125820 - DNA, 519 bp, Homo sapiens
  misc_feature: GYAE6OF02GZGUU.41.75.G09.1.454.CMB.1.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagattttcgcgacttattaactgcccaaacaattattccttttttatccgtactagtttttggcctaggggaccaaggctggagatacaaaggaactgtgctgcaccatctgtcttcattccttcccgcctatctgattatactacttgtctgagcgggctggcgaaggcgctag

SEQ ID NO: 125821 - DNA, 606 bp, Homo sapiens
  misc_feature: GYAE6OF02J1AMQ.41.75.G09.1.454.CMB.1.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactgccaaacaattattctttttatccgttactagtttttcggccctaggggtacccaaaggtctagggtacgagttacgaaaagggtaacttaggtacgggcttacggaccgtaacccgtaacgttccgttacgttctttctaacttcccgttacccgacctacgttcctcgtacttacttacttaaccttggtaccttggacggtcggggtcctgggaccgtaacgggtaccgtacgtaacg

SEQ ID NO: 125822 - DNA, 510 bp, Homo sapiens
  misc_feature: GYAE6OF02G8H2F.41.75.G09.1.454.CMB.1.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaaacattattcttttttatccgttactagttttggccaggggaccaaagctaggagatacaaaggaactgtgctgcaccatctgtcttcacttccttcccgctatctgatatatctgtctgagcgggctggcaaggcgatag

SEQ ID NO: 125823 - DNA, 510 bp, Homo sapiens
  misc_feature: GYAE6OF02HYB4W.41.75.G09.1.454.CMB.1.raw
  modified_base (352)..(352): a, c, t, g, unknown or other
  misc_feature (352)..(352): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (464)..(464): a, c, t, g, unknown or other
  misc_feature (464)..(464): n is a, c, g, or t
tcagtctatactatcacgaccggtgctcgatttagtatagacatcagggacttaggggctttgcccaggctcctgctgctctgtttcccccggtgccaggtgtgacatcgagatgacccagtctccgtcctcactgtctgcgtctattggggacagagtcaccatcacttgccgggcgagtgccgacatttaggactttttttggcctggtttcagcaggagcctggcaaagcccctaagtcccctgatcttttctggatccacttttgaagagtggagtccccagccaggttcagcggcagtggttctgggacacatttcactctcaccatcagcagcctgcagcctgganatttcgcgacttatactgaccaacaatattctttttatccgttactagttttgccgagggaccaagcgtgganatacaaagaactgtgntcgcacatctgtctcatcctccnccactctgatagtatactgtctgaggcggcgtggcaaggcgatacg

SEQ ID NO: 125824 - DNA, 547 bp, Homo sapiens
  misc_feature: GYAE6OF02ICKXF.41.75.G09.1.454.CMB.1.raw
  modified_base (250)..(250): a, c, t, g, unknown or other
  misc_feature (250)..(250): n is a, c, g, or t
  modified_base (514)..(514): a, c, t, g, unknown or other
  misc_feature (514)..(514): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaagcccctaagtccctgatctttcnggatccactttgaagagtggagtcccagccaggttcagcggcagtggttctgggacacatttcactctcaccatcagcagcctgccagcctggagtattttcgcgtactttacttactgacccaataatttactttacttttttactaccgttacgttaggtttttcggaccgtacggggaaccgaagtcgtggtaagtagtacgaaaggtacgtgtgctgcaccatctcgtcttctacttcctacccgctattgatatatctntcgtgacgtcggcgtcggcgaggcgacagtacg

SEQ ID NO: 125825 - DNA, 519 bp, Homo sapiens
  misc_feature: GYAE6OF02G1D1J.41.75.G09.1.454.CMB.1.raw
  modified_base (218)..(218): a, c, t, g, unknown or other
  misc_feature (218)..(218): n is a, c, g, or t
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (511)..(511): a, c, t, g, unknown or other
  misc_feature (511)..(511): n is a, c, g, or t
tcagtctatactatcacgaccggtgctcgatttagtatagacatcaggggggggtctcaggaggcagcgctctcaggacgtcaccaccatggcctgggctctgctcctcctcaccctcctcactcaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaaggtaacncccccaaatcatcatctatgagcctataagngcctgagggtttcaatcgcttcactgcctcaagtccgacaacncgctcctgacatctgnggctcaggctagacggacgngctgattattnttgtgctcagtnttgttcgtcgctatcctattatgtaccttagaagtcggactaggtcaccggttctaaggtcacggacccaacggcccaacccgtgtcgtaccaccgttnttccccgg

SEQ ID NO: 125826 - DNA, 615 bp, Homo sapiens
  misc_feature: GYAE6OF02F67UC.41.75.G09.1.454.CMB.1.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagccccctaagtcccctgacttcttttactggactccactttggaagtagttgggactcccagccaggttcagcggcagtggttctgggacactagttcactctcaccatccagcagcctgcagcctggactatttcgcggtaacttattactcggaccaaactaacttatttccttttttataccgttacttacggttttcggtaccggaacggggtaccaacgtcgtagggaagagttacgaaaggtaactggtagcctgaccgtacctagttctcgttacgttctacttccttcccgctaattccgtagtattaacgttaacttaccgtcggttacgttaggtacggtcgggtccttgggaacccggtaagggtccgtacgtaag

SEQ ID NO: 125827 - DNA, 640 bp, Homo sapiens
  misc_feature: GYAE6OF02JNAUJ.41.75.G09.1.454.CMB.1.raw
  modified_base (264)..(264): a, c, t, g, unknown or other
  misc_feature (264)..(264): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccggcgagtgccgacattaggtactttttttcggccttggtttcaggtccgaggtacgcctgggacaaacgcccctaagtccctgattcttttcnggactcctactttgaacgagtggagtccccagccagttcagtcggcagtggttcgtggacacgtattcactcgtcaccgtatcacgcacgcctagccacgccttaggactagttttccggacctatttcgtttaacgtcgaaccctaaacaacctttaagtttccttttttaacgtacccgttactacgtttttacggaccgtacggggtaacgtaagtccgtaaggacgtacgtaacgtaaacggtaacgttcggtagtcgtcggtacaccgtactcgtgttacgtctaacttcctacccgacctacgtcctacgtattacgtaacttaccgtgtacctggaacgttcgggacgttcggacgacggtcgacggta

SEQ ID NO: 125828 - DNA, 838 bp, Homo sapiens
  misc_feature: GYAE6OF02HL3H7.41.75.G09.1.454.CMB.1.raw
  modified_base (315)..(315): a, c, t, g, unknown or other
  misc_feature (315)..(315): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccggggcgagtgccgacattaggacttttttggcctggtttcagcgaggagcctggcaaagcccctaagtccctggtactcttttctgggatccactttgaaggagtggacgtcccagccaggttcagcggcagtggtctgggacnctatttccactctcaccacgtcaacgcgacggccctggaccacggcccttagggacgtaacgtttttccggaccgttaaccgttttaacgtttaacgttcggtaacccctaaaacctaaattttaccttttaacgttttttttaaccgtaccccgtttaactttaacgggttttttacggggaacccggttaaccggggggtaaccctaaacgggtaccgttaggggtaaacggtaccttaaacggaaaacggggtttaaccggttacgggttaacgggggtacctttccggggaaccctaacccgttacgttttacccggttcggttttacccttttacgttaacccgttttaccccgttttacccccggtacccttaaccgtttccgttacggtttaacctttaacgtttaaccgtttaaccggtttttaccgggttacggttaacggtacggggttccccggggtacgggttaacccggggttacccggggtaaacgggggtcccggaacgttaaccggg

SEQ ID NO: 125829 - DNA, 746 bp, Homo sapiens
  misc_feature: GYAE6OF02I1O5P.41.75.G09.1.454.CMB.1.raw
tcagtctatactatcacgaccggtgctcgatttagtatagacatcaggggaggaatcagacccagtcaggacacagcatggacatgagagtcctcgctcagctcctggggctcctgctgctctgtttccccggtgccaggtgtgacatcgagatcgaccagtctccgtcctcactgtctgcgtctagttggggacagagtcaccatcacttggccgggcgagtcgccgactagttaggtacttttttggccttggtttacagcgaggacgccgtggacaacgcccctaaggtccctagtacttccgttttcgtacggtacttccgtacgttttaggaacggtaggttcgggtacgtccccgaggtccgtaagggttccacggtccggcgtaggtttcgggttcgtacggggaactacgttactttcctacgttcctaccacctactcgacgtccgtacgtccgtgaccgtacgtcccgtagggtacgttacgttttccggaccgttaacgttttaacttaccgtacgaccctaaacgttaacgttttacgttttaaccgttttttacgtacccggtttaacgtttacgggtttttacccggaccgggtaaccggggtaacctaacggttaccgtagggtaacgtacgtaaccggtaaacgggtaccgttacgggtacggtccgttacggtacccttaaccgtccgtttaccggttccgtttaccgtttacctacccgtttccccgg

SEQ ID NO: 125830 - DNA, 671 bp, Homo sapiens
  misc_feature: GYAE6OF02HNKQ5.41.75.G09.1.454.CMB.1.raw
  modified_base (255)..(255): a, c, t, g, unknown or other
  misc_feature (255)..(255): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcagtgccgacattaggacttttttggcctggtttcagcaggagcctggcaaagcccctaagtcccctagtacttcttttcnggactccacttttgaatagtggagtccccagccaggttcagtcggacagtcggttcctgggactacgatttccacgtcctcaccgatcagcctagcctgccagcctggatactttcgacgtactttattacgtcaccaaactaattcttttacttttttacgtccgtttacttagtttttcggaccgtaggggtaaccaacggtcgtacgggagacgttaacggaaacggtaaccgttggtacggtaccttacggaccctaacggtaaccttacgtccggtttaccttaccgtaaccgtttcccctttaccccggaccttacttcgggttactaactttacggttactaaccgttcggtaccgttacggaccgggtccgggtaacggttcggacggtaacggcccggttataacgg

SEQ ID NO: 125831 - DNA, 814 bp, Homo sapiens
  misc_feature: GYAE6OF02HWVH7.41.75.G09.1.454.CMB.1.raw
  modified_base (120)..(120): a, c, t, g, unknown or other
  misc_feature (120)..(120): n is a, c, g, or t
tcagtctatactatcacgaccggtgctcgatttagtatagacatcagggacttaggggctttgccaggctcctgctgctctcgtttccccggtgccaggtgtgacatcgagatcgacccngtcctccgtcctcactgtctgcgttcttagttgggacagagtccaccatccacgttcggccgggacgagtcgcccgtactagtttacggttacgttttttcggccgttggtttacaggtccgaagggtaccggccgttacgggaacctaaaaaccggtccccccgttaaacggttaccccgttagttacttttcccgttttttaccgtacgggtaaccttaccgttactttttaacgggaacggtaaggttacgggtaccggttacccccagggtaccccttaacgggttccgaacgggtcggacgttacggtttcggtttaccgggtaggggtacctaacttaccggtttacctaacccggtttcctaaccgtaacccctacgttaacgacggtaccgtacgcccgtacgaccgtaccgggtacgtaggtagtacctttcggaagtttaccttaactacacgtactaaactatttcgttttctttacgtacgttagttcgtttacggacgtaggccgatgaggtagtaagaacgtaacgtatgggtacgactccgactaccgtattccgtactttaccttcgaacctttcccgacccgttctaacgttcctaaggttacttaacgttcgttaacccgttagttacgacgggtcggacgggttccggtaacggtaaccggtcggacgtcgaacg

SEQ ID NO: 125832 - DNA, 744 bp, Homo sapiens
  misc_feature: GYAE6OF02HPFJP.41.75.G09.1.454.CMB.1.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctatggggacagagtcaccatcacttggccgggcgagtcgccgacattaggtacttttttcggccttggtttcagccaggagcctggaccaaacgcccctaagtcccctagtacttcgttttcgtggtacttcccaacgttttaggaaagtaggtcggacgttaccccgacggtacccgtacggtttacgacggccggtaccgtaggttcgggttccgtacgggtaaccaaccgtaattttccaaccgttcccgtacctaaccgaacttacaacggcctacgaccgttcgaccgacggtacccgtagggtacgtactttccggacgtaactttacgttaactacgaccctaaactaaactttagttttacctttttagtacccgttaacgtttagttttcggaccgtaacgggtacctaggtacgtaggaataacgtaacgaaaaggttaccgtggtacggtcctacggtactaacccgtagttccgttacgtccttacgttaccttcccgttacccgtacttccgttacgtacgtaactttaacgtcttaacgtccgttacgtcggaggtccgggtcgtaggtaccggaacggcgtactagg

SEQ ID NO: 125833 - DNA, 680 bp, Homo sapiens
  misc_feature: GYAE6OF02H85L4.41.75.G09.1.454.CMB.1.raw
  modified_base (264)..(264): a, c, t, g, unknown or other
  misc_feature (264)..(264): n is a, c, g, or t
  modified_base (673)..(673): a, c, t, g, unknown or other
  misc_feature (673)..(673): n is a, c, g, or t
tcagtctatactatcacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccggcgagtgccgactagttaggtacttttttggccttggtttcagcaggagcctggaccaaacgccccttaaacgtccctagtacttcttttcgnggtacttccctacttttgaaacggtagtggtacgtcccagcctaggttcagtcggcagtggttctgggacactagtttcactctccaccatcgagtcacgtcctgcctacggcctgggactacgtttcgacgtactttacgttactcggtaacctaagtaactttacttttccttttttaacgtacccgtttaacgttaaccgggtttttcggacccggtaaacgggggtaacctaacggtccgttaggacgtaacgtaccgtaaagggtacctggttcgacctacgccgtaacctagttccgttgttaccttctacgttcccgttacccggaccttacgtctacggtacttaacgtacttaccgtgttacgtacggtggtaccgggacttcgggacgtacggtaccgngtaacgg

SEQ ID NO: 125834 - DNA, 594 bp, Homo sapiens
  misc_feature: GYAE6OF02FJLNL.41.75.G09.1.454.CMB.1.raw
  modified_base (491)..(491): a, c, t, g, unknown or other
  misc_feature (491)..(491): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
  modified_base (555)..(555): a, c, t, g, unknown or other
  misc_feature (555)..(555): n is a, c, g, or t
  modified_base (582)..(582): a, c, t, g, unknown or other
  misc_feature (582)..(582): n is a, c, g, or t
tcagtctatactatcacgaccggtgctcgatttagtatagacatcagggacttaggggctttgccaggctcctgctgctctgtttccccggtgccaggtgtgacatcgagatgaccccagtctccgtcctcactgtctgcgtctattggggacagagtcaccatcacttgccgggcgagtgccgacattaggacttttttggccttggtttcagcaggagccgtggcaaacgtcccctaagtccccgtgattctttttctggcttccactttagaagagtggagtccagccgaggttcagcggctagtcggttctggggacaacgtatttaccacgtctaccaccgtactcgacgctacgcctggcacggtctacggtatacgtttcgacgtaacttattaccttacgaaccaaactagttactttcttttttacgttacttaacgttagttttcggaccggtacgggaccgtaaacgtcgtaggacgtanacgaaaacgactagtcgctnacacgtatctntctctacgtccttccncatntacgtatacgttntacttgtcgtggacgcggttgaaaggngacgtctatacg

SEQ ID NO: 125835 - DNA, 807 bp, Homo sapiens
  misc_feature: GYAE6OF01CSJD6.26.40.D07.1.454.CMB.1.raw
tcagagactatactcacgaccggtgctcgatttagtgatagagcgtaacaacaggagggggagagcagcacccagcaaccacatctgtcctctagagaactccctgagagctccgttcctcaccatggactggaccgtggaggactcctcttcgttgggtggcagcacgccacgacggaccgtcccccgtcccgagggtcgcctacggttgggtcgcaggtcggtggggctgggaagggagaaaggaacggtccggtcggggcctcgaggtacggaacggttcctccgtaggacgtaacggtccttcgtgactaacttaccttacctacgaacgaaccctaaacctactacacgtcggacgtacggttggcgaccgacgaccggcccgtagggtaacgacgggtctaggaggtaggacggtcgggactacgaaccgttacccaaaccgtagtcggtacgggtacgaaacctaaagtaacgtacgacgaactaaaggtaacggtacggttacgggaacgggtacgtaggtacctacgtacgtaacggtaccggaacggaacggtacccgacgtaccgtacgtacgacgtaccgaaccgtacgtaccgtaaggtacggtaacgggtaaccgtaggtaaccggtaacggtacggtaacggtacgtaaccggttaccggtaaccggtaacccgggttcccgggtttaacccggttttaccggttttacggtttaccggtaacggttaacggggtaaaaccggtaacggtaacccggttaaccgggtaaggggttaaaccgggtaaacccgg

SEQ ID NO: 125836 - DNA, 741 bp, Homo sapiens
  misc_feature: GYAE6OF01DX182.26.40.D07.1.454.CMB.1.raw
  modified_base (580)..(580): a, c, t, g, unknown or other
  misc_feature (580)..(580): n is a, c, g, or t
tcagagactatactcacgaccggtgctcgatttagtgatagagcgtaacaacagagggggagagcagcacccagcaaccacatctgtcctctagagaactcccctgagagcctccgttcctcaccatggactggacctggagactcctcttcgttggtgcagcacgccacgacggaccgtccccctcccgaggtcgacgtacgttggtgcgtaggtcggtgggctggaggtagaaaggacgccggtgggccctagaggtaggtaacggttcctccgtaggacgtaacggtccttcgacgtactaattaccttaccttacaagacctaaaccactagtacgcgacgacgttggcacgaccggaccgcccgtaggaacgtacgggtcttacggaggtaggtacgcggtacgacgtaacctacccgtaacccgaaacgtcggttacggtacggaacctaaaacggtaaagttcgacgtaaccgtaaacgtaacggttaacggttaacggacgggtaacgtacgttactacccgttaaacgaccgttacggaacccgggtaacggtaacccgacttaccgaacnccggaaacgccgaaccaacgtctaaccggtagtaacgggtaacctggtaaactgtacgtagagtacctgaaccggtacgttaccggtcgttttaaaccgttgttacccggtaagtaacccgggaaacttacggtaaccgtacgggaacgtcgggtaaaccg

SEQ ID NO: 125837 - DNA, 706 bp, Homo sapiens
  misc_feature: GYAE6OF01DSKXQ.26.40.D07.1.454.CMB.1.raw
tcagagactatactcacgaccggtgctcgatttagtgatagagcgtaacaacagagggggagagcagcacccagcaaccacatctgtcctctagagaatcccctgagagctcccgttcctcaccatggactggacctggaggatcctcttcttggtggcagcagccacgaggacgtcccctcccaggtgcacgttggtgcagtcgtggggctggaggtgaagaagccgtggggcctcagtgaggtctccgtgcaaggtcttcgtgactatactaccttcagccaaccactacatgcacggtggggtcgacgaccgacggccccgtaggaaccgaaggggtcttaggacggttggatggggactgaacctaccccaaccctaacgacgttcgggacgacgaaactaaagttgtacgacaacgtaaggttaagtttacggacgggtacgaacggtacttaccgtaccgtaacgtacggaacccggaacgggtaacctaccggttacccgaacgttaccgaacgtacccaaccgtacgtaacccgtacgtaacgtacgggtaaaccgtcggtaaacgttaacggtaccgtaagggtaagttacgttacgtacggtaaccgttacccggtttacggggtttacccgtttttagtttaccgttgggtaacgtaacggtaaacggtagtaccggtacggacgggttaaccgg

SEQ ID NO: 125838 - DNA, 586 bp, Homo sapiens
  misc_feature: GYAE6OF01E2UVK.26.40.D07.1.454.CMB.1.raw
  modified_base (254)..(254): a, c, t, g, unknown or other
  misc_feature (254)..(254): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
tcagagactatactcacgaccggtgctcgatttagtgatagagcgtaacaacagagggggagagcagcacccagcaaccacatctgtcctctagagaataccctgagagctccgttcctcaccatggactggacctggaggatcctcttcttggtggcagcagccacaggagtccccctcccaggtgcacttggtgcagtctggggctgaggtgaagagcctggggcctcagtgaggtctcctgcaaggcttcngcatataccttcagcaaccactacatgcactggggtgcgacacggcccctggacgaagggcttggagtggatgggactgactcccaccctacacgtggtgcaacaaagtntgcaanagtaagttcgaggcaggtatcgtcagtcgaccgagggacacgtccatcgaagccaacgacgacctacgtacgtacgggtaactggaacgtaacgacgtaggaacgtacgtaccgtacggtacccgtaccgttccggggttacccgtttttacgtttccgttagggttacggtaaccggtaaaggtacgttaccgggtaacggtaagggttacccgg

SEQ ID NO: 125839 - DNA, 708 bp, Homo sapiens
  misc_feature: GYAE6OF01A4LR8.26.40.D07.1.454.CMB.1.raw
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
  modified_base (666)..(666): a, c, t, g, unknown or other
  misc_feature (666)..(666): n is a, c, g, or t
tcagagactatactcacgaccggtgctcgatttagtgatagagcgtaacaacaggagggggagagcagcacccagcaaccacatctgtcctctagagaactcccctgagagcctccgttcctcaccatggactggacctggaggatcctcttcgttgggtggcagcacgccacgaggaccgtccccctcccgaggtcgctacgttggtgcagtcggtggggctggaggtagaagacggtccgtcggggcctcgaggtggacggtctcgtgacgaggtcttngctatacttacctcacgtaccaaccgtactanactcgacgtacggttcggggacgaccgaaccggtccgggtaccccgtaagggaaccggtaacgggtcgttaagggacgggtcggtaagggtcgggtacctacgtaaccctacccgtaaaccgttaccgaacgggttcggaacgaacctaaacggtaaagttgtaaaccgggactaaacgggtaggttaacggttacggaacgggtacgacggtcctactacgtaaggccggtaacggaccgtaacgaccgtacctagacacgaccaagaccactagttacggacgtaacgtaggtacgtaagtacgaagaccgttatacggtacgtaaccgttcggttacgttacgttttacngttacggagtaaacggactacggtaacggacggtaggttaac

SEQ ID NO: 125840 - DNA, 968 bp, Homo sapiens
  misc_feature: GYAE6OF01AWAWH.26.40.D07.1.454.CMB.1.raw
  modified_base (307)..(307): a, c, t, g, unknown or other
  misc_feature (307)..(307): n is a, c, g, or t
tcagagactatactcacgaccggtgctcgatttagtgatagagcgtaacaacagagggggagagcagcacccagcaaccacatctgtcctctagagaatcccctgagagctccgttcctcaccatggactggacctggaggatcctcttcttggtgcagcagccacaggagtcccctcccaggtgcacgttggtgcagtcgtggggctgaggtgaagacgccgtggggcctcagtgaaggtctactgcaaggcttctgcatactaccttcagtcaaccgacctaacacgtgccgtacgtggggtacncggaccgacgggtcccccttagggaaccgtaaaggggtccgtttaggaacgggttacgggacgttacgggggaaccgttaggtaaccgttaccccgaaacccccgttaaacgtaaccccgggttagggggtttaccggaacccgtaaaaccgtaaaaacgggtttacgtaccggtacccgtaaacgtaaacgggttaaacggtttttacccggaaacggggggtaccgtaaaccggggtaacgtttaacccccgttaacccggtaacggtttaacgggtaaacccccggaaacggggggttaaacccgtaaaccccggttaacccccgtaactttaaccccgggaacggtaacccggaaaccccgtaaccgggttaacccccgttaaacccggaaacggtttaaacccgggggttaaaccccgttaaggggtaaaccgggttaaccgggtaccggttaaacggaacgggttaacccgttaaacccgggtaaccggggttaaacccggttaaacccgggttttaccccgggggttttaacccggttttttaaaccggttttacccggtttaacggggtttaacccgggtaaaaccggttaaaaccgggttaaccgggttaacccggttaaaccggggtaaacgggggtttaaacccccgggg

SEQ ID NO: 125841 - DNA, 575 bp, Homo sapiens
  misc_feature: GYAE6OF02FZ4TL.26.40.D07.1.454.CMB.1.raw
tcagagactatactcacgaccggtgctcgatttagtgatagagcgtaacaacagagggggagagcagcacccagcaaccacatctgtcctctagagaatcccctgagagctccgttcctcaccatggactggacctggaggatcctcttcttggtggcagcagccacaggagtcccctcccaggtgcacttggtgcagtctggggctgaggtgaagaagcctggggcctcagtgaaggtctcctgcaaggcttctgcatataccttcagccaaccactacatgcactgggtgcgacacggcccctggacaagggcttgagtggatgggactgactcccaaccctaacacgtggtggacaacgaaagtatcgacaacaggtaagtttacgagggacgaggactcctaccagtcgaaccgagggaccacgtaccatccgacgaccaccgacgtaccctacacgtacgggaactaggaacgtaacgtacgtaggacgtatacgtagaccggtacgttaccggttccgttttatttccgtggtacggtacgtaaagtacgtaccgtacggaggtaccgg

SEQ ID NO: 125842 - DNA, 977 bp, Homo sapiens
  misc_feature: GYAE6OF02FIHZY.26.40.D07.1.454.CMB.1.raw
  modified_base (364)..(364): a, c, t, g, unknown or other
  misc_feature (364)..(364): n is a, c, g, or t
tcagagactatactcacgaccggtgctcgatttagtgatagagcgtaacaacagaggggagagcagcacccagcaaccacatctgtcctctagacgaactcccctgacgacgcctccgttcctcaccagtgacctggacctggacggtactcctcttcgtggtgcagccagcccacgacggaccgtccccctccgaggttcgctacgtttggtcgcgtacggttcggtaggggtcctaggtacgggttagaacggtaccggtccccggttcggggaccctacgtacggtacgtaaccggttccctccgtacgaccgtaacggtcctttacgcgacctactaccgttacccacacgtaccaaccnctacacgtcgcgtacgttcggacgacgaccggtaaccggtcccggtaacggacggtacgggtactagggtacggtacggtacggttaccgaacccgtaaccgtaccccgtaaccccgtaaaccggttacccggtacggttaaccggggtactaaacccgtaaaacggttaaaacccggttccggttaccggaaaacccgttacgggtaaaacccgggttttaacggaacccggggtaacccgttaacccggtaaaccgttaccccgtttacccggaaacccgtttaacgggaaccccgaacccgggtaacccgtacccgttaaccgtaccccgtaaacccgaccgtaacccgtaaccctaaccggttacccgttaaaaccggtaacgttaaaccgggtaaaccgttaacgggtaacggtttaaccggggaaacttacccgggttaacgaacccggtttaaccgttcccgggtttaaccgtccccgggtttttaaccgggttaacggtttaacccggttttaaggaacccgggttaaaggtaaccccggttaaacgtacccggggttaccggtaaaccggttaaacccggggtttccccttaaaaaaccccggg

SEQ ID NO: 125843 - DNA, 550 bp, Homo sapiens
  misc_feature: GYAE6OF02I2MAI.26.40.D07.1.454.CMB.1.raw
  modified_base (343)..(343): a, c, t, g, unknown or other
  misc_feature (343)..(343): n is a, c, g, or t
tcagagactatactcacgaccggtgctcgatttagtgatagagcgtaacaacagagggggagagcagcacccagcaaccacatctgtcctctagagaatcccctgagagctccgttcctcaccatggactggacctggaggatcctcttcttggtggcagcagccacaggagtcccctcccaggtgcacttggtgcagtctggggctgaggtgaagagcctggggcctcagtgaaggtctcctgcaaggcttctgcatataccttcagcaaccactacatgcacgtgggtgcgacaggcccctggacaagggcttgagtggatgggactgactccaccctaanacgtggtggacacaaagtatgcaacgagtaagtttcgagggcaggatctacatcgaccgagggacacgtccatcaagccacacgcctacgatacggaactagagtaacgactaggaagacttacgtagaaccggtacgttaccggttaccgttttaattttcgtagttaggtaccggtaaagtacgtacggacggtagggtaaccgg

SEQ ID NO: 125844 - DNA, 532 bp, Homo sapiens
  misc_feature: GYAE6OF02GP71B.26.40.D07.1.454.CMB.1.raw
tcagagactatactcacgaccggtgctcgatttagtgatagagcgtaacaacagagggggagagcagcacccagcaaccacatctgtcctctagagaatcccctgagagctccgttcctcaccatggactggacctggaggatcctcttcttggtggcagcagccacaggagtcccctcccaggtgcacttggtgcagtctggggctgaggtgaagaagcctggggcctcagtgaaggtctcctgcaaggcttctgcatataccttcagcaaccactacatgcactgggtgcgacacggcccctggacaagggcttgagtggatgggactgactccaccctaacactggtggcaacaaagtatgcaacagtaagtttcgagggcaggatctccatgaccgaggacacgtccatcagcacacgcctacagtaggaactagaagtacgacgtagagtatcgtacggacgtacgttccggtaccgttttagtttcgttggtacgtacggtaaagagtacggtacgtagggtacgg

SEQ ID NO: 125845 - DNA, 659 bp, Homo sapiens
  misc_feature: GYAE6OF02GRC5Z.26.40.D07.1.454.CMB.1.raw
  modified_base (261)..(261): a, c, t, g, unknown or other
  misc_feature (261)..(261): n is a, c, g, or t
tcagagactatactcacgaccggtgctcgatttagtgatagagcgtaacaacagagggggagagcagcacccagcaaccacatctgtcctctagagaatcccctgagagcctccgttcctcaccatggactggacctggaggatcctcttcttggtggcagcagccacaggacgtccccctccaggtgcacgttggtgcagtcgtggggctggaggtgaagagccgtggggcctcagtgaaggtctccgtgcaggtcttcngactatactaccttcacgaccaaccactacagtgctacgtgggtcgaccgacgaccggcccctagggaaccgaaggggtcttaggaggtacggagtacggggtactcggacctaccccgtaaccctaacgacgttgggacgaactaaacgaaagttgacgactaacggtaagtaacgttcggacgggtacgaaggtactccgtacgtaacgtaccggaccggacgggactaccggtacctacgtaccgacgacctaccgacgtaccgtaacgtacggtaacggtaacgtacggaagttacgacgtagacgtacgtcggagtacccggtcggtttaccggttaccgttttagttcgtacggtacggacggtaaacggtcgtacggtacggacggtaccg

SEQ ID NO: 125846 - DNA, 620 bp, Homo sapiens
  misc_feature: GYAE6OF02G82U8.26.40.D07.1.454.CMB.1.raw
  modified_base (262)..(262): a, c, t, g, unknown or other
  misc_feature (262)..(262): n is a, c, g, or t
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
tcagagactatactcacgaccggtgctcgatttagtgatagagcgtaacaacagaggggggagagcagcacccagcaaccacatctgtcctctagagaatcccctgagagctccgttcctcaccatggactggacctggaggatcctcttcttggtggcagcagccacaggagtccccctcccaggtgcacgttggtgcagtctggggctgaggtgaagaagccgtggggcctcgagtgaaggtctcctgacaaggtcttcngcatactaccttcagacaaccactacatcgctacgtgggtcgcgacgacggcccctagggacgaaggggcttggaggtgggagtgggactgactccaaccctaacncgtgggtcgacaacgaaagtncgacaacgagtaagttacgacgggacgagggtactccgtacgaagtacggaaccggacgggtacctaccgtaccaacgtccgacgaccaaccgacgacctaacgacgtacggaacgtagaaggttaacgacgtagaacgtatcgtaggtaaccgtacggttccggtttaacgtttttacgttcgttaggtacggtaacgtaaaggtacggtaccggtaggtacggtaccgg

SEQ ID NO: 125847 - DNA, 806 bp, Homo sapiens
  misc_feature: GYAE6OF02JTXTI.26.40.D07.1.454.CMB.1.raw
  modified_base (65)..(65): a, c, t, g, unknown or other
  misc_feature (65)..(65): n is a, c, g, or t
tcagagactatactcacgaccggtgctcgatttagtgatagagcgtaacaacagagggggagagnagcaccagcaaccacatctgtcctctagagaactcccctgagagctccgttcctcaccatggactggacctggaggactcctcttcttgggtggcagcagccacgaggacgtcccctcccagggtcgctacgttggtcgacagtcggtggggcgtaggagggtagaaggaacggccggtggggccctcgaggtaggtaacgggtcctccgtacgccgtaaggtccgtttacgtcggtactaagttacttaccctttcaacgaccaaccctactaactaacgtgtaccaacggttgggtacgaccggacggtacgggtcccccggtaagggaaccggaaacgggtcgtttacgggtaggtagggtaggtacgggtaccgttggacctacccgtaaccctaaacggtcggttacgggcggaactaacggtaaaactcggtacgtcaacggtaacggtttaagtttacgggaacggggtaccgtaacggggtaacttccgttaccgaagtttaaccgggaaaccggtaccgggtacgtaacccgttccggaaacgttacccgacgaaccgaaccggtaccgaacgttaaaccgaacggtttaacggaacggttacgtaaacggttaggaaccggttagaacggttactaccggtaagggtaccgttaacggttaccgtttcgtttaagttttcggtaacggtttaagaaccggtaacgacgtaacggttacgcgggttaaccgg

SEQ ID NO: 125848 - DNA, 739 bp, Homo sapiens
  misc_feature: GYAE6OF02HKGUQ.26.40.D07.1.454.CMB.1.raw
tcagagactatactcacgaccggtgctcgatttagtgatagagcgtaacaacagagggggagagcagcacccagcaaccacatctgtcctctagagaatcccctgagagctccgttcctcaccatggactggacctggaggatcctcttcttggtggcagcagccacaggacgtcccctcccaggtgcacttggtgcagtcgtgggctgaggtgaagacgccgtggggcctcgagtgaacggtctccgtgcaaggtcttctgctattactaccttcgagaccaaccactaccatcgctacgtggggcgaccggacgaccggccccgtagggaaccgaaggggtcttggaggttagggtacggtaggggactacggacctacccgtaaccctaacgccgttacgggtacggaacctaaacgtaaacgtacgtacggaccaacgtaaggttaaccggtttacggaacggggtaccgtaacgggtaccttacccgttaccgtaacgtaccgggtaaacccggtaacggggaacccttaacccggtaccctacgttaccgaacggaccaaccgtaccgaacccgtacgtaacgttacggaacgtacggtaaacgttaacggagttaaggaacgttacgtacgttacggtaaccggtaccggtttaccgggtttaccgttttacgttcggtaacggttacggtaacggtaaacgttacggtaaccggtacggtacggtaaccgg

SEQ ID NO: 125849 - DNA, 733 bp, Homo sapiens
  misc_feature: GYAE6OF02HFX2K.26.40.D07.1.454.CMB.1.raw
tcagagactatactcacgaccggtgctcgatttagtgatagagcgtaacaacagagggggagagcagcacccagcaaccacatctgtcctctagagaatcccctgagagctccgttcctcaccatggactggacctggaggatcctcttcttggtggcagcagccacgaggacgtcccctcccaggtgcacgttggtgcaggtcgtggggctggaggtagaaggaacgccgtggggcctcgagtaggtaacggtcctccgtgacgaacggtcttctgactatacttacctcacgaccaaccgtactactaagtcgactacggtggtacggcgacgaccggcccgtagggaacgacgggtcgttaggacggtggagtacggtactcgacttacccgaacccttaacgacggtcggtacgaaccgtaaacgtaaacggttacgtaacggacctaacgtaaacggttaacggttagggaacgggtaacggtaacgactttaccggtactaacggtacgggtaacccggaacgggaccgtaaccgtacccgtaagtaccgaacggtaccctaacggtaccgaaccccgttaacggtaaaggtacccgtaacggtaacggttaaccggtacgaaccgtaagtactagttacccgtaggtaacccggtccggttaccggtttactttaccggtttcgagttacggacgttaaacgccggtacggaccggtaggtaccgg

SEQ ID NO: 125850 - DNA, 685 bp, Homo sapiens
  misc_feature: GYAE6OF02F7O41.26.40.D07.1.454.CMB.1.raw
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (676)..(676): a, c, t, g, unknown or other
  misc_feature (676)..(676): n is a, c, g, or t
tcagagactatactcacgaccggtgctcgatttagtgatagagcgtaacaacagagggggagagcagcacccagcaaccacatctgtcctctagagaatcccctgagagctccgttcctcaccatggactggacctggaggatcctcttcttggtgcagcagccacgaggacgtccccctccgaggtcgctacgttggtcgctagtcgtggggctggaggtagaagaacgccgtcggggcctcgagtggaacggtcctccgtgcaaggtcttcgngacctatacgttaccttcgagacccaaacctccgtaanagtcgctaggtgggtcaccgacgaccgggcccgtaggaacgtacggttcgttaggaggtggagtcgggactacgactaccccgaactaacgtcggtaggacgacaaacgtaagtgacgacgaacgtaagttacgttcggaaggcgtacgtactaccgtaccgtacggtacgaaccggtagtaccgtaccgtactaacgtccgaaccgtacaacccggtaatacccgtaagacggtaacgtaccggtagtaaccgtaagtacgtaggtacgtaccttacggaacgtaccggttaccgttaccggtttaccgttttagtaccggtggttaaacggacgttaaacggtccgtacgggttaaccggnggtaacccg

SEQ ID NO: 125851 - DNA, 789 bp, Homo sapiens
  misc_feature: GYAE6OF02IX349.26.40.D07.1.454.CMB.1.raw
  modified_base (119)..(119): a, c, t, g, unknown or other
  misc_feature (119)..(119): n is a, c, g, or t
  modified_base (467)..(467): a, c, t, g, unknown or other
  misc_feature (467)..(467): n is a, c, g, or t
tcagagactatactcacgaccggtgctcgatttagtgatagagcgtaacaacagagggggagagcagcaccagcaaccacatctgtcctctagagaatcccctgagagcctccgttccncaccatggactggacctggaggatccttcttcgttgggtcggtcagcacgccaacgaggaccgtccccctccgacggtgctaccttggtacgctacgtcgtgggggctggtacggtagaacgtaacggtcccggtcggggtaccctcgtacggttacggaaacggttcccttccgtacggccgtaaacggggtctttaccgtacgtacgtaacttaaccgttaccgttaccaaccgtaacccaaaccctacctactaaccggtgtaaccgtacggttacgggtacaccggtaacgaccggaccccgttagggaaccgtacggtagttcgaggttggacggtggtaacncgactacccctaacctaagtcgtcgacgaactaaagtaacgtatacgtacccgaagttaacgttaacggttacgggaacgggtacctaacggtcttaccggtaacgtacgtacggaacccggtaagtaacccggttacctaacgtacgaccacggtacctaccggacttaccggactacggtaagttaccgtaagttacccgaggtacgtacgtaagttacccgtagtacccggttaccgttaccggttaccgttttacggtttaccgtacgttccgttaacgggaacgtaacctaggtacccggtaggacgggttaaaccc

SEQ ID NO: 125852 - DNA, 537 bp, Homo sapiens
  misc_feature: GYAE6OF01CETXC.30.14.B03.1.454.CMB.1.raw
  modified_base (529)..(537): a, c, t, g, unknown or other
  misc_feature (529)..(537): n is a, c, g, or t
tcagcacgctacgtcacgaccggtgctcgatttagtgtgagtagttccgcgggggacctcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggctttttcctggaagcagggctattttgttgcttcagcaccgtagtgcctcgtcatcacgcctcagccttgattttccggatttgcctggaaaaccagcctacacgcttaaaccgggacaaccgtcgcccggccaacatacgccttctcccgtccccccttcgcacgtaacaccaagtacaaggtaatacttaacctgtttacccatacgactacgtcctttcggccctcgccgttaggggtccactcaccctcgccccgtattaacgtggaccacggacccttggtccttccggcgaggcgggactggcgaaggcgcatagnnnnnnnnn

SEQ ID NO: 125853 - DNA, 754 bp, Homo sapiens
  misc_feature: GYAE6OF01DE2DV.30.14.B03.1.454.CMB.1.raw
  modified_base (333)..(333): a, c, t, g, unknown or other
  misc_feature (333)..(333): n is a, c, g, or t
  modified_base (726)..(726): a, c, t, g, unknown or other
  misc_feature (726)..(726): n is a, c, g, or t
  modified_base (734)..(738): a, c, t, g, unknown or other
  misc_feature (734)..(738): n is a, c, g, or t
  modified_base (740)..(749): a, c, t, g, unknown or other
  misc_feature (740)..(749): n is a, c, g, or t
  modified_base (751)..(753): a, c, t, g, unknown or other
  misc_feature (751)..(753): n is a, c, g, or t
tcagcacgctacgtcacgaccggtgctcgatttagtgtgagtagttccgcgggggacctcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggtctttttccgtggaagcgagggctattttggttcgctttcagccgaccgtagtcgccttcgtcatccgacgtcctgacgtcctttagtacgttttaccggtattttccggacctaacggaaaaccncgtacctacgaccggtaaccgttaaaacccggggaacctaaccggtcccggacccggaccaaactacttaacgtccctttacccgttccccccgttacccccgttccgaacgtaacgttaaaccaaccgtaaacgtaacgaaacggttaaacttaacgttttaaaccctttcggtttaccccaatccgtaccgttacccgtcccgttttacggcccttaccggtaccggtttaccggggtacctacccgttaccccgtaaccccgttaccggtaccccccgtttaaagtttaaaccggttacgggaaccgtaaccgggttaaccccgtttcggttcccggtccggtacggtacggtcggggtccgtagggaccgaagggccgtaacgttacgngcatcgannnnngnnnnnnnnnncnnnc

SEQ ID NO: 125854 - DNA, 213 bp, Homo sapiens
  misc_feature: GYAE6OF02H10YA.30.14.B03.1.454.CMB.1.raw
  modified_base (142)..(142): a, c, t, g, unknown or other
  misc_feature (142)..(142): n is a, c, g, or t
  modified_base (155)..(155): a, c, t, g, unknown or other
  misc_feature (155)..(155): n is a, c, g, or t
  modified_base (159)..(159): a, c, t, g, unknown or other
  misc_feature (159)..(159): n is a, c, g, or t
  modified_base (161)..(161): a, c, t, g, unknown or other
  misc_feature (161)..(161): n is a, c, g, or t
  modified_base (163)..(164): a, c, t, g, unknown or other
  misc_feature (163)..(164): n is a, c, g, or t
  modified_base (166)..(167): a, c, t, g, unknown or other
  misc_feature (166)..(167): n is a, c, g, or t
  modified_base (169)..(169): a, c, t, g, unknown or other
  misc_feature (169)..(169): n is a, c, g, or t
  modified_base (171)..(173): a, c, t, g, unknown or other
  misc_feature (171)..(173): n is a, c, g, or t
  modified_base (175)..(213): a, c, t, g, unknown or other
  misc_feature (175)..(213): n is a, c, g, or t
tcagcacgctacgtcacgaccggtgctcgatttagtgtgagtagttccgcgggctggcaaggcgcatagggggctgggcaaggcgcatagggggctgggcaagggcgcgatagggagcggggctgggcaagggcgcataggncggctggacagcnatgngngnngnngngnnngnnnnnnnnnnnnnnnnnnnnnnnnnnnnnnnnnnnnnnn

SEQ ID NO: 125855 - DNA, 251 bp, Homo sapiens
  misc_feature: GYAE6OF01AUGAR.4.38.D05.1.454.CMB.1.raw
  modified_base (249)..(251): a, c, t, g, unknown or other
  misc_feature (249)..(251): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcgaccaagggaccaaggtggaaatcaaacgaactgtggctgcaccatctgtcttcatcttcccgccatctgactacagtgctctgagcgggctggcaaggcgcatagnnn

SEQ ID NO: 125856 - DNA, 208 bp, Homo sapiens
  misc_feature: GYAE6OF01AVIET.4.38.D05.1.454.CMB.1.raw
  modified_base (207)..(208): a, c, t, g, unknown or other
  misc_feature (207)..(208): n is a, c, g, or t
tcagagcactgtagcacgaccggtgctcgatttagtatctgatagttgggtttgggcggtgctcgatttagtatctgatagttgggtttggggaagaggaagactgacggtccccaggagttcaggtgctgggcacagcggccctgggctgcctggtcaaggactacttccctacagtgctctgagcgggctggcaaggcgcatagnn

SEQ ID NO: 125857 - DNA, 251 bp, Homo sapiens
  misc_feature: GYAE6OF01C7HHE.4.38.D05.1.454.CMB.1.raw
  modified_base (250)..(251): a, c, t, g, unknown or other
  misc_feature (250)..(251): n is a, c, g, or t
tcagagcactgtagcacgaccggtgctcgatttagtatctgatagtgggtctgggacagacttcactctcaccatcagcagactggagcctgaagattttgtagtgtattactgtcagcagtgtggtagctcaccgacgttcggccaagggaccaaggtggaaatcaaacgaactgtggctgcaccatctgtcttcatcttcccgccatctgactacagtgctctgagcgggctggcaaaggcgcatagnn

SEQ ID NO: 125858 - DNA, 441 bp, Homo sapiens
  misc_feature: GYAE6OF01DV769.4.38.D05.1.454.CMB.1.raw
  modified_base (236)..(236): a, c, t, g, unknown or other
  misc_feature (236)..(236): n is a, c, g, or t
  modified_base (349)..(349): a, c, t, g, unknown or other
  misc_feature (349)..(349): n is a, c, g, or t
  modified_base (435)..(441): a, c, t, g, unknown or other
  misc_feature (435)..(441): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggcaccctctccaagngcacctctggggcacagcggccctgggctgcctggtcaaggactacttccctacagtgctctgagcgggctggcaaggcgcatagnnnnnnn

SEQ ID NO: 125859 - DNA, 502 bp, Homo sapiens
  misc_feature: GYAE6OF01BBDU8.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaagggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggagcctagaagattttgctagtgtattactgtcagcagtgtggtagctcaccgacgtcggccgaagggaccaaggtaggaaatacgaaacgactagtggactcgacaccatcgtgtc

SEQ ID NO: 125860 - DNA, 210 bp, Homo sapiens
  misc_feature: GYAE6OF01BWDBX.4.38.D05.1.454.CMB.1.raw
  modified_base (209)..(210): a, c, t, g, unknown or other
  misc_feature (209)..(210): n is a, c, g, or t
tcagagcactgtagcacgaccggtgctcgatttagtatctgatagttgggtttgggcggtgctcgatttagtatctgatagttgggtttgggggaagaggaagactgacggtcccccaggagttcaggtgctgggcacagcggccctgggctgcctggtcaaggactacttccctacagtgctctgagcgggctggcaaggcgcatagnn

SEQ ID NO: 125861 - DNA, 210 bp, Homo sapiens; identical to SEQ ID NO: 125860
  misc_feature: GYAE6OF01BOSN5.4.38.D05.1.454.CMB.1.raw
  modified_base (209)..(210): a, c, t, g, unknown or other
  misc_feature (209)..(210): n is a, c, g, or t

SEQ ID NO: 125862 - DNA, 247 bp, Homo sapiens
  misc_feature: GYAE6OF01CB315.4.38.D05.1.454.CMB.1.raw
  modified_base (247)..(247): a, c, t, g, unknown or other
  misc_feature (247)..(247): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgcatctgactacagtgctctgagcggctggcaaggcgcatagn

SEQ ID NO: 125863 - DNA, 210 bp, Homo sapiens
  misc_feature: GYAE6OF01BVLGJ.4.38.D05.1.454.CMB.1.raw
  modified_base (210)..(210): a, c, t, g, unknown or other
  misc_feature (210)..(210): n is a, c, g, or t
tcagagcactgtagcacgaccggtgctcgatttagtatctgatagttgggtttgggcggtgctcgatttagtatctgatagttgggtttgggggaagaggaagactgaccggtcccccaggagttcaggtgctgggcacagcggccctgggctgcctggtcaaggactacttccctacagtgctctgagcgggctggcaaggcgcatagn

SEQ ID NO: 125864 - DNA, 441 bp, Homo sapiens
  misc_feature: GYAE6OF01BC17W.4.38.D05.1.454.CMB.1.raw
  modified_base (436)..(441): a, c, t, g, unknown or other
  misc_feature (436)..(441): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaagggcccatcggtcttccccctggcaccctcctccaagagcacctctgggggcacagcggccctgggctgcctggtcaaggctacttccctacagtgctctgagcgggctggcaaggcgcatagnnnnnn

SEQ ID NO: 125865 - DNA, 250 bp, Homo sapiens
  misc_feature: GYAE6OF01C0N1Z.4.38.D05.1.454.CMB.1.raw
  modified_base (249)..(250): a, c, t, g, unknown or other
  misc_feature (249)..(250): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgccatctgactacagtgctctgagcgggctggcaaggcgcatagnn

SEQ ID NO: 125866 - DNA, 207 bp, Homo sapiens
  misc_feature: GYAE6OF01BY0NL.4.38.D05.1.454.CMB.1.raw
  modified_base (207)..(207): a, c, t, g, unknown or other
  misc_feature (207)..(207): n is a, c, g, or t
tcagagcactgtagcacgaccggtgctcgatttagtatctgatagttgggtttgggcggtgctcgatttagtatctgatagttgggtttggggaagaggaagactgacggtccccaggagttcaggtgctgggcacagcggccctgggctgcctggtcaaggactacttccctacagtgctctgagcgggctggcaaggcgcatagn

SEQ ID NO: 125867 - DNA, 443 bp, Homo sapiens
  misc_feature: GYAE6OF01A0XNI.4.38.D05.1.454.CMB.1.raw
  modified_base (236)..(236): a, c, t, g, unknown or other
  misc_feature (236)..(236): n is a, c, g, or t
  modified_base (436)..(443): a, c, t, g, unknown or other
  misc_feature (436)..(443): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggcaccctcctccaagagcacctctgggggcacagcggccctgggctgcctggtcaaggctacttccctacagtgctctgagcgggctggcaaggcgcatagnnnnnnnn

SEQ ID NO: 125868 - DNA, 208 bp, Homo sapiens
  misc_feature: GYAE6OF01C3RU3.4.38.D05.1.454.CMB.1.raw
  modified_base (208)..(208): a, c, t, g, unknown or other
  misc_feature (208)..(208): n is a, c, g, or t
tcagagcactgtagcacgaccggtgctcgatttagtatctgatagttgggtttgggcggtgctcgatttagtatctgatagttgggtttgggggaagaggaagactgacggtcccccaggagttcaggtgctgggcacagcggcctgggctgcctggtcaaggactacttccctacagtgctctgagcgggctggcaaggcgcatagn

SEQ ID NO: 125869 - DNA, 542 bp, Homo sapiens
  misc_feature: GYAE6OF01CF214.4.38.D05.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaaccnggtaccagcagaacctggccaggctccaggctctcatctatggtncatccagcagggccactggcatcccagacaggttcagtggcaggtcgggtctgggacagtacttcactctcaccatcagcagactggacgcctagaagtagtttgctagtagttattactgtacagtctagttgtaggtagtctacgaccgtacgttaccggtacgaacgggtaccgaaaggtacggaaacgtacgaaaacgtaacgtaggtaggacgtacgaccgacctactcgtgttaccg

SEQ ID NO: 125870 - DNA, 250 bp, Homo sapiens; identical to SEQ ID NO: 125865
  misc_feature: GYAE6OF01AKDAH.4.38.D05.1.454.CMB.1.raw
  modified_base (249)..(250): a, c, t, g, unknown or other
  misc_feature (249)..(250): n is a, c, g, or t

SEQ ID NO: 125871 - DNA, 210 bp, Homo sapiens; identical to SEQ ID NO: 125860
  misc_feature: GYAE6OF01AUAC1.4.38.D05.1.454.CMB.1.raw
  modified_base (209)..(210): a, c, t, g, unknown or other
  misc_feature (209)..(210): n is a, c, g, or t

SEQ ID NO: 125872 - DNA, 442 bp, Homo sapiens
  misc_feature: GYAE6OF01ASQX5.4.38.D05.1.454.CMB.1.raw
  modified_base (236)..(236): a, c, t, g, unknown or other
  misc_feature (236)..(236): n is a, c, g, or t
  modified_base (437)..(442): a, c, t, g, unknown or other
  misc_feature (437)..(442): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaacccctggtcactgtctcctcagcctccaccaagggcccatcggtcttccccctggcaccctcctccaagagcacctctgggggcacagcggccctgggctgcctggtcaaggactacttccctaagtgctctgagcgggctggcaaggcgcatagnnnnnn

SEQ ID NO: 125873 - DNA, 478 bp, Homo sapiens
  misc_feature: GYAE6OF01DIJAB.4.38.D05.1.454.CMB.1.raw
  modified_base (228)..(228): a, c, t, g, unknown or other
  misc_feature (228)..(228): n is a, c, g, or t
  modified_base (387)..(387): a, c, t, g, unknown or other
  misc_feature (387)..(387): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (460)..(478): a, c, t, g, unknown or other
  misc_feature (460)..(478): n is a, c, g, or t
tcagagcactgtagcacgaccggtgctcgatttagtatctgataggttgggtttagggtgcccgggaaaggcctggaatggatggggatcatctatcctgatgactctgataccagatacagtccgtccttggaaggccgcgtcaccttctcagccgacaagtccatcagcaccgcctacctgcagtggagcagcctgaaggcctcggacagcgccatatattactgncgaaaaaccgtagcagctcacccgtaggactttgactactgggccagggaacctggtcactcgtctcctcacgcctccaccaacgggcccaattccggtccttccccctcggccaccctctccaagacgccacctcgtcgggggcaacacggcggcccnggggcctgcccttggtacaacggacttaccttccgtaacngtcgctcgtgagcgggntggcaagcgcaatcgnnnnnnnnnnnnnnnnnnn

SEQ ID NO: 125874 - DNA, 533 bp, Homo sapiens
  misc_feature: GYAE6OF01A8F78.4.38.D05.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaacctggtaccagcagaacctggccaggctcccaggctcctcatctatggtncatccagcagggccatggcatcccagacaggttcagtggcaggtgggtctgggacagtacttcgactctcaccatcagcagactggacgctagaagtagtttgcgtagtgtattactgtacagcgtagtgtggtagctcgaccgtacgtccggaccgaacgggaccgtaaggtacggaaacgtacgaaacggtaacgtacggtaggaccgtacgacaccacgtcgtcgttacc

SEQ ID NO: 125875 - DNA, 517 bp, Homo sapiens
  misc_feature: GYAE6OF01AZZZT.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagccgcatactattactgtgacgaaaaccagtacgcagcctaccaaccccgtaaggacctttgactacgtcgggg

SEQ ID NO: 125876 - DNA, 449 bp, Homo sapiens
  misc_feature: GYAE6OF01DMXNK.4.38.D05.1.454.CMB.1.raw
  modified_base (238)..(238): a, c, t, g, unknown or other
  misc_feature (238)..(238): n is a, c, g, or t
  modified_base (442)..(449): a, c, t, g, unknown or other
  misc_feature (442)..(449): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccaatatattactgtgacgaaaaccngtagcagcctcaccccgtaaggactttgactactggggccagggaaccctggtcactgtctcctcagcctccaccaagggcccatcggtcttccccctggcaccctctccaagacgcacctctggggcacagcggccctgggctgcctggtacaaggacctacttccctacagtcgctctgagcgggctggcaaggcgcatagnnnnnnnn

SEQ ID NO: 125877 - DNA, 495 bp, Homo sapiens
  misc_feature: GYAE6OF01CZ69A.4.38.D05.1.454.CMB.1.raw
  modified_base (237)..(237): a, c, t, g, unknown or other
  misc_feature (237)..(237): n is a, c, g, or t
  modified_base (478)..(479): a, c, t, g, unknown or other
  misc_feature (478)..(479): n is a, c, g, or t
  modified_base (482)..(495): a, c, t, g, unknown or other
  misc_feature (482)..(495): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagctcaccccgtaaggacttgactacgtgggccagggaaccctggtcactgtctcctcacgcctccaccgaaggcccagtccgtccttccccctggccacccctcctccaacgacgccacctcgtgggggccacgacggccggccctgggctcgcccgtggtaccgaacggtaccttaccttccccgtacacgtcgcctcgtggacggcgggtcgtcgggcaacggcgacagtagnngcnnnnnnnnnnnnnn

SEQ ID NO: 125878 - DNA, 210 bp, Homo sapiens; identical to SEQ ID NO: 125860
  misc_feature: GYAE6OF01EQMJT.4.38.D05.1.454.CMB.1.raw
  modified_base (209)..(210): a, c, t, g, unknown or other
  misc_feature (209)..(210): n is a, c, g, or t

SEQ ID NO: 125879 - DNA, 476 bp, Homo sapiens
  misc_feature: GYAE6OF01AKXYX.4.38.D05.1.454.CMB.1.raw
  modified_base (236)..(236): a, c, t, g, unknown or other
  misc_feature (236)..(236): n is a, c, g, or t
  modified_base (460)..(476): a, c, t, g, unknown or other
  misc_feature (460)..(476): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtcctcctcagcctccaccgaacgggcccatccggtccttccccctggccaccctcctccaagacgccacctcgtggggcacgacgccggccctgggctcgccgtggtacaacggaccttaccttcccctacgagtcgcctcgtgagcgggctggcgaaggcgcatgnnnnnnnnnnnnnnnnn

SEQ ID NO: 125880 - DNA, 211 bp, Homo sapiens
  misc_feature: GYAE6OF01CM9T7.4.38.D05.1.454.CMB.1.raw
  modified_base (209)..(211): a, c, t, g, unknown or other
  misc_feature (209)..(211): n is a, c, g, or t
tcagagcactgtagcacgaccggtgctcgatttagtatctgatagttgggtttgggcggtgctcgatttagtatctgatagttgggtttgggggaagaggaagactgacggtcccccaggagttcaggtgctgggcacagcggccctgggctgcctggtcaaggactacttccctacagtgctctgagcgggctggcaaggcgcatagnnn

SEQ ID NO: 125881 - DNA, 580 bp, Homo sapiens
  misc_feature: GYAE6OF01BS6F0.4.38.D05.1.454.CMB.1.raw
  modified_base (202)..(202): a, c, t, g, unknown or other
  misc_feature (202)..(202): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcggagtgttagagcagctacttaacctggtaccagcagaaacctggccaggctcccaggctcctcatctatggtgcatccagccgagggccacgtggcactcccgagacaggttcaggtggcaggtgggtctgggacagtacttcactctacaccatcagcagacgtggacgtctagaagttattttgactagttagttatttacgtgtacgagtcgtaggttggtaggttacgccgtaccgaaccggttacggttaccggaccgaaacgggaaccgtaagggtacggaaaacgtacgaaaacgtaacgttggtacggacgtacgactacctagttacctcgttcttcgtaccg

SEQ ID NO: 125882 - DNA, 446 bp, Homo sapiens
  misc_feature: GYAE6OF01DKVSF.4.38.D05.1.454.CMB.1.raw
  modified_base (236)..(236): a, c, t, g, unknown or other
  misc_feature (236)..(236): n is a, c, g, or t
  modified_base (439)..(446): a, c, t, g, unknown or other
  misc_feature (439)..(446): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaacccctggtcactgtctcctcagcctccaccaagggcccatcggtcttccccctggccaccctcctccaagagcacctctgggggcacagcggccctgggctgcctggtcaaggactacttccctacagtgctctgagcgggctggcaaggcgcatagnnnnnnnn

SEQ ID NO: 125883 - DNA, 441 bp, Homo sapiens
  misc_feature: GYAE6OF01DIUAO.4.38.D05.1.454.CMB.1.raw
  modified_base (236)..(236): a, c, t, g, unknown or other
  misc_feature (236)..(236): n is a, c, g, or t
  modified_base (435)..(441): a, c, t, g, unknown or other
  misc_feature (435)..(441): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggccaccctctccagagcacctctggggcacagcggccctgggctgcctggtcaaggactacttcctacagtgctctgagcgggctgggcaaggcgcatagnnnnnnn

SEQ ID NO: 125884 - DNA, 253 bp, Homo sapiens
  misc_feature: GYAE6OF01BGAIW.4.38.D05.1.454.CMB.1.raw
  modified_base (249)..(253): a, c, t, g, unknown or other
  misc_feature (249)..(253): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgccatctgactacagtgctctgagcgggctggcaaggcgcatagnnnnn

SEQ ID NO: 125885 - DNA, 250 bp, Homo sapiens
  misc_feature: GYAE6OF01EUXMV.4.38.D05.1.454.CMB.1.raw
  modified_base (249)..(250): a, c, t, g, unknown or other
  misc_feature (249)..(250): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgcatctgactacagtgctctgagcggggctggcaaggcgcatagnn

SEQ ID NO: 125886 - DNA, 502 bp, Homo sapiens
  misc_feature: GYAE6OF01BTTUZ.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctactaacctggtaccagcagaaacctggccaggctcccaggctcctcatctatggtgcatccagcagggccactggcatcccagacaggttcagtggcaggtgggtctgggacagacttcactctcaccatcagcagactggagcctagaagtattttgctagtgtattactgtcagcagtgtggtagctcaccgacgttcggccgaagggaccaaggtaggaaactacgaaacgactgtcggctgcaccatctgtcc

SEQ ID NO: 125887 - DNA, 445 bp, Homo sapiens
  misc_feature: GYAE6OF01BSH9N.4.38.D05.1.454.CMB.1.raw
  modified_base (437)..(445): a, c, t, g, unknown or other
  misc_feature (437)..(445): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaagggcccatcggtcttccccctggcaccctcctccaagagcacctctgggggcacagcggccctgggctgcctggtcaaggactacttccctacagtgctctgagcgggctggcaaggcgcatagnnnnnnnnn

SEQ ID NO: 125888 - DNA, 509 bp, Homo sapiens
  misc_feature: GYAE6OF01BY3AU.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtcttcgaaggccgcgtcaccttctcagccgacaagtccatcagccaccgcctacctgcagtggagcagcctgaacggcctcgggacagcgccatatattactgtagacgaaaccagtagcagctacacccgtagactttgactcgtcgggg

SEQ ID NO: 125889 - DNA, 560 bp, Homo sapiens
  misc_feature: GYAE6OF01BO7KL.4.38.D05.1.454.CMB.1.raw
  modified_base (455)..(455): a, c, t, g, unknown or other
  misc_feature (455)..(455): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaaggcccggggagtctctgaagatctcctgtaagggttctggatacatctttaggacctactggatcggctgggtgcgccgaggtcgaccgggaaggcctggaatggatggggatcgatctatcctgatgactctagactaccagactacgacgttcccgtccgtttacgaacggtccgtccgttacacctttctcgacgccgaacaacgtcccatccgagcccacgccctacctgccagtcggacncgacgccgtagaacggtcctacgggacacgacgaccatatattacgtcgtacgaacgaaacctagtacgcacgctacgacccgtagacttcgactacggtacggg

SEQ ID NO: 125890 - DNA, 209 bp, Homo sapiens
  misc_feature: GYAE6OF01DN0O8.4.38.D05.1.454.CMB.1.raw
  modified_base (209)..(209): a, c, t, g, unknown or other
  misc_feature (209)..(209): n is a, c, g, or t
tcagagcactgtagcacgaccggtgctcgatttagtatctgatagttgggtttgggcggtgctcgatttagtatctgatagttgggtttgggggaagaggaagactgacggtcccccaggagttcaggtgctgggcacagcggccctgggctgcctggtcaaggactacttccctacagtgctctgagcgggctggcaaggcgcatagn

SEQ ID NO: 125891 - DNA, 441 bp, Homo sapiens
  misc_feature: GYAE6OF01A0ZQ9.4.38.D05.1.454.CMB.1.raw
  modified_base (236)..(236): a, c, t, g, unknown or other
  misc_feature (236)..(236): n is a, c, g, or t
  modified_base (433)..(441): a, c, t, g, unknown or other
  misc_feature (433)..(441): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggcaccctcctccaagagcacctctggggcacagcgcctggctgcctggtcaaggactacttccctacagtgctctgagcgggctggcaaggcgcatagnnnnnnnnn

SEQ ID NO: 125892 - DNA, 211 bp, Homo sapiens
  misc_feature: GYAE6OF01ENQZL.4.38.D05.1.454.CMB.1.raw
  modified_base (210)..(211): a, c, t, g, unknown or other
  misc_feature (210)..(211): n is a, c, g, or t
tcagagcactgtagcacgaccggtgctcgatttagtatctgatagttgggtttgggcggtgctcgatttagtatctgatagttgggtttgggggaagaggaagactgacggtccccccaggagttcaggtgctgggcacagcggccctgggctgcctggtcaaggactacttccctacagtgctctgagcgggctggcaaggcgcatagnn

SEQ ID NO: 125893 - DNA, 486 bp, Homo sapiens
  misc_feature: GYAE6OF01DCMLA.4.38.D05.1.454.CMB.1.raw
  modified_base (236)..(236): a, c, t, g, unknown or other
  misc_feature (236)..(236): n is a, c, g, or t
  modified_base (460)..(486): a, c, t, g, unknown or other
  misc_feature (460)..(486): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaagactttgactactgggccagggaaccctggcactgtctcctcacgcctccaccaacgggcccatccggtccttccccctcggcccacccgtcctaccaagacgcacctcgtcgggggcacgacgccggccctgggctgcccgtggtcgaacggtacctaccttccctacagtcgctctgacggcgggctggcaggccgcatacgnnnnnnnnnnnnnnnnnnnnnnnnnnn

SEQ ID NO: 125894 - DNA, 603 bp, Homo sapiens
  misc_feature: GYAE6OF01D3LJ3.4.38.D05.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcacctgtctttgtctccaggggaaancgccaccctctcctgcagggccagtcagagtgttagcagcagctacttaactggtaccagcagaacctggccaggctccaggcctcctnatctatggtncatccagcagggccagtggacacgtcccaagacctaggttcaggtggcaggtgggtctgggacagccttcactctcacatcagcagacgtggacgtccgtaggtaagtagttttacggacgtaggttacgttagtttacgttgtacgtaggtccgtaggttaggttacgggttaacggtccgttaccgtaacccggtacggttaccgggaccggtaacgggaaccgtaaagggtacggtaaacgtacgaaaccggtacgtacggtacggacgtacggtaccaaccgtacgttcgtcgtttaccg

SEQ ID NO: 125895 - DNA, 519 bp, Homo sapiens
  misc_feature: GYAE6OF01CDBR5.4.38.D05.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
  modified_base (510)..(510): a, c, t, g, unknown or other
  misc_feature (510)..(510): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaaccnggtaccagcagaaacctggccaggctcccaggctcctcatctatggtncatccagcagggccacgtggcatcccagacaggttcagtggcaggtgggtctgggacagacttcactctacacatcagcagacgtggagcctgaagtatttgctagtgtattactgtcagctagtgtggtagcctcgaccggtacgttcggaccgaagggaccgaaggtacgaaactacgaaacggtacgtgtacggcgtgacctacnctcgtgtcc

SEQ ID NO: 125896 - DNA, 495 bp, Homo sapiens
  misc_feature: GYAE6OF01EQJ9N.4.38.D05.1.454.CMB.1.raw
  modified_base (433)..(433): a, c, t, g, unknown or other
  misc_feature (433)..(433): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggagcctgaagtattttgcagtgtattactgtcagcagtgtgtagctcnccgacgttcgacgaaggaccaaggtggaaactagaaacgactgtgctcgacaccatcgtgtc

SEQ ID NO: 125897 - DNA, 529 bp, Homo sapiens
  misc_feature: GYAE6OF01BH1JK.4.38.D05.1.454.CMB.1.raw
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (498)..(501): a, c, t, g, unknown or other
  misc_feature (498)..(501): n is a, c, g, or t
  modified_base (503)..(507): a, c, t, g, unknown or other
  misc_feature (503)..(507): n is a, c, g, or t
  modified_base (509)..(509): a, c, t, g, unknown or other
  misc_feature (509)..(509): n is a, c, g, or t
  modified_base (511)..(514): a, c, t, g, unknown or other
  misc_feature (511)..(514): n is a, c, g, or t
  modified_base (516)..(529): a, c, t, g, unknown or other
  misc_feature (516)..(529): n is a, c, g, or t
tcagagcactgtagcacgaccggtgctcgatttagtatctgatagttgggtttaggtgcccggggaaaggcctggaatggatggggatcatctatcctgatgactctgataccagatacagtccgtccttcgaaggccgcgtcaccttcgtcagccgacaagtccatcagcaccgcctacctgcagtggagcagcctgaaggcctcggacagcgccatatattacngtgacgaaaaccngtagcagctcacccgtaaggactttgactacgtgggccagggaaccctggtcactgtctcctcagcctccacaacggcccatcgtcttccccgtgccaccctcctccaagcgcaccgtcgtggggcacgacggccggcccgtgggcctcggcccgttgggtaccaacgggtaccttacccgtttccccgtacgtaacggttcgccgttcgtcgggacggccggggtcgttagggaccgttaagggccgacagtacggcnnnnannnnngngnnnngnnnnnnnnnnnnnn

SEQ ID NO: 125898 - DNA, 519 bp, Homo sapiens
  misc_feature: GYAE6OF01CR1TL.4.38.D05.1.454.CMB.1.raw
  modified_base (241)..(241): a, c, t, g, unknown or other
  misc_feature (241)..(241): n is a, c, g, or t
  modified_base (380)..(380): a, c, t, g, unknown or other
  misc_feature (380)..(380): n is a, c, g, or t
  modified_base (484)..(484): a, c, t, g, unknown or other
  misc_feature (484)..(484): n is a, c, g, or t
  modified_base (489)..(496): a, c, t, g, unknown or other
  misc_feature (489)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(504): a, c, t, g, unknown or other
  misc_feature (502)..(504): n is a, c, g, or t
  modified_base (506)..(519): a, c, t, g, unknown or other
  misc_feature (506)..(519): n is a, c, g, or t
tcagagcactgtagcacgaccggtgctcgatttagtatctgataggtttgggtttaggtagcccgggaaaggcctggaatggatggggatcatctatcctgatgactctgataccagatacagttccgtccttcgaaggccgcgtcaccttctcagccgacaagtccatcagcaccgcctacctgcagtggagcagcctgaaggcctcggacagcgccatatattactgtgacgaaaaccngtagcagctcaccccgtaaggactttgactacgtgggccagggaaccctggcactgtctcctcagcctccaccaacgggccacgtccggttaccttccccctcggccacccctcctaccaacgacgacctaccgttcgngggggccacgacgccggcccgtgggcctcgccgtaggtaccaaggtacctacttcccctagacgtcgctcgtggacggcgggcgtggaccgaggcgacgatagngcagnnnnnnnngngngnnngnnnnnnnnnnnnnn

SEQ ID NO: 125899 - DNA, 520 bp, Homo sapiens
  misc_feature: GYAE6OF01BSO5J.4.38.D05.1.454.CMB.1.raw
  modified_base (301)..(301): a, c, t, g, unknown or other
  misc_feature (301)..(301): n is a, c, g, or t
  modified_base (399)..(399): a, c, t, g, unknown or other
  misc_feature (399)..(399): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaacctggccaggctcccaggctcctcatctatggtncatccagcagggccagtggcatcccagacaggttcagtggcagtgggtctgggacagtacttcgactctcaccatcagcagactggagcgtagaagtntttgcgtagtgttattactgtcagctaggtgtggtagctcgaccggtacgttcggaccgaacgggaccgaagggtacggaactacgaaacggactaggtggactcgacacactcgtgttcc

SEQ ID NO: 125900 - DNA, 216 bp, Homo sapiens
  misc_feature: GYAE6OF01AXY93.4.38.D05.1.454.CMB.1.raw
  modified_base (208)..(216): a, c, t, g, unknown or other
  misc_feature (208)..(216): n is a, c, g, or t
tcagagcactgtagcacgaccggtgctcgatttagtatctgatagttgggtttgggcggtgctcgatttagtatctgatagttgggtttgggggaagaggaagactgacggtcccccaggagttcaggtgctgggcacagcggccctgggctgcctggtcaaggactacttccctacatgctctgagcgggctggcaaggcgcatagnnnnnnnnn

SEQ ID NO: 125901 - DNA, 211 bp, Homo sapiens; identical to SEQ ID NO: 125880
  misc_feature: GYAE6OF01BEP66.4.38.D05.1.454.CMB.1.raw
  modified_base (209)..(211): a, c, t, g, unknown or other
  misc_feature (209)..(211): n is a, c, g, or t

SEQ ID NO: 125902 - DNA, 522 bp, Homo sapiens
  misc_feature: GYAE6OF01AISJ0.4.38.D05.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcattctccaggcaccctgtctttgtctccaggggaaangccaccctctcctgcagggccagtcagagtgtagcagcagctacttaacctggtaccagcagaaacctggccaggcctcccaggctcctcatctatggtncatccagcagggccactggcatcccagacaggttcagtggcaggtgggtctgggacagtacttcactctcaccatcagcagactggagccgtagtaagtattttgactagtgttattacgtgtcagtcgtagtggtggtagctcgaccgacgttccggaccgaacgggaccgaagggtaggaaactacgaaacgactagtgacgtgaccacactcgtgtcc

SEQ ID NO: 125903 - DNA, 469 bp, Homo sapiens
  misc_feature: GYAE6OF01BWLLE.4.38.D05.1.454.CMB.1.raw
  modified_base (236)..(236): a, c, t, g, unknown or other
  misc_feature (236)..(236): n is a, c, g, or t
  modified_base (461)..(469): a, c, t, g, unknown or other
  misc_feature (461)..(469): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaacgggcccatcggtccttccccctggccaccctcctccaacgacgcaccctctgggggcacacggccggcccgtcgggctgcctcgggtaccaacggaccttacttccctacacgtcgctcgtgacgcgggctcggcaaggcgacatagnnnnnnnnn

SEQ ID NO: 125904 - DNA, 502 bp, Homo sapiens
  misc_feature: GYAE6OF01CM1P5.4.38.D05.1.454.CMB.1.raw
  modified_base (484)..(502): a, c, t, g, unknown or other
  misc_feature (484)..(502): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccagtagcagctcaccccgtaaggactttgactacgtggggccagggaaccctggtcactgtctcctcacgcctccaccaacgggcccatccggtccttccccctggccacccctcctccaagacgccacccgtcgtcgggggccacgacggccggcccgtgggcctcgcccgtaggtcgaaaggaccttacctttcccctacagttcgcgtcgtggacgccggggctcgggcaacgggccgacagtagnnnnnnnnnnnnnnnnnnn

SEQ ID NO: 125905 - DNA, 581 bp, Homo sapiens
  misc_feature: GYAE6OF01CCKP2.4.38.D05.1.454.CMB.1.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcattctccaggcaccctgtctttgtctccgaggggaaancgccaccctctcctgcagggccagtcagagtgtagcagcagctacttaaccnggtaccagcagaacctggccaggcctcccgaggcctcctcatctatggtncatccagcacgggccacgtggcactcccagacctaggttcaggtggctaggtcggtctgggacagtacttcactctaccacatcagcagacgtggacgcgtagaagtatttgactagttgtactttacgtgtacgagtcgtaggttcggtaggtacgccgttaccgacccggttacggttaccgggaccgtaacggggtaacccgtaaagggtacggtaaactaaccggaaaacggtacgtcggtacggcgtacgaccaacctacttcgtcgttacc

SEQ ID NO: 125906 - DNA, 516 bp, Homo sapiens
  misc_feature: GYAE6OF01DZIIW.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaagggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggagcctagaagtattttgctagtgtattactgtcagctagtgtggtacgctcgaccgtacgttcggaccgaagggacctaagggtacggaaatacaaacggtacgtggtggactgaccactatctgttacc

SEQ ID NO: 125907 - DNA, 524 bp, Homo sapiens
  misc_feature: GYAE6OF01B9NSU.4.38.D05.1.454.CMB.1.raw
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctccagataccaccggagaaattgtgttgacgcagtctccaggcaccctgtcttgtctccgagggaaagagccacctctcctgcagggccagtcagagtgtagcagcagctactaacnggtaccagcagaactggcaggctccagctcncatctatggtgcatccagcgagggccacgtggcactcccagacaggttcagtggcaggtggtctgggacagtacttcactctcaccatcagcagacgtggagcctagaagttatttgctagtgtattactgtacagctaggtggtggtacgctacgaccgtacggttccggacgaaacgggaccgaaagggtacggaaactaacgaaacgtaacgtgtaggacgtcgacaaccatcgtgttaccg

SEQ ID NO: 125908 - DNA, 248 bp, Homo sapiens
  misc_feature: GYAE6OF01BZTB2.4.38.D05.1.454.CMB.1.raw
  modified_base (248)..(248): a, c, t, g, unknown or other
  misc_feature (248)..(248): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgccatctgactacagtgctctgagcggctggcaaggcgcatagn

SEQ ID NO: 125909 - DNA, 538 bp, Homo sapiens
  misc_feature: GYAE6OF01CS4U1.4.38.D05.1.454.CMB.1.raw
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcccggggagtctctgaagatctcctgtaagggttctggatacatctttaggacctactggatcggctgggtgcgccaggtgcccggggaaaggcctggaatggatggggatcatctatcctgatgactctgataccagatacagtccgtccttcgaaggcccgcgtccaccttctcacgccgacaagtccatcacgccaccnccctacctgcagtggancacgcctggaacggcccgtcgggacaggccgaccataatattactcgtagaccgaaaaccagtacgcagcctctaaccccgtaagactttcgacgtacgtacgggg

SEQ ID NO: 125910 - DNA, 579 bp, Homo sapiens
  misc_feature: GYAE6OF01A548N.4.38.D05.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaaccnggtaccagcagaaacctggccaggcctcccaggcctcctcatctatggtgcatccagcagggccactggcactcccagctaggttcagtggcaggtggtctgggacagtacttcactctacacatcagcagactggacgcgtagagtatttagcgtagtgttattacgttgtacgagcgtaggtggtaggttacgtaccgttaccgtaccggtaccggttccgggaaccgtaacggggtaacccgtaaagggtacggaaaacgtaccgtaaaacggtacgtacggtacggtaccgtacggaccaaccgtacttccgtcgttaccg

SEQ ID NO: 125911 - DNA, 446 bp, Homo sapiens
  misc_feature: GYAE6OF01DF8E8.4.38.D05.1.454.CMB.1.raw
  modified_base (236)..(236): a, c, t, g, unknown or other
  misc_feature (236)..(236): n is a, c, g, or t
  modified_base (436)..(446): a, c, t, g, unknown or other
  misc_feature (436)..(446): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcacccgtaaggactttgactactggggccagggaaccctggtcactgtctcctcagcctccaccaagggcccatcggtccttccccctggccaccctcctccaagacgcacctctggggcacagcgccctgggctgcctggtcaggactaccttccctacagtgctctgagcgggctggcaggcgcatagnnnnnnnnnnn

SEQ ID NO: 125912 - DNA, 268 bp, Homo sapiens
  misc_feature: GYAE6OF01B4MTY.4.38.D05.1.454.CMB.1.raw
  modified_base (254)..(268): a, c, t, g, unknown or other
  misc_feature (254)..(268): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatccttcccgccagtcctgactacagtgctctgagcggggctggccaaggcgcatagnnnnnnnnnnnnnnn

SEQ ID NO: 125913 - DNA, 212 bp, Homo sapiens
  misc_feature: GYAE6OF01B4SL2.4.38.D05.1.454.CMB.1.raw
  modified_base (209)..(212): a, c, t, g, unknown or other
  misc_feature (209)..(212): n is a, c, g, or t
tcagagcactgtagcacgaccggtgctcgatttagtatctgatagttgggtttgggcggtgctcgatttagtatctgatagttgggtttgggggaagaggaagactgacggtcccccaggagttcaggtgctgggcacagcggccctgggctgcctggtcaaggactacttccctacagtgctctgagcgggctggcaaggcgcatagnnnn

SEQ ID NO: 125914 - DNA, 478 bp, Homo sapiens
  misc_feature: GYAE6OF01AJRD6.4.38.D05.1.454.CMB.1.raw
  modified_base (236)..(236): a, c, t, g, unknown or other
  misc_feature (236)..(236): n is a, c, g, or t
  modified_base (468)..(478): a, c, t, g, unknown or other
  misc_feature (468)..(478): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaggactttgactactggggccagggaaccctggtcactgtctcctcagcctccaccaagggcccatccggtcttccccctggccaccctcctccaacgacgccaccctccgtcggggggcaccgagccgggccccttggggcctggcccgttgggtccaagggacctacctttcccctacagtgctcgtgagcggggctgggcaaggcgcatagnnnnnnnnnnn

SEQ ID NO: 125915 - DNA, 253 bp, Homo sapiens
  misc_feature: GYAE6OF01AINTH.4.38.D05.1.454.CMB.1.raw
  modified_base (250)..(253): a, c, t, g, unknown or other
  misc_feature (250)..(253): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgcatctgactacagtgctctgaggcgggctggcaagggcgcatagnnnn

SEQ ID NO: 125916 - DNA, 442 bp, Homo sapiens
  misc_feature: GYAE6OF01BUGTA.4.38.D05.1.454.CMB.1.raw
  modified_base (236)..(236): a, c, t, g, unknown or other
  misc_feature (236)..(236): n is a, c, g, or t
  modified_base (431)..(431): a, c, t, g, unknown or other
  misc_feature (431)..(431): n is a, c, g, or t
  modified_base (437)..(442): a, c, t, g, unknown or other
  misc_feature (437)..(442): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagcccatcagcaccgcctacctgcagtggagcagcctgaaggcctcggacagcgccatatattactgtgcgaaaaccngtagcagctcacccgtaaggactttgactactgggccagggaaccctggtcactgtctcctcagcctccaccaagggcccatcggtcttccccctggccaccctcctccaacgagcacctctgggggcacagcggccctgggctgcctggtcaaggactactccctacagtgctctgacgcgggctggcaaggcncatagnnnnnn

SEQ ID NO: 125917 - DNA, 636 bp, Homo sapiens
  misc_feature: GYAE6OF01CH6LC.4.38.D05.1.454.CMB.1.raw
  modified_base (237)..(237): a, c, t, g, unknown or other
  misc_feature (237)..(237): n is a, c, g, or t
  modified_base (607)..(607): a, c, t, g, unknown or other
  misc_feature (607)..(607): n is a, c, g, or t
  modified_base (609)..(636): a, c, t, g, unknown or other
  misc_feature (609)..(636): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagctccaaccccgtaaggactttgactacgtggggccacgggaacctggtcactcgtcctcctcacgccctcccaacccgaacggggcccctaacgttcccggttcccctttcccccccgttgggcccctaacccccgtccctacccgaaaacgaccgaccaaccccgttcggtcggggggacccaaccgacggcccgggtcccccgtgggggtcctcgggtaccccgttggggtaacccaaacgggtaacccttaacccgtttacccccgttaacgtacgggtttccgcccgtttccggtagggaacgggtccgggggtacccgtcggggacccgaaagggtcccggaacgtagttaacggcgngnnnnnnnnnnnnnnnnnnnnnnnnnnnn

SEQ ID NO: 125918 - DNA, 518 bp, Homo sapiens
  misc_feature: GYAE6OF01AN64E.4.38.D05.1.454.CMB.1.raw
  modified_base (189)..(189): a, c, t, g, unknown or other
  misc_feature (189)..(189): n is a, c, g, or t
  modified_base (237)..(237): a, c, t, g, unknown or other
  misc_feature (237)..(237): n is a, c, g, or t
  modified_base (494)..(518): a, c, t, g, unknown or other
  misc_feature (494)..(518): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggancagcctgaaggcctcggacagcgccatatattactgtgacgaaaaccngtagcagctcaccccgtaagactttgactactgggccagggaccctggtcactgtctcctcagcctccaccaacggcccatccggtccttccccctcggccaccctccctccaagacgccaccctcgtcgggggccacgacgccggcccgtggggcctcggccctgggtaccgaacggacccttaccctttcccctacgtacggttcgtccttccgtggacggccggggctcgggaccaagggccgacaactaggcnnnnnnnnnnnnnnnnnnnnnnnnn

SEQ ID NO: 125919 - DNA, 456 bp, Homo sapiens
  misc_feature: GYAE6OF01CH8M7.4.38.D05.1.454.CMB.1.raw
  modified_base (236)..(236): a, c, t, g, unknown or other
  misc_feature (236)..(236): n is a, c, g, or t
  modified_base (445)..(456): a, c, t, g, unknown or other
  misc_feature (445)..(456): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatccggtccttccccctggccaccctcctccaagacgcacctcgtgggggcacagcggccctgggctgcctggtcaaggactaccttccctacagtgctctggacgcgggctggcaaggcgcatagnnnnnnnnnnnn

SEQ ID NO: 125920 - DNA, 212 bp, Homo sapiens; identical to SEQ ID NO: 125913
  misc_feature: GYAE6OF01D8PN7.4.38.D05.1.454.CMB.1.raw
  modified_base (209)..(212): a, c, t, g, unknown or other
  misc_feature (209)..(212): n is a, c, g, or t

SEQ ID NO: 125921 - DNA, 609 bp, Homo sapiens
  misc_feature: GYAE6OF01D4HJ5.4.38.D05.1.454.CMB.1.raw
  modified_base (345)..(345): a, c, t, g, unknown or other
  misc_feature (345)..(345): n is a, c, g, or t
tcagagcactgtagcacgaccggtgctcgatttagtatctgatagttgggtttgggggagtctccctcactgcccagctgggatctcagggcttcattttctgtcctccaccatcatgggtcaaccgccatcctcgccctcctcctggctgttctccaaggagtctgtgccgaggtgcagctggtgcagtctggagcagaggtagaaaaagcccggggagtctctgaagatctccgtgtaagggttctggatacatctttaggacctacgtgatcggctgggtgcgcgaggtcgacccgggaaaggccgtaggaatggagtggggatcatctatcctgatgactntgatacagatacgacgtccgtcttcggaacggccgtcgtcaccctttctacgacgacccgaacaacgtccataccgacgccaacccgcctaccgtgacgtaggtggacgtccgacgccgtaggaaccggcccgtacggacgaacggccgaccaacgttacttaacgttaccgtagtaacgaacgtaaaacccaggtacgaccgtaacgtacctaacccggtaacccggtaaggttacctttacgaacgttacgggtacccgggg

SEQ ID NO: 125922 - DNA, 575 bp, Homo sapiens
  misc_feature: GYAE6OF01B79HX.4.38.D05.1.454.CMB.1.raw
  modified_base (183)..(183): a, c, t, g, unknown or other
  misc_feature (183)..(183): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagcnggttttgcagtctggagcagaggtagaaaaagcccggggagtctctgaagatctcctgtaagggttctggatacatctttaggacctactggatcggctgggtgcgccaggtcgaccgggaaaggccgtggaatggagtggggatcatctatcctgatgactctgataccagactacacgtccgtcttacgaacggccgtcgtcaccttctcagtccgacaacgtccatcacgccaccgcctacctgcagtcggacgcacgctacgaacggcccgtacggaccgacggccgacccataactattaccgtgtacgaaccgaaaacctaggtacgcgtaacgccctacccgaaccccgttaaggtaccttttcgaaccgtacggtacccggggg

SEQ ID NO: 125923 - DNA, 552 bp, Homo sapiens
  misc_feature: GYAE6OF01AWZZT.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgcaggtgcccgggaaaggcctggaatggatggggatcatctatcctgatgactctgataccagatacagtccgtccttacgaaggccgcgtcaccttctcagccgacaacgtccatcagccaccgcctacctgcagtggagcagccgtagaacggccctacggacacgcgaccatactattactaggtacgaacgaaaaccgagtacgccgagacccgtaccgaaccccggttaaggtaccttttacggaccgttacggtaccggggg

SEQ ID NO: 125924 - DNA, 447 bp, Homo sapiens
  misc_feature: GYAE6OF01C0QS8.4.38.D05.1.454.CMB.1.raw
  modified_base (236)..(236): a, c, t, g, unknown or other
  misc_feature (236)..(236): n is a, c, g, or t
  modified_base (440)..(447): a, c, t, g, unknown or other
  misc_feature (440)..(447): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaacccctggtcactgtctcctcagcctccaccaagggcccatcggtcttccccctggccaccctctccaagacgcacctcgtggggcacgagcggccctgggctgcctggtcaaggactacttccctacagtgctctgagcgggctggcaaggcgcatagnnnnnnnn

SEQ ID NO: 125925 - DNA, 441 bp, Homo sapiens
  misc_feature: GYAE6OF01ECF8T.4.38.D05.1.454.CMB.1.raw
  modified_base (437)..(441): a, c, t, g, unknown or other
  misc_feature (437)..(441): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaagggcccatcggtcttccccctggcaccctcctccaagagcacctctgggggcacagcggccctgggctgcctggtcaaggactacttccctacagtgctctgagcgggctggcaaggcgcatagnnnnn

SEQ ID NO: 125926 - DNA, 636 bp, Homo sapiens
  misc_feature: GYAE6OF01A5246.4.38.D05.1.454.CMB.1.raw
  modified_base (200)..(200): a, c, t, g, unknown or other
  misc_feature (200)..(200): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgctccgaggggaangccaccctctcctgcagggccagtcagagtgttagcagcagctacttaacctggtaccagcaagaaccctggccaggcctcccgaggcctcctcatctagtggtcgacatccagccgagggcccaagtcgggccactccccgagaccgtagggtttccagggtcggacgtagggtcgggtctaggggacctagtacctttcgactctcaccatcagcacgtacgtggacgtccgtagtaacgttagttttcggacgtacgttagttagtttacgtggttaccgtacggtcgtaggttaggttacgggttacggtccgtcgtaacccggtacggttaccgggaccgtaacggggtaaccgtaagggtaacggtaaacgtacgtaaacggtaacgtacggtacggtacgtacggtaccacgtacgttcgtcgttaccg

SEQ ID NO: 125927 - DNA, 502 bp, Homo sapiens
  misc_feature: GYAE6OF01CWHFU.4.38.D05.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (486)..(486): a, c, t, g, unknown or other
  misc_feature (486)..(486): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaaccnggtaccagcagaaacctggccaggctcccaggctcctcatctatggtgcatccagcagggccactggcatcccagacaggttcagtggcagtgggtctgggacagacttcactctcaccatcagcagactggagcctagaagtattttgctagtgttattactgtcagcagtgtggtagctcaccgtacgttcggaccgaagggaccaagggtaggaaatacaaacgactgnggctgacacatctgtc

SEQ ID NO: 125928 - DNA, 450 bp, Homo sapiens
  misc_feature: GYAE6OF01EKT0N.4.38.D05.1.454.CMB.1.raw
  modified_base (236)..(236): a, c, t, g, unknown or other
  misc_feature (236)..(236): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (442)..(450): a, c, t, g, unknown or other
  misc_feature (442)..(450): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtccttccccctggccnccctcctccaacgngcacctctgggggcacgagccggccctgggctgcctggtcaagtacctacttccctacagtgctctgacgcgggctggcaggcgcatgnnnnnnnnn

SEQ ID NO: 125929 - DNA, 528 bp, Homo sapiens
  misc_feature: GYAE6OF01C7IUM.4.38.D05.1.454.CMB.1.raw
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctgaagatctcctgtaaggtctggatacatctttaggacctactggatcggctgggtgcgccgaggtgccccggggaaaaggccgtggaagtggaagtgggggatcgaattctaatcctagatgactctagataccagatacagtccgtcctgaaggccgtcgtcaccttctcagccgaacaacgtccatcacgaccacccgcctacctgcagtggagcagctgacgcctacggcagcnccatatatacngtgacgaaacagtagcagcaccgacccgtaaggactttacgacgtcgtacgggg

SEQ ID NO: 125930 - DNA, 470 bp, Homo sapiens
  misc_feature: GYAE6OF01D9YPO.4.38.D05.1.454.CMB.1.raw
  modified_base (237)..(237): a, c, t, g, unknown or other
  misc_feature (237)..(237): n is a, c, g, or t
  modified_base (413)..(413): a, c, t, g, unknown or other
  misc_feature (413)..(413): n is a, c, g, or t
  modified_base (450)..(470): a, c, t, g, unknown or other
  misc_feature (450)..(470): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagctcacccgtaaggactttgactactggggccagggaaccctggtcactgtctcctcacgcctccaccaagggcccatcggtccttccccctggccaccctcctccaagcgcacctcgtggggcacagcggccctgggctgcctggtcaaggacctacttccctacagtnctctgacggcgggctcgggcgaaggtcgctataggcnnnnnnnnnnnnnnnnnnnnn

SEQ ID NO: 125931 - DNA, 586 bp, Homo sapiens
  misc_feature: GYAE6OF01EF0Z0.4.38.D05.1.454.CMB.1.raw
  modified_base (200)..(200): a, c, t, g, unknown or other
  misc_feature (200)..(200): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtcagagtgttagcagcagctacttaacctggtaccagcagaaacctggccaggctccaggctcctcatctatggtgccatcccagccgagggcccacgtcgggccactccccagaccgtaggttccaggtcggcaggttgggtctggggacaggtacttcaccttctccaccatcagcagaccgtggagccgtaggaagtagttttcgcgtagtgttatttactgtcagctaggtggtggtagctcgaccgtacggttccggaccgtaagggaccgtaagggtacggtaaacgtaccgaaaacggtaacgttcgggtacggtaccgttacggacccaacccgtacgttccgtcggttacccg

SEQ ID NO: 125932 - DNA, 506 bp, Homo sapiens
  misc_feature: GYAE6OF01BJZWA.4.38.D05.1.454.CMB.1.raw
  modified_base (236)..(236): a, c, t, g, unknown or other
  misc_feature (236)..(236): n is a, c, g, or t
  modified_base (481)..(506): a, c, t, g, unknown or other
  misc_feature (481)..(506): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctacacccgtaagactttgactacgtggggccagggaacctggtcactgtctcctcagcctccaccaacgggcccacgtccggtccttcccccgtggcctacccctccctccaacgacgccaccctcggtcgggggccaacgacgcggcccctgggcctcgcccgtcggtcaacggtaccttaccttccctacagtcgctcgtgacggcgggtcgtcgggcgaagggccacgactagnnnnnnnnnnnnnnnnnnnnnnnnnn

SEQ ID NO: 125933 - DNA, 575 bp, Homo sapiens
  misc_feature: GYAE6OF01A9451.4.38.D05.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaaccnggtaccagcagaacctggccaggctcccaggcctcctcatctatggtgcatccagcagggccactggcactcccagacaggttcagtggcaggtgggtctgggacaggtacttcactcctacaccatcgagcagacgtggacgccgtagtaagtatttacgacgtagtacgttattacgtgtactagcgtagtggtggtacgtccgtacgtaccggtaccggttccggaccggtaacgggaccgtaaggggtacggaaacgtaaccgaaacggtaacgtaggtacgggacgtacggacctaaccgtacttcgttcgttaccg

SEQ ID NO: 125934 - DNA, 698 bp, Homo sapiens
  misc_feature: GYAE6OF01CCK9M.4.38.D05.1.454.CMB.1.raw
  modified_base (205)..(205): a, c, t, g, unknown or other
  misc_feature (205)..(205): n is a, c, g, or t
  modified_base (261)..(261): a, c, t, g, unknown or other
  misc_feature (261)..(261): n is a, c, g, or t
tcagagcactgtagcacgaccggtgctcgatttagtatctgatagttggggtttggggagagctgctcagttaggacccagagggaaccatggaaaccccagcgcagcttctcttcctcctgctactctggctcccagactaccaccggagaaattgtgttgacgcagtctccaggccaccctgtctttgtctccgaggggaaanacgcccaccctctcctgcgagggccagtcagagtgtagcagcagactacttaaccnggtaaccagacgaacgaaccgtcggaccgacggcctacccgacggtccttaccgtactacgttcgttagtcggtcgacctacgtccgagaccggacgggtaccacggtcggacctaccgtacccgagtaaccgtacggttacgacgggtggacgtagggttcgggtcgtacgggaactacgtaccttctaccgttaccacctaactacgtacgagaccgtaaggtacgtggaactaccgtaagttacgtttagtttcggactttagggttacttacgttacgtcgtaacgtacgtacgttaggttacggtacgggtacctccgttaacccggacggttaccggttaccggaaaccgtaacgggtaaccgtaaagggtaccgtaaacgtacgaaaccggtgtgggtacacgtccgaaccttactgttccgtcgttacc

SEQ ID NO: 125935 - DNA, 460 bp, Homo sapiens
  misc_feature: GYAE6OF01ASCZP.4.38.D05.1.454.CMB.1.raw
  modified_base (450)..(460): a, c, t, g, unknown or other
  misc_feature (450)..(460): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaagggcccatcggtccttccccctggcaccctcctccaacgacgcaccctcgtgggggcacgacgcggccctcgggctcgcctcggtcaacggactacttcccctacagtcgctctgagcgggctggcaaggcgcatagnnnnnnnnnnn

SEQ ID NO: 125936 - DNA, 574 bp, Homo sapiens
  misc_feature: GYAE6OF01AWQFI.4.38.D05.1.454.CMB.1.raw
  modified_base (382)..(382): a, c, t, g, unknown or other
  misc_feature (382)..(382): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgcaggtgccgggaaggcctggaatggatggggatcgatctatcctgatgactctgataccagatacagtccgtcgttcgaacggccgctccaccttcnctacgccgacaacgtccactcacgcacccgccctaccctgcctaggcggtagcgacgcctaggaacgggtccctaccgggacacggcaccaatataattacctaggtacgacggaaaaccaggtacgtacgacgtaccctaccgtaaacccccgttaagggtaacctttcggaaccgtacggtacccggggg

SEQ ID NO: 125937 - DNA, 592 bp, Homo sapiens
  misc_feature: GYAE6OF01AZM3N.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcattctccaggcaccctgtctttgtctccaggggaaangccaccctctcctgcagggccagtcagagtgtagcagcagctacttaacctggtaccagcagaaacctggccaggcctcccaggcctcctcatctatggtgcactccagcgacgggccactggcactcccagacaggttcagtggcaggtgggtctgggacagacttcactctcacatcagcagactggacgccgtagtaagtattttcgactagttgtatttacgtgtaccagtcgtaggttggttacgggtacgtccgtaccgtaaccggtaccggttccgggaaccgtaaacggggaaccgtaaaggggtacggaaaacgtaacgaaaacggtaaccgttacgggtacggaccgtacggaccaacccgtacgttccgttggttacccg

SEQ ID NO: 125938 - DNA, 510 bp, Homo sapiens
  misc_feature: GYAE6OF01BPI3D.4.38.D05.1.454.CMB.1.raw
  modified_base (199)..(199): a, c, t, g, unknown or other
  misc_feature (199)..(199): n is a, c, g, or t
  modified_base (503)..(503): a, c, t, g, unknown or other
  misc_feature (503)..(503): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgctccaggggaangccaccctctcctgcagggccagtcagagtgttagcagcagctacttaacctggtaccagcagaaacctggccaggctcccaggctcctcatctatggtgcatccagcagggccactggcatcccagacaggttcagtggcaggtgggtctgggacagacttcactctcaccatcagcagacgtggacgcctagaagtattttgctagttgtattacgtgtcagctagtgtggtagctcgacgacgttcggaccgaagggaccgaagggtagaaactacgaaacgacgtgtggacgtcgacacntcgtgtc

SEQ ID NO: 125939 - DNA, 608 bp, Homo sapiens
  misc_feature: GYAE6OF01CQP64.4.38.D05.1.454.CMB.1.raw
  modified_base (400)..(400): a, c, t, g, unknown or other
  misc_feature (400)..(400): n is a, c, g, or t
  modified_base (541)..(541): a, c, t, g, unknown or other
  misc_feature (541)..(541): n is a, c, g, or t
tcagagcactgtagcacgaccggtgctcgatttagtatctgataggttgggtttgggggagtctccctcactgcccagctgggatctcagggcttctattttctgtcctccaccatcatggggtcaaccgcatcctcgccctctcctggctgttctccaaggagtctgtgccgaggtgcagctggtgcagtctggagcagaggtagaaaaaggcccggggagtctcgtagaagatctccgtgtaagggtctggatacattcgtttaggacctatggatcggctgggtgcgcgaggtcggaccgggaaagcgtaggaatggagtggggatcatctatcgtgatgactcgtagactaccgagtatacacgtccgttcgtcgaacggccgcgtccacctttcncgtacgaccgaactacgtacctatacacgaccaccgaccctaccgtggcaggtggacgcacgtcgtacggaaccggtccgtacgggacacggaccgacctaagttaacttaacgttacgtagtacgaaaccgtaaaaccgngtaacgacgtacgtaccctaccgtaaccccggtaagttacctttacgaaccgttccggtaacggggg

SEQ ID NO: 125940 - DNA, 548 bp, Homo sapiens
  misc_feature: GYAE6OF01C77H0.4.38.D05.1.454.CMB.1.raw
  modified_base (290)..(290): a, c, t, g, unknown or other
  misc_feature (290)..(290): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctgtaccagacagaaacctggccaggctcccaggctcncatctatggtgcatccagcagggccatgcatcccagacaggttcagtggcaggtggtctgggacagtactcactctacaccatcagcagacgtggacgcctagaacgtattttgctagtgtaattagtagtcagtcgagttggtggtacgtctccgaaccggtacgttccggaccgtaaacgggacctaaagggtacgtaaaacgtacgaaacggtaactacgggtagtcgtacggactaccgtatcgttcgttaccc

SEQ ID NO: 125941 - DNA, 555 bp, Homo sapiens
  misc_feature: GYAE6OF01EM8PS.4.38.D05.1.454.CMB.1.raw
  modified_base (199)..(199): a, c, t, g, unknown or other
  misc_feature (199)..(199): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgctcaggggaaangccaccctctcctgcagggccagtcagagtgtagcagcagctacttaacctggtaccagcagaaacctgaccaggctcccaggcctctcatctatggtgcatccagcgagggccacgtggcactcccagacaggttcagtggcaggtgggtctgggacagacttcactctcacatcagcagactggagcctagaagtattttgactagtgttattacgtgtacagctaggtggttagggtagtccgtacgaccggtacgttccgggaccgaaaggggacccaaagggttacggaaaacgttaccgaaaacggtaacgtagggtacggacgtcggaacaaccctattccgtgttacc

SEQ ID NO: 125942 - DNA, 519 bp, Homo sapiens
  misc_feature: GYAE6OF01BZHN0.4.38.D05.1.454.CMB.1.raw
  modified_base (241)..(241): a, c, t, g, unknown or other
  misc_feature (241)..(241): n is a, c, g, or t
  modified_base (379)..(379): a, c, t, g, unknown or other
  misc_feature (379)..(379): n is a, c, g, or t
  modified_base (490)..(490): a, c, t, g, unknown or other
  misc_feature (490)..(490): n is a, c, g, or t
  modified_base (493)..(519): a, c, t, g, unknown or other
  misc_feature (493)..(519): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcggaaggccgcgtcacctttctcagccgacaagtccatcagcaccgcctacctgcagtggagcagcctgaaggcctcggacagcgccatatattactgtagaccgaaaaccngtagcagctcaccccgtaaggactttgactacgtgggccagggaaccctggtcactcgtctcctcacgcctccaccgaacgggcccagttccggtccttcccccgtggcccaccctcctaccaagcgaccaccgtcgnggggccacgacgccggcccgtgggctcgccgtcggtaacgaacgtaccttaccttacctacgtagtcgtctcgtggaggccgggcgtcggacgaacggccgtacacgtagngcnnnnnnnnnnnnnnnnnnnnnnnnnnn

SEQ ID NO: 125943 - DNA, 552 bp, Homo sapiens
  misc_feature: GYAE6OF01A710Q.4.38.D05.1.454.CMB.1.raw
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
tcagagcactgtagcacgaccggtgctcgatttagtatctgatagttgggtttgggcggtgctcgatttagtatctgatagttgggtttgggattcacgttgcagatgtagggctgggtgcgccaggtgcccgggaaaggcctggaatggatggggatcatctatcctgatgactctgataccagatacagtccgtccttcgaaggccgcgtcaccttctcagccgacaagtccatcagccaccgcctacctgcagtggagcagcctgaaggcctcggacagcgccatatattactgtgacgaaaaccagtagcagctcaccccgtaagcttgactacgtgggccagggaccctggtcactcgtctcctcacgcctccaccacggcccacgtccggtccttccccgtcggcctacccctcctaccaacgacgccacccgtcgtcggggacacgacgccgcccgtcgggcgtcgccgtggtaccgaacggtacctaccttccctacagtcgtcgtcgtggacggccgggcgtcggacgaacggcgacgntgcn

SEQ ID NO: 125944 - DNA, 461 bp, Homo sapiens
  misc_feature: GYAE6OF01B8FAW.4.38.D05.1.454.CMB.1.raw
  modified_base (236)..(236): a, c, t, g, unknown or other
  misc_feature (236)..(236): n is a, c, g, or t
  modified_base (423)..(423): a, c, t, g, unknown or other
  misc_feature (423)..(423): n is a, c, g, or t
  modified_base (452)..(461): a, c, t, g, unknown or other
  misc_feature (452)..(461): n is a, c, g, or t
tcagagcactgtagcacgaccggtgctcgatttagtatctgatagttgggtttaggtgtccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaacggcccatccggtcttccccctggccaccctcctccaacgacgccacctcgtgggggccacaggccggcccgtgggctcgcctggtccaacggactaccttccctacagtnctctgagcgggctggcgaaggcgcatagnnnnnnnnnn

SEQ ID NO: 125945 - DNA, 626 bp, Homo sapiens
  misc_feature: GYAE6OF01EYY8V.4.38.D05.1.454.CMB.1.raw
  modified_base (439)..(439): a, c, t, g, unknown or other
  misc_feature (439)..(439): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaggcccggggagtctctgaagatctcctgtaagggttctggatacatctttaggacctactggatcggctgggtgcgccaggtcgcccggggaaaggcctgggaatgggagtggggatcatctatcctgatgactctgataccagatacagtccgtcttcgaacggccgcgtccaccttctacacgccgacaacgtccatcagccaccgccctacctgcgagtgggacncgagcctagggaacggcccgtaccgggaaccgacggccgaccctaagttaacttaacgtttaaccgttcggtaacgaaacccggtaaaaaacctagggttaaacggacccaacggtacccgtaaccccgtaacccccgggttaaagggtaccctttttacggaaccgttaccgggtaacccgggggg

SEQ ID NO: 125946 - DNA, 584 bp, Homo sapiens
  misc_feature: GYAE6OF01C4NBM.4.38.D05.1.454.CMB.1.raw
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtgcagctggtgcagtctggagcaggaggtagaaaaaggcccggggagtctctgaagatctcctgtaagggttctggatacattctttacggacctactggatcggcgtgggtgcgccgagggtcggacccggggaaaggccgtagggaagtgggagtggggatcatctatcctgatgactctgatacagatacgacgtccgtccttcggacggccgtcgtctaccttctcacgccgactaacgtccatcgacgccaccgcctacctgcgagtggacgcacgcgtagaacggccgtacggacgacgccgacctatacttacttactcgtacgaaccgaaaccgtagtacgcgacgtaccgtacccgtaacccggttaagtaccgttacgtaccgttacggtaccgggg

SEQ ID NO: 125947 - DNA, 524 bp, Homo sapiens
  misc_feature: GYAE6OF01BN1Z6.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatgggatggggatcatctatcctgatgactctgataccagatacagtccgtccttcgaaggccgcgtcaccttctcagccgacaacgtccatcacgccacccgcctacctgcagtcggagcagcctggaacggcctcggacagcgccatatattcgtgtagacgaaacagtacgcagcctaccgacccggtaagtactttgacgtcggtacgggg

SEQ ID NO: 125948 - DNA, 546 bp, Homo sapiens
  misc_feature: GYAE6OF01CTLIW.4.38.D05.1.454.CMB.1.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (521)..(521): a, c, t, g, unknown or other
  misc_feature (521)..(521): n is a, c, g, or t
  modified_base (523)..(546): a, c, t, g, unknown or other
  misc_feature (523)..(546): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctggacagcgccatatattacngtgacgaaaaccngtagcagctcaccccgtaagactttgactacgtggggccacgggaaccctggtcactcgtctcctcacgccctccaccgaacggcccactccggtcccttcccccgtcggcctacccctcctaccgaacgacgccacccgtcgtcgggggcaccggacggccggtcccgtgggcctcggtcccgtgggtaccaacgggtacccttaccgttccccgtaacgtacggttcgtccgttcgtggacggccggggtccgttgggaccgaacgggccgacgtaagtacgngnnnnnnnnnnnnnnnnnnnnnnnn

SEQ ID NO: 125949 - DNA, 646 bp, Homo sapiens
  misc_feature: GYAE6OF01CSSCM.4.38.D05.1.454.CMB.1.raw
  modified_base (363)..(363): a, c, t, g, unknown or other
  misc_feature (363)..(363): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcccggggagtctctgaagatctcctgtaagggttctggatacatctttaggacctactggatcggctgggtgcgccaggtggaccccggggaaaggccgtggaatgggagtgggggatcatctatcctgatgactctgataccagatacncgtccgtctcgaacggccgccgtcaccttctcacgacccgacaacgtaccatccacgcccacccgcctacccgtcgccaggtcggacgccaacggccgtaggaacgggcccgtacgggaccacggccgaccgtattaacttacgtttacgtacggtacgaaccggtaaaaacccgtaggttaacggcctaaccgggtaccccttaacccggtaaaccccccgggttaaacgggttacccgttttaaccgggtaacccgttaaccggggttaaccccggggggg

SEQ ID NO: 125950 - DNA, 650 bp, Homo sapiens
  misc_feature: GYAE6OF01BFXR8.4.38.D05.1.454.CMB.1.raw
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaagacgccaccctctcctgcagggccagtcagagtgttagcagcagactacttaaccgtggtaccagcaacgaaccgtcggccaggcctcccgaggcctcctcattctagtcggtcgcagtccgagccgacgggccctacgtcggacctacgtacccgagaccgtaggttaccgagtcgggacgtagggtcgggtcgtagggactaggtaccttcacttcctacaccatcgacgtacgagtaccgtggaactccgtaagtaacgttntttcgataggttnttacgttacgtcgtacaggcgttaggttcggtaggtacgtacccttaccggaccggttacggttaaccgggaccggtaaacggggtacccgtaaaggggttacgaaaacttacccggaaaacggtacgttcggtaagggccttacgactaccgtattccgttaggttacccc

SEQ ID NO: 125951 - DNA, 526 bp, Homo sapiens
  misc_feature: GYAE6OF01ERCJ6.4.38.D05.1.454.CMB.1.raw
  modified_base (202)..(202): a, c, t, g, unknown or other
  misc_feature (202)..(202): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcattctccaggcaccctgtctttgtctccaggggaaagngccaccctctcctgcagggccagtcagagtgttagcagcagctacttaactggtaccagcagaacctggccaggctcccaggctcctcatctatggtgcatccagcagggccactggcatcccagacaggttcaggtggcaggtggtctgggacagacttcactctcacatcagcagactggacgccgtagaagtattttgactagtgttattactgtcgagtcgtagtgtggtagctacgaccggtacgttccggaccgtaacgggaccgaagggtacggaaactacgaaacgtacgtcggtgactcgaccactactcgtgtc

SEQ ID NO: 125952 - DNA, 453 bp, Homo sapiens
  misc_feature: GYAE6OF01BG7N7.4.38.D05.1.454.CMB.1.raw
  modified_base (236)..(236): a, c, t, g, unknown or other
  misc_feature (236)..(236): n is a, c, g, or t
  modified_base (439)..(439): a, c, t, g, unknown or other
  misc_feature (439)..(439): n is a, c, g, or t
  modified_base (445)..(453): a, c, t, g, unknown or other
  misc_feature (445)..(453): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcacgcctccaccaagggcccatccggtccttccccctggccaccctcctccaagacgcacctcgtcgggggcacagccggccctgggctgcctggtcaaggactacttccctacagtgctctgagcgggctggcaaggcncatagnnnnnnnnn

SEQ ID NO: 125953 - DNA, 561 bp, Homo sapiens
  misc_feature: GYAE6OF01E2NSQ.4.38.D05.1.454.CMB.1.raw
  modified_base (202)..(202): a, c, t, g, unknown or other
  misc_feature (202)..(202): n is a, c, g, or t
  modified_base (382)..(382): a, c, t, g, unknown or other
  misc_feature (382)..(382): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtgttagcagcagctacttaacctggtaccagcagaaacctggccaggctcccaggcctcctcatctagtggtgcatccagccgagggccacgtggcactcccagacaggttcagtcggcaggtgggtctgggacaggtaccttcaccttcncaccatcagcagacgtggacgcctagaagtatttgctagtgttattactgtcagctaggtgtacgggtagccgtcgaccggtaccggttcggaccgaaagggtacccgaaagggtacggaaacgttacgaaacggtaacgttggtacggacgtacgacaaccgtacttccgttgttacc

SEQ ID NO: 125954 - DNA, 705 bp, Homo sapiens
  misc_feature: GYAE6OF01BV0H9.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagcgccaccctctcctgcagggccagtcagagtgttagcagcagctacttaactggtaccagcagaacctggccaggcctcccgaggcctcctcatctagtggtgcatccagcgacgggcccacgtcggacactcccgaagaccgtaggttcgaggtcggacgtagggtcgggtcgtaggggaactacggtacctttcgaccttccgtaccaacctactacgacgacgaacggtacgtcgggaacgtacccgttaggtaaacgtttagtttttcggacgttaaggtttacgttaacgttttacgttacggttaccgtacggtaccgtagggtttcgggttacgggttaacgtcccgttacccggtaacccgggtaccgggtttacccgggaaccggtaaacggggtaacccgtaaaggggttaacggtaaaacgttaacccggaaaacggtacggttacgggtcggtaccgtacggaccgtaaccgtattccgttcgtttacccg

SEQ ID NO: 125955 - DNA, 624 bp, Homo sapiens
  misc_feature: GYAE6OF01BV8VY.4.38.D05.1.454.CMB.1.raw
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
tcagagcactgtagcacgaccggtgctcgatttagtatctgatagttggggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctgggagcgaggaggtagaaaaacggcccggggagtcgtctgaaagatctcctggttaagggttctggatacattcgtttaaggacctacgtggagtcggcgtgggtcgccgccgagggtcggaccgggaaggccgtaggagtggagtgggatcatcatctgatgtactcgtgactacgagtatacgacgtccgtcttacggacggtccgcgtcaccttctacacgaccgatagtaccatacgacgccacccgccttacgngacgtagcggtacncgagtccgaggtaaccggtcccgtacgggaccaggccctagtacttaacgttacttcggtacggtaacgaaaccgtaaacgaggttacgaaccgtacgtacccgtacccggtaaacccggtaacggttaccgtacggtaaccgtcgggtacccgggg

SEQ ID NO: 125956 - DNA, 525 bp, Homo sapiens
  misc_feature: GYAE6OF01AEG4U.4.38.D05.1.454.CMB.1.raw
  modified_base (427)..(427): a, c, t, g, unknown or other
  misc_feature (427)..(427): n is a, c, g, or t
  modified_base (485)..(485): a, c, t, g, unknown or other
  misc_feature (485)..(485): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaggcctggaatggagtggggatcatctatcctgatgactctgatacagatacagtccgtccttcgaacggccgcgtctaccttctcagccgacaacgtccatcacgccaccgcctacctgcagtggancacgcctgaacggcctacggaccagccgaccatacttatacgtagcgaccgaaacgtntagcacgctaccgacccgtagacttgacgtcgtaccgggg

SEQ ID NO: 125957 - DNA, 665 bp, Homo sapiens
  misc_feature: GYAE6OF01AFFS1.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaacggcccggggagtctctagaagatctccgtggtaagggttctggatacattcgttaggacctacgtggatcgggcgtggggtcgccggccgagggtcggacccggggaaacggccgtaggaagtgggagtggggatcatctatcctgatgactctagactacagtactacgtacgtccgttccgttacggaacggtccgtcgtacctaccttctcgacgacccgaactaacgtccactcgacgacccacccgccctaccgtcgcgtaggtcggacgcacggccgtaggaccggtccgtacggacgacggaccgacctagttaacttaacgttaccgtagggtaaccgaaaccggtaaaaccgtaggtaacggaccgaccggtacccgtaccccgtaaaccccgggtttaaacggttaccgtttacggtaaccggttaaccgggtacccggggg

SEQ ID NO: 125958 - DNA, 509 bp, Homo sapiens
  misc_feature: GYAE6OF01AKXYU.4.38.D05.1.454.CMB.1.raw
  modified_base (237)..(237): a, c, t, g, unknown or other
  misc_feature (237)..(237): n is a, c, g, or t
  modified_base (453)..(453): a, c, t, g, unknown or other
  misc_feature (453)..(453): n is a, c, g, or t
  modified_base (484)..(509): a, c, t, g, unknown or other
  misc_feature (484)..(509): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagcctcacccgtaaggactttgactacgtgggccagggaaccctggtcactgtcctcctcacgccctccaccgaacgggccccatccggtccttcccccgtggccaccctcctaccaacggcgcctaccgtcgtcgggggcacgacggccggcccgtgggcctggcccttcgggtacaacggtacttaccgttcctacgagtcgccttcgngacggcgggctggcgaacgggcgacgatagnnnnnnnnnnnnnnnnnnnnnnnnnn

SEQ ID NO: 125959 - DNA, 616 bp, Homo sapiens
  misc_feature: GYAE6OF01EZIDS.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaggcccggggagtctctgaagatctcctgtaagggttctggatacatctttaggacctactggatcggctgggtgccgccgagggtcggacccggggaaaggcctgggaatggagtggggatcatctatcctgatgactctagataccagactacacgttcccgtcgtttacggaacggcccgccgttacctacccgtttctcgacggcccgaacaacgtccaatccagcccacccgtccctaccgtcgcgaggtcggacgcgacgccgtaggaaccggcccgtacgggacgacggccgtaccctattaacttacgttacgtacggtacgaaccgaaaaccgaggtacgcacgtcctacccgaaccccggttaaggtaccttttacgaaccgttcgggtaccgggg

SEQ ID NO: 125960 - DNA, 638 bp, Homo sapiens
  misc_feature: GYAE6OF01E0I9L.4.38.D05.1.454.CMB.1.raw
  modified_base (200)..(200): a, c, t, g, unknown or other
  misc_feature (200)..(200): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaattgtgttgacgcagtctccaggcaccctgtctttgtctccaggggaaancgccacctctcctgcagggccagtcagagtgttagcagcagtctacttaaccgtggtaccagcagaacctggaccaggcctacccgaggcctccgtctaactcgtagtggtgcacgtccgagcacggccacgtggcacgtcccagacgtacggttcaggtcggacgtagggtcgggtctaggggaactaggtaccttcgacttcgtaccacctagtcagctaggacgtggacgtaccgtagtaaacgttagtttcggacgtagttagttaactttacgtacgtacgacgtccgtaggttcggtagggtacgtaccgttacgaacccggttacggttacccgggaccgtaaacgggtaccgtaagggtaacggtaaaactacgaaacggtacgtacgggtacggtacgtacggacccagtaacgttccgtaggtttccc

SEQ ID NO: 125961 - DNA, 496 bp, Homo sapiens
  misc_feature: GYAE6OF01BBQUM.4.38.D05.1.454.CMB.1.raw
  modified_base (236)..(236): a, c, t, g, unknown or other
  misc_feature (236)..(236): n is a, c, g, or t
  modified_base (471)..(471): a, c, t, g, unknown or other
  misc_feature (471)..(471): n is a, c, g, or t
  modified_base (479)..(496): a, c, t, g, unknown or other
  misc_feature (479)..(496): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcacgccctccaccaacgggcccatccggtccttccccctggccacccctcctccaaagacgccaccctcgtggggccacgaggccggcccgtgggctgcccgtggtacaacggtacctacttccctacaggtcgcttcgtcggacggccgggtctcgggcgaaacgggccgnaactaggnnnnnnnnnnnnnnnnnn

SEQ ID NO: 125962 - DNA, 471 bp, Homo sapiens
  misc_feature: GYAE6OF01A3GDX.4.38.D05.1.454.CMB.1.raw
  modified_base (237)..(237): a, c, t, g, unknown or other
  misc_feature (237)..(237): n is a, c, g, or t
  modified_base (419)..(419): a, c, t, g, unknown or other
  misc_feature (419)..(419): n is a, c, g, or t
  modified_base (448)..(471): a, c, t, g, unknown or other
  misc_feature (448)..(471): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagctcaccccgtaagactttgactactgggccagggaaccctggtcactgtctcctcagcctccaccaagggcccatcggtcttccccctgccaccctcctccaagacgccacctcgtcgggggcacgacgccggcccgtgggctgcctcggtcaacggactaccttcctacacgtnctctgagcgggctggcgaggcgcatacgnnnnnnnnnnnnnnnnnnnnnnnn

SEQ ID NO: 125963 - DNA, 559 bp, Homo sapiens
  misc_feature: GYAE6OF01B4B7S.4.38.D05.1.454.CMB.1.raw
  modified_base (238)..(238): a, c, t, g, unknown or other
  misc_feature (238)..(238): n is a, c, g, or t
  modified_base (530)..(533): a, c, t, g, unknown or other
  misc_feature (530)..(533): n is a, c, g, or t
  modified_base (536)..(559): a, c, t, g, unknown or other
  misc_feature (536)..(559): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaacggcctcggacagcgccatatattactgtgacgaaaaccngtagcagctcacccgtaagactttgactactgggccagggaaccctggtcactgtctcctcacgccctccaccgaacgggccctaatccggtcctttcccccctcggtaccaccccgttccctaccgaagacgccaacccgttcgtcgggggaccaccgaggcccgggccctggggcctcggcccgttgggtaccaaacgggtaccttaaccgtttcccctaacgacgttcggccttcgtacggacggtcccggggtcgttacgggaccgaacgggccgacgtaagtacggnnnngcnnnnnnnnnnnnnnnnnnnnnnnn

SEQ ID NO: 125964 - DNA, 688 bp, Homo sapiens
  misc_feature: GYAE6OF01C6ZSB.4.38.D05.1.454.CMB.1.raw
  modified_base (252)..(252): a, c, t, g, unknown or other
  misc_feature (252)..(252): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgctccaagggaagcgccaccctctcctgcagggccagtcagagtgttagcagcagctacttaaccnggtaccagcagaaacctcggcaggcctccaggctcctcatctatggtgcactccaggcgacgggaccctacgtcgggccaactcccgaagtaccgtaggtttaccgaggttcgggcgtagggttggggtcgtaggggacctacgtactttccaaccttcgtaccaccatccgagaccgacgtacgtggacgtaccgttaaggaacgttacgttttcgacgttagtgtttaacttttacgtgttaccgaggtccgtaagggttcggtttagggtacgtaccgttcccggtaacccggttaccgggtttaccgggaacccgtaaaacggggaaccgtaaaggggtaacggtaaaacgtaaccggaaaaccggtaacggttacgggttacggtacgttaccggtaaccgaacccttaagttcccgtttacggttacccg

SEQ ID NO: 125965 - DNA, 729 bp, Homo sapiens
  misc_feature: GYAE6OF01DK9E8.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaaggcccggggagtctctgaagatctcctggtaagggttctggatactatctttaggacctacgtggagtcggcgtgggtgccgccgagggtcggacccggggaaaggccgtaggaagtggagtggggactcgaatctatccgtgacgtgacctcgtagaactaccgagtacgtaacgtacggttcccgttccgtttacggaaacggtcccggtccgttaccctaccgtttcctaccgaacggtacccgaaccgtaacgtcccaattaccgaaccggaccctaacccggtccccttacccgtcggaccgtacggttacgggacgtacggaaccgtcccggtaacgggaacccgggtcccggtaccgggaaccgaccggtacccgaccctaagttaacttaaccgtttacgacggttacgaaacccggaaaaccctaggttaaccggacctacggtaccctaacccccggtaaacccggtaacgttaaccgtttcgaaccgttaccggtaacccgggggg

SEQ ID NO: 125966 - DNA, 642 bp, Homo sapiens
  misc_feature: GYAE6OF01EFRRL.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctgggagcaggaggtagaaaaaggcccggggagtctctgaagatctcctgtaagggttctggatacattctttaggaccttactggatcggctggggtgcgccgaggtcggacccgggaaaggcctgggaatgggagtggggatcgatctatcctgatgactctgataccagatacacgttccgtccttacggaacggccgtcgtctaccttctcacgccgaacaacgtccatcacgccaccgccctacctgctaggtcggagcacgtccgtacggaacgggtcccgtaccgggtaaccgacggtcccggacctaacttaacgttaacttttaaccgtaggtaaccggaaccggaaaaacccctaggttaacgaccaacggtaccctaaccccgtaacccccggttaaaagggttaccctttacggtaaccgttacgggtaacccgggggg

SEQ ID NO: 125967 - DNA, 263 bp, Homo sapiens
  misc_feature: GYAE6OF01D68TK.4.38.D05.1.454.CMB.1.raw
  modified_base (250)..(263): a, c, t, g, unknown or other
  misc_feature (250)..(263): n is a, c, g, or t
tcagagcactgtagcacgaccggtgctcgatttagtatctgataggtgggtctgggacagacttcactctcaccatcagcagactggagcctgaagattttgcagtgtattactgtcagcagtgtggtagctcaccgacgttcggccaagggaccaaggtggaaatcaaaacgaactgtggctgcaccatctgtcttcatcttcccgccatctgctacagtgctctgagcgggctggcaaggcgcatagnnnnnnnnnnnnnn

SEQ ID NO: 125968 - DNA, 253 bp, Homo sapiens
  misc_feature: GYAE6OF01CLM7X.4.38.D05.1.454.CMB.1.raw
  modified_base (249)..(253): a, c, t, g, unknown or other
  misc_feature (249)..(253): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatccttcccgcatctgactacagtgctctgagcgggctggcaaggcgcatagnnnnn

SEQ ID NO: 125969 - DNA, 617 bp, Homo sapiens
  misc_feature: GYAE6OF01C3TD1.4.38.D05.1.454.CMB.1.raw
  modified_base (368)..(368): a, c, t, g, unknown or other
  misc_feature (368)..(368): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctagaagatctcctgtaagggttctggatacattctttaggacctactggatcggctgggtgcgccgaggtcggacccggggaaagccgtaggaatgggagtggggatcgatctatcctagatgactctgactaccagactacncgtcccgtcgttcgaacggcccgcgtaccaccttctcacgccgaactaacgtccatccagccacccgccctaccgtcgcgtagtggacgcgacgccgtaggaacggcccgtcgggaaccacggaccgacctataacttaacgttacgtggtaacgaaccgtaaaaaccgacggtaacgcctaacgtcctacccgtaaacccccggttaaaggtaccgttttaacacccggggggttacgtacccggggg

SEQ ID NO: 125970 - DNA, 224 bp, Homo sapiens
  misc_feature: GYAE6OF01ER0UU.4.38.D05.1.454.CMB.1.raw
  modified_base (211)..(224): a, c, t, g, unknown or other
  misc_feature (211)..(224): n is a, c, g, or t
tcagagcactgtagcacgaccggtgctcgatttagtatctgatagttgggtttgggcggtgctcgatttagtatctgatagttgggtttggggggaagaggaagactgacggtccccccaggagttcaggtgctgggcacagcggccctgggctgcctggtcaaggactacttccctacagtgctctgagcgggctggcaaggcgcatagnnnnnnnnnnnnnn

SEQ ID NO: 125971 - DNA, 664 bp, Homo sapiens
  misc_feature: GYAE6OF01AGZ2I.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccacggagaaattgtgttgacgcagtctccaggccaccctgtctttgtctccgaggggaaagcgcccaccctctcctgcagggccagtcagagtgtagcagcagctacttaacctggtaccagcagaacctggccaggcctcccgaggcctcctcatctagtggtcgcactccgaggcgacgggccacgtggcctacgtaccccgaggaccgaggttcagggtgggctagggttcgggtcgtacggggaactacggtacctttcgacctcctaccaaccctagtaccgacggaccaggtaccggtacgggacgtacccgtagggtaaacgttgttttcgaccgtaggtttacgttaactttacgtggttaccaggttccgtaagggtttcggtacgggttacgtccgttacccgaaccgggttaccggttacgggaccggtaacgggtaacccgtaagggtacggtaaactaccggaaacggtacgttggtacggtccgtacgaccaccgtgttccgtcgttcc

SEQ ID NO: 125972 - DNA, 877 bp, Homo sapiens
  misc_feature: GYAE6OF01DSPNZ.4.38.D05.1.454.CMB.1.raw
  modified_base (165)..(165): a, c, t, g, unknown or other
  misc_feature (165)..(165): n is a, c, g, or t
tcagagcactgtagcacgaccggtgctcgatttagtatctgatagttgggtttgggggagtctccctcactgcccagctgggatctcagggcttctattttctgtcctccaccatcagtggggtcaaccgccatcctcgccctcctcctggctgttctccaaggngtctgtgccgaggtgcagctggtgcagtctggagcgaggaggtaaggaaaaacggcccggggatctcgtagaagtacttccgtcgtaggttaacgggttctaggtaactactagttacgtttaacggaccttacgtaggtacgttccgggcgtggggtcgccggtaccggaggggtccgggaaccccgggggtaaacggtccggtaagggtaaaggtggggtaacgggttagggggtactacgtaacgtttaccgttaacgttcccgtaggtacgttacggtaccttacgtagtaaaccgtaaccgaagtaacttaccgtaccggttcccgttaccggttacggaaccgggtcccgtccggtacctaccgttcgaccgtaaccggaccgaactaacgtaccctaacgtaccgacgtacccgacccgtaccgttaccgtacgacggtaacggcgggacgtaccgaacggtccggtacgggaaccggtcccggtaaccgggaccgaaccggtacccgtaacccgttaagttaaaccgtttaacgtttacggttaaccgggtaaacccggtaaaaccggtaaaaacccggttaggtaacccgtaaccggtaaccccggttaccccgttaaacccccgggttaaaccccgggttaaacgggtttaacccgttttaccggggtaaaccccggttacccgggggttaaccccgggggg

SEQ ID NO: 125973 - DNA, 211 bp, Homo sapiens; identical to SEQ ID NO: 125892
  misc_feature: GYAE6OF01B5E3F.4.38.D05.1.454.CMB.1.raw
  modified_base (210)..(211): a, c, t, g, unknown or other
  misc_feature (210)..(211): n is a, c, g, or t

SEQ ID NO: 125974 - DNA, 521 bp, Homo sapiens
  misc_feature: GYAE6OF01DEV41.4.38.D05.1.454.CMB.1.raw
  modified_base (238)..(238): a, c, t, g, unknown or other
  misc_feature (238)..(238): n is a, c, g, or t
  modified_base (495)..(521): a, c, t, g, unknown or other
  misc_feature (495)..(521): n is a, c, g, or t
tcagagcactgtagcacgaccggtgctcgatttagtatctgataggttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagctaccacccgtaagtacttgactacgtgggccaggaaccctggtcactgtctcctcacgcctccaccgaacgggccctacgtccggttcccttcccccgtcggcctaccctcctaccaacgacgccaccgtcgtcggggcacgacgcccggccgtgggcctcgccgtcggtacaacggtacctaccttcccctacgacgttcgccttcgtggacggcgggtcgtacgggacgtaacggcgacacgtagcnnnnnnnnnnnnnnnnnnnnnnnnnnn

SEQ ID NO: 125975 - DNA, 569 bp, Homo sapiens
  misc_feature: GYAE6OF01DZPUS.4.38.D05.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtgtagcagcagctactacngtacngcagaactgcagctccagctctcatctatggtncatccagcagggccacgtggcactcccagacaggttcaggtggctaggtgggtctgggacagtacttcactctacaccatcagcagacgtggacgaccgtagtaagtatttgactagtgttattactgtcagtcgtagttggtggtacgtccgttacgacccggtacggttccggacccgtaaacggggaccgtaaagggtacgggtaaaacgttaaccgaaaacggtaaacgttaggtacgggtacgtacggaccaccgtaacttccgttcggttaccg

SEQ ID NO: 125976 - DNA, 479 bp, Homo sapiens
  misc_feature: GYAE6OF01A12VM.4.38.D05.1.454.CMB.1.raw
  modified_base (237)..(237): a, c, t, g, unknown or other
  misc_feature (237)..(237): n is a, c, g, or t
  modified_base (378)..(378): a, c, t, g, unknown or other
  misc_feature (378)..(378): n is a, c, g, or t
  modified_base (460)..(479): a, c, t, g, unknown or other
  misc_feature (460)..(479): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagctcaccccgtagactttgactacgtggggccagggaaccctggtcactgtctcctcagcctcccaccgaacgggcccagtccggtccttccccctggccacccctcctccaacgcgcaccctcgtggggcacgngccgcccgtgggctcgccgtggtacaacggtcttaccttccctacgacgttcgctcgtgcggcgggctggacaggcgcatgnnnnnnnnnnnnnnnnnnnn

SEQ ID NO: 125977 - DNA, 220 bp, Homo sapiens
  misc_feature: GYAE6OF01D9FKT.4.38.D05.1.454.CMB.1.raw
  modified_base (214)..(220): a, c, t, g, unknown or other
  misc_feature (214)..(220): n is a, c, g, or t
tcagagcactgtagcacgaccggtgctcgatttagtatctgatagttgggtttgggcggtgctcgatttagtatctgatagttgggtttggggggaagaggaagactgaccggtccccccaggagttcaggtgcgtgggcacagccggccctgggctgcctggtcaaggactacttccctacagtgctctgagcgggctggcaaggcgcatagnnnnnnn

SEQ ID NO: 125978 - DNA, 650 bp, Homo sapiens
  misc_feature: GYAE6OF01DHLV9.4.38.D05.1.454.CMB.1.raw
  modified_base (347)..(347): a, c, t, g, unknown or other
  misc_feature (347)..(347): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctgaagatctcctaggtaagggttctggatacattctttaggacctactggatcggctgggtgcgcgaggtcggaccgggaaagccgtggaatggagtggggatcatctagtcctgatgactntgatacagatacacgttccgtccgtcgaacggccgtacgtctaccttctaccgacgacccgaacgaacgtccaacgttcaacgcccacccgtaccctaccgtcgaccgtaggtcggaacgcaacgtcctaacggaacggtcccgtacgggacgaccgaccgacctaacttaagttaacgtttacgtaggtaaccggaaaccgtaaaaaccgaaggttacgtacccgaacggtacccttaaccccggtaaacccggttaaacggttacgttttaaccggtaaccgttaccgggtaacccggggg

SEQ ID NO: 125979 - DNA, 566 bp, Homo sapiens
  misc_feature: GYAE6OF01DO9K7.4.38.D05.1.454.CMB.1.raw
  modified_base (452)..(452): a, c, t, g, unknown or other
  misc_feature (452)..(452): n is a, c, g, or t
tcagagcactgtagcacgaccggtgctcgatttagtatctgatagttggggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagacagaaacctggccaggctccaggctcctcatctagtggtgcatccagcgacgggccacgtggcactcccagacaggttcagtggcgaggtgggtctgggacacgacttcactctacaccatcagcagacgtggagctaggagttatttgctagtgttacttactgtacaggactaggtgttgggtacncctaccgaccggtacggttccggacccggtaaagggaccctaaagggagggtaaaactacggaaaacggtacgtgggtacggacttacgggactaccgtattccgttggttacc

SEQ ID NO: 125980 - DNA, 558 bp, Homo sapiens
  misc_feature: GYAE6OF01ESGSF.4.38.D05.1.454.CMB.1.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctcaagggaaagngccaccctctcctgcagggccagtcagagtgtagcagcagctaacttaacctggtaccagcaagaaacctggccaggctcccaggcctcctcatctagtggtgcatccagcgagggccactggcactcccaagacaggttcaggtggcaggtgggtctgggacagacttcactcncacatcagcagacgtggacgcctagaagtagtttgctagtgttaattacgtgtacgagcgtagtggtaggtacgcttaccgaccggtacgttcggaccgaaacggggaccgtaaagggtacggtaaaacgtaacgaaacggtaacgtaggtggacgtacgacaacctacttacgtgttaccg

SEQ ID NO: 125981 - DNA, 616 bp, Homo sapiens
  misc_feature: GYAE6OF01CWF7Q.4.38.D05.1.454.CMB.1.raw
  modified_base (364)..(364): a, c, t, g, unknown or other
  misc_feature (364)..(364): n is a, c, g, or t
  modified_base (457)..(457): a, c, t, g, unknown or other
  misc_feature (457)..(457): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggatctctgaagatctcctaggtaagggttctggatacattctttaggacctactggatcggcgtgggtgcgccgagggtcggacccgggaaaggccgtggaagtggagtggggatcgatctatcctagatgactcgtgactacganatactacgtccgtacttcggaacggccgtccgtacctaccgttctaccgacgtacccgaactacgtaccgactcgacgaccacccgcctaccngcgaggtcgacgcacgccgtagaacggtccctacgggactacggccgacctattaacgttactttacgcggtacgaaccgaaaacgtagtaacgacgacgtcccgtacccgaacccggttaacggtaccttttaacggccgttacgggtaacccggggg

SEQ ID NO: 125982 - DNA, 553 bp, Homo sapiens
  misc_feature: GYAE6OF01A633W.4.38.D05.1.454.CMB.1.raw
  modified_base (419)..(419): a, c, t, g, unknown or other
  misc_feature (419)..(419): n is a, c, g, or t
tcagagcactgtagcacgaccggtgctcgatttagtatctgatagttgggtttgggggagtctccctcactgcccagctgggatctcagggctttcattttctgtcctccaccatcatggggtcaaccgccatcctcgccctcctcctggctgttctccaaggagtctgtgccgaggtgcagctggtgcagtctggagcagaggtagaaaaagcccggggagtctctgaagatctcctgtaaggttctggatacatctttaggacctactggatcggctgggtgcgccaggtcgcccggggaaaggcctggaatgggatggggatcatctatcctgatgactctgatacagatacacgtccgtcttcgaaggccgcgtcaccttctcacgccacaagtccatcacgccaccgcctaccngcaggtggagcacgcctggaacggcctacgggacacggccgacctataacttattacgtgtacgaacgaaaaccgagtaacgcacgtcctaccgtaaaccccggttaggtacctttcgacgtacggtccggggg

SEQ ID NO: 125983 - DNA, 673 bp, Homo sapiens
  misc_feature: GYAE6OF01BX2QQ.4.38.D05.1.454.CMB.1.raw
  modified_base (208)..(208): a, c, t, g, unknown or other
  misc_feature (208)..(208): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
tcagagcactgtagcacgaccggtgctcgatttagtatctgataggtttggggtttggggagagctgctcagttaggacccagagggaaccatggaaaccccagcgcagcttctcttcctcctgctactctggctcccagactaccaccggagaaattgtgttgacgcagtctccaggccaccctgtctttgctacgaaagggaaacncgcccaccctctcctgcgagggccagtcagagtgtagcagcagcttacttaacgngtaccagcaagaacctgaccnggcctccgagctctactactactancggtgactacncgagccgacggccacgtgctacgtcccagaccgtaaggttcaaggtcggacgtaggtcgggtacgtcgggaactacgtactttccaactcctaccaactactacgacgaccaaggtaccgtaggacgtaccggtaagtaacggttagtttcggtacgttagttacgttaacgtttacgtggtacgtaacggtgtaacggttggtacgggtacgtaccgttaaccggtaccggttaccgggttaccgggaacggtaaccggtaaaccggtaacgggttaacggaaacgttaaccgaaacggttcggtacggtaggtacccgtacggactaaccggtacttacgtcggtttaccc

SEQ ID NO: 125984 - DNA, 729 bp, Homo sapiens
  misc_feature: GYAE6OF01B848U.4.38.D05.1.454.CMB.1.raw
  modified_base (705)..(705): a, c, t, g, unknown or other
  misc_feature (705)..(705): n is a, c, g, or t
  modified_base (707)..(707): a, c, t, g, unknown or other
  misc_feature (707)..(707): n is a, c, g, or t
  modified_base (719)..(719): a, c, t, g, unknown or other
  misc_feature (719)..(719): n is a, c, g, or t
  modified_base (722)..(722): a, c, t, g, unknown or other
  misc_feature (722)..(722): n is a, c, g, or t
  modified_base (726)..(726): a, c, t, g, unknown or other
  misc_feature (726)..(726): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcggaaggccgcgtcaccttctcagccgacaagtccatcgcaccgcctacctgcgagtaggagcacgccgtgaacggccgtcggacacgccgaccaatattaattacgtgtacgacgaaaaaccagtagacgacgaccgttaccgaacccccgtaagggtaacctttgtaccgtaacgtcgggggaccgaacggggtaaccccgtcggtacgtacctcggttccctaccctttaccgaccggtccctaccccgaaacccgaaccggggtaccccgtaccgtttacccggttccccgtttccccccgtacgggtcccctacccctaccccgtacaaacggacgcccgtaccgtcgggtcggggaccacgaaccggtccggtcccggtcgggtcgtcgtccgtcgggttaacgaacggtacccttaccttacccgtacgtacgttcgtacccgtacgttacgggaaccggcggggttacgtcggggaaacccgaaacggggtcccgaaccgtaacgggtaacggcgcgtacgtcgcgcgtcgacgacgtacgagtacgtacgacgcgcgtacgtcgtgngngtagcgcgtcgntancgtngcg

SEQ ID NO: 125985 - DNA, 666 bp, Homo sapiens
  misc_feature: GYAE6OF01BWY0S.4.38.D05.1.454.CMB.1.raw
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgagggaagagcccacctctcctgcaggccagtcagagtgtagcagcagctactacngtacagcagaactgcagctccagctctnatctagtggtgcactccgagcgacgggccctacgtcggacctaccgtacccgaaggaccgtaggttccagggttcggacgtagggtcgggtcgtacgggactacggtaccttcactcctaccacctagcgtacggacaacggtcgtaggacctcgttaagtaacgttntttacggntacgtttatacgtttacgtcgtaacgagtcgttagggttacgtacggtacgaccgttacccggaaccgggttaccgtaccgggtaaccggtaaacgggtacccggtaaacgggtaaacgttaaaccgtaaccggtaaaaacccggttcggttacggtacggtaccgttaccgtaacccgtaaccgttttaccgttcgtttcccggtttaacccc

SEQ ID NO: 125986 - DNA, 212 bp, Homo sapiens
  misc_feature: GYAE6OF01AVQY9.4.38.D05.1.454.CMB.1.raw
  modified_base (209)..(212): a, c, t, g, unknown or other
  misc_feature (209)..(212): n is a, c, g, or t
tcagagcactgtagcacgaccggtgctcgatttagtatctgatagttgggtttgggcggtgctcgatttagtatctgatagttgggtttgggggaagaggaagactgacggtccccccaggagttcaggtgctgggcacagcggccctgggctgcctggtcaaaggactactccctacagtgcctgagcgggctggcaaggcgcatagnnnn

SEQ ID NO: 125987 - DNA, 566 bp, Homo sapiens
  misc_feature: GYAE6OF01CGYA9.4.38.D05.1.454.CMB.1.raw
  modified_base (238)..(238): a, c, t, g, unknown or other
  misc_feature (238)..(238): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(566): a, c, t, g, unknown or other
  misc_feature (539)..(566): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcacccgcctacctgcagtggagcagcctgaaggcctcggacagcgccatatattactgtgacgaaaaccngtagcagctcaccccgtaagactttgactacgtggggccacgggaaccctggtcacttgtcctcctcacgccctccaaccgaacggggccccaagttcccggttcccttcccccgtcggccctacccctcctccaaagcgccaccgtcgtcggggcacgacggccggcccgtggggcctcggccgtacgggtaccgaacgggtaccttacccgtttccccgtacgtacgttcgtccttcggtacgggacgggccggggttaccgcgggaccgaaacgggccgtacgtaagtaacggngngnnnnnnnnnnnnnnnnnnnnnnnnnnnn

SEQ ID NO: 125988 - DNA, 681 bp, Homo sapiens
  misc_feature: GYAE6OF01BAXPE.4.38.D05.1.454.CMB.1.raw
  modified_base (203)..(203): a, c, t, g, unknown or other
  misc_feature (203)..(203): n is a, c, g, or t
  modified_base (419)..(419): a, c, t, g, unknown or other
  misc_feature (419)..(419): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggccaccctgttctttgtctccgaggggaanacgcccaccctctcctgcgagggccagtcaggagtgttagcagcagcttaccgttaacctcggtaccagcaacgaaccgtggaccgaggcctcccgaggcctcctctatctagtcggtgcctacgtccgaggccgacgggccacgtcggaccacctacccgaagacgtaggttccaggtcggacgtaggtgggtcgtaggactacgtcttcactcncacatcgagcaagcgtcggacgtacgtaagtaagttcgtttgacgttagttacgttactttacgtcgtacgtaggtacgtagggttacggtacggtaccgtaccgttaccgggtaccggtaccgggttaccgggaaccgggtaaacggggtaaacccggtaaaggggttaaaccgggtaaacgttaaccgaaacgggttaaccgttgggtacggtaaccgtacgtaccccgtaaacgtacgtttccggttccgtttaacccg

SEQ ID NO: 125989 - DNA, 610 bp, Homo sapiens
  misc_feature: GYAE6OF01EC4FH.4.38.D05.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcacctgtctttgctcagggaangccaccctntcctgcagggccagtcagagtgttagcagcagctacttaactggtaccagcagaaacctggccaggcctccaggtcctcctcatctagtggtgcatccagcgacggccacgtggcactcccagacaggttcagtcggctaggtgggtctggggacacggacttcactctaccaccatcacgcgacgtacgtggacgtacctaggaagttacgttttacgacgtagttagttactttacgttcggtacgacggtcgtaaggttggtagggttacgtcgttaaccgacccggttaccggtccgggaaccgtaacggggaaccgtaaacgggtaacgggtaaactaacgaaaaccggtacgttagggtacggtacgtacgaccgtaccgtacgttgttcccgttaccg

SEQ ID NO: 125990 - DNA, 540 bp, Homo sapiens
  misc_feature: GYAE6OF01ALKB6.4.38.D05.1.454.CMB.1.raw
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (515)..(540): a, c, t, g, unknown or other
  misc_feature (515)..(540): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctactgcagtggagcagcctgaaggcctcggacagcgccatatattactgtgacgaaaaccngtancagctcacccgtaagactttgactacgtgggccacggaacctggtcactgtcctcctcacgcctccaccgacggcccagtccggtccttccccgtcggccaccctcctaccgaacgacgcctaccgtcgtcgggggccacgtacggccggtcccgtgggcctcgtccgttacggtaccgaacggtaccttaccttccccgtaacgtacggtcgtctccggttacggacggccggggtcgtcgggaccgaacggcggtaccgagtaggctgctcgnnnnnnnnnnnnnnnnnnnnnnnnnn

SEQ ID NO: 125991 - DNA, 802 bp, Homo sapiens
  misc_feature: GYAE6OF01D0PWY.4.38.D05.1.454.CMB.1.raw
  modified_base (166)..(166): a, c, t, g, unknown or other
  misc_feature (166)..(166): n is a, c, g, or t
tcagagcactgtagcacgaccggtgctcgatttagtatctgatagttgggtttgggggagtctccctcactgcccagctgggatctcagggcttctattttctgtccctccaccatcagtggggtcaaccgccatcctcgccctcctcctggctgttctccaaggngtctgtgccgaggtgcagctggtgctagtctggagcgaggaggtaaggaaaaacggcccggggagtctacgtagaagtacttccgtccgtagggttaacgggttcgtaggtaactaactacgtttacggtttaaccggtaaccgttacgtagggtacgttccgggtcgttggggtcgccggtacccggtaaggggtcccggggaaaccccgggggtaaacggtcccggttaagggtaacggttaggggaaggttaggggtactaccgtaagtttaccgtacgttaccgtagtacgttacggtaccttacgtaacggtaactaaccgtaacgtaactaccggtaccggttccccgttaccgttaccgggaccggtcccgtccgttaccctaccgtttccgtaccgtaccggtaacccgtaaccgaacgttaccctaacgtacgaccgtacccacccggtacctacgtcgcgtaggtcggactcgacgtcgacggtaccggtcccggacgaacgccgacgtaactagttattacgttaacggtgaaaccggaaaccgtaaacgagtacggcaacccggtacctacccggttaaacccggttaagttaccgtttacgtaccgggtaccggtaacccggg

SEQ ID NO: 125992 - DNA, 699 bp, Homo sapiens
  misc_feature: GYAE6OF01C9C0V.4.38.D05.1.454.CMB.1.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccaccctctcctgcagggccagtcagagtgtagcagcagctacttaaccngtaccagacacgaaacctggccaggctcccgaggctcctcaatctatggtcgcagtaccaggcgacgggacctacgtgggacccacgtaccccagaaccgtaggtttccgaaggttcgggaccgtaggtcgggtcgtaggggactagtactttccgaaccttctaccgacctaagttccgaacgtacgaacggtacgtagggtaccgtaccgttaggtaacgttagttttaggaccgttagttcgttaactttacgttagtccgtacggtagttacgggttaggttacggtacgtccgttacccgtaaccgggttaccggtttaccgggaaccggtaaacgggacccgggtaaagggtaacgggtaaaacgtaaccggtaaaacggtacgttacgggtacggtaccgttaccggaacctacccgttaacgccgtttcggttaccc

SEQ ID NO: 125993 - DNA, 693 bp, Homo sapiens
  misc_feature: GYAE6OF01B3I9J.4.38.D05.1.454.CMB.1.raw
  modified_base (200)..(200): a, c, t, g, unknown or other
  misc_feature (200)..(200): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgagggaancgccacctctcctgcagggccagtcagagtgtagcagcagctacttaaccnggtaccagcaagaacctggccaggcctcccaggcctcctnactctagtggtncatccagcgacgggccagtcggacacgtcccagactaggttcaggtcggacaggtgggtcgtagggacacgtacttacgacctctaccactatacaggaccaggtacgtacggaacgtaccgtaaggtaacgttcgttttacggacgttaaggttcgtttaacgtttacgtacggttaccgacggttacgtaaggttcgggtacgggttacgtacccgttaccgtaaccccgggtacggttaacccggggaaccgtaaacgggggtaacccgtaaaggggttaaccggtaaaacggttaaccggtaaaaccggtaaccggttacgggttaaccgggtaccgtaaccgggtaaccttaacccgttacgttaaccccgttgggtttaacccc

SEQ ID NO: 125994 - DNA, 729 bp, Homo sapiens
  misc_feature: GYAE6OF01CNA3D.4.38.D05.1.454.CMB.1.raw
  modified_base (673)..(673): a, c, t, g, unknown or other
  misc_feature (673)..(673): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaacggcccgggagtctctgaagactctccgtaggttaaggtctggatactattcgtttaaggaccttacgtggtacgttcggcgtggggtcgaccgccgagggtcggacccggggaaaggccgttaggaagtcgggagtggggtatcgtactcttacgtccgtagtacgtcgtaaccgttctacggtaacttacccgaagtaacgttaaaccgtccggtttaccccggttacgtttacccgggaaaccgggtccccgtaccgttaccctaacccgtttcgtaccgtaaccggacccgtaaacgtaacccgtccaacgtaccgaacgcccgaacccgtccctaaccgtccggacgacgggtacggtacgacgtaccggtccgtaacggtaaccggccccggtacggaacgtcgaccgacctaacgtatttacgtacgtacggtacgaaaccgtaaacaggtacncgacgtacccaaccgtaaccccggtaagtacctttacgaaccgttcggtaccgggg

SEQ ID NO: 125995 - DNA, 773 bp, Homo sapiens
  misc_feature: GYAE6OF01AQRZB.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaacctggtaccagcagaacctggaccaggctcccaggcctcctcatctagtggtcgcatccagccgacgggcccacgtgggaccacgtcccgaagtactacggttccagggttggaccgtagggttcgggtccgtacgggggaacctaggtacctttccaaccgttcctacctaacccacgttccgaacggacctaacggtaaccgttgggacgtacccgttaggtaaacggtttacgtttttacggacgttaagggtttacgtttaacgtttaaccgttaggttaccgtaacgggtaccgttaagggtttcgggtttaagggttaccggtaccgttacccggttaacccgggtacccgggtttaccgggaaacccgggtaaaccgggggtaaacccggtaaaacggggttaacgggtaaaaacgttaacccggtaaaaaccggttaaccggttaacgggttaccgggtaccgttaaccggaccccgttaaaccgtaaccggttcccgtttaacggtttaccccg

SEQ ID NO: 125996 - DNA, 510 bp, Homo sapiens
  misc_feature: GYAE6OF01A18CX.4.38.D05.1.454.CMB.1.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (493)..(510): a, c, t, g, unknown or other
  misc_feature (493)..(510): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattacngtgacgaaaaccngtagcagctcacccgtaagactttgactactgggccagggaaccctggtcactgtctcctcacgcctccaccgaacgggcccacgtccggtccttcccccgtcggcccaccctccctccaacgacgccacccgtccgtcgggggccacgacggccggcccgtcggggccttcggcccgtcgggtaccaacgggtaccttaccgttcccctacgacgtcgctcgtggacggcgggcgtggcgaaggccgcagtacgnnnnnnnnnnnnnnnnnn

SEQ ID NO: 125997 - DNA, 825 bp, Homo sapiens
  misc_feature: GYAE6OF01E6BUI.4.38.D05.1.454.CMB.1.raw
tcagagcactgtagcacgaccggtgctcgatttagtatctgatagttgggtttggggagagctgctcagttaggacccagagggaaccatcggaaaccccagcgcagcttctcttcctcctgctactctggctcccagactaccacggagtaattgtgttgacgcagtcctcgacggccacccgttgttcgtttgtacgtaccggaaggggaaacgaccgccctaccctctccgtgcgacggccagtcgagtagtggtaggactactaacgttacgccgtaggtaccacgacaacgtaaaccgtcggaccgacggtcccgtaccgtacgtccttccgtacgattcgtagtcggtcgacctaccgtacccgaaccggaccgggtacctaccggttaccggtaaccctaccccgtacggtacccgtacggttaccggaggttcggtaccggtacggggttcgggttaccgtacgggtaaccttaccggtaccgttaccctaacccgttacctaacccgaccgttacgaccggtacgtaccgtaccggtacccgttggaccgtaacggtttaacgttaagggtttaaacgttttaggttttaacggtttaaacgttttaccgtacgttaacgtacggttaaacgttaacgttaaacgtttaacttaaccggttaccgtcccggttactaccgttaccggttaccgggttgggaaccgggttaacgggaacggtacggtaacgacgtaaacgtaaccggtaacgtcgttacggtccgccgtggtaacccttacgtacgtttcgaccctttcgtaccctccgttaccccg

SEQ ID NO: 125998 - DNA, 778 bp, Homo sapiens
  misc_feature: GYAE6OF01CS9OY.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatgggtcaaccgccatcctcgccctcctcctggctgttctccaaggagtctgtgccgaggtgcagctggtgcagtctggagcaggaggtagaaaaacggcccggggagtctcgtagaagtactctccgtaggtaacgggttctggatactattcgtttaggacctacgtggagtcggcgtgggtgccgccgaggtcggacccgggaaagtccgtaggaacgtggagtggggatcatactatccgtgagtcgtactcgtagaactacgaagtataaccgtacgttcccgttaccgttacggaacggtcccgtacggttaccctacccgtttctccgttaccgacccgtaacgtaaccgttaccctaacgttaccgaacgtaccccgacccgtaccccttacccgtacggaccgtacggttacgggacgaccgaccggtacccgtaacggtaacccgggtacccggtaccgggaaccgaccggtacccgtaacccgttaagtttaaccgttacgtttaaccggtacggttaaccggaaaacccggtaaaaccgtaacgggtaccgtacccgtaaaccggttaccccgttaaaccccggtaaaccccgggttaaaacggtttacccgtttaacggtaacccgttaaccggggttaaccccgggggg

SEQ ID NO: 125999 - DNA, 660 bp, Homo sapiens
  misc_feature: GYAE6OF01CYUVZ.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaacggcccggggagtctcgtagaagacttcgtccgttaggtaaggggtttctaggattaactattcgtttaacggaccttagtggagtcggcgtgggtcgcgccgagggtcgacccgggaaagccgtaggaatggagtgggatcgatctatcagatgactcgtagaactaccagtactacgtacgtccgtaccttacggaacggccgtcgtacctacctttcaccgacgacccgaacgtaacgtaccaagtccgaacgccgaacccgacccgtaaccgtgaccgtaggtacggagcgacggtccgtaggaaaccggtcccgtaccggacgacgccgacctaattaacttacttacggtacgtacgtaaaccgaaaaccgtaggtaacacgaccgtaaccacccgtaaaccccggttaagtaacctttacggaaccgtacgggtaccgggg

SEQ ID NO: 126000 - DNA, 533 bp, Homo sapiens
  misc_feature: GYAE6OF01D4CCQ.4.38.D05.1.454.CMB.1.raw
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (506)..(510): a, c, t, g, unknown or other
  misc_feature (506)..(510): n is a, c, g, or t
  modified_base (512)..(533): a, c, t, g, unknown or other
  misc_feature (512)..(533): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagccgccaatatattactgtagaccgaaaaccngtagcagtcctccaccccgtaaggactttgactacgtgggccagggaaccctggtcactgtctcctcngcctccaccacggcccatcgtcctcccctgccnccctccnccagcncacctcgtggggcacgagccggccgtgggcctcggccgtcggtacgaacgggtaaccttacccgtttcccctaacgtacggttacgtccgtcttcgggacgggccggggtcggttacgggccgtaaacggggtcccgacgtaataggtcannnnncnnnnnnnnnnnnnnnnnnnnnn

SEQ ID NO: 126001 - DNA, 212 bp, Homo sapiens; identical to SEQ ID NO: 125913
  misc_feature: GYAE6OF01EZG8U.4.38.D05.1.454.CMB.1.raw
  modified_base (209)..(212): a, c, t, g, unknown or other
  misc_feature (209)..(212): n is a, c, g, or t

SEQ ID NO: 126002 - DNA, 780 bp, Homo sapiens
  misc_feature: GYAE6OF01AY0QT.4.38.D05.1.454.CMB.1.raw
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtgcagctggtgcagtcgtggagcaggaggtagaaaaacgcccggggatctctagaagatctcctaggtaacggttctggatactattcgttaggacctacgtggatcggtcgtgggtcgccggccgtagggtcggacccggggaaaggtccgtagggaagtggagtggggatcgtactcgttactccgtagtatacggtactcgtagtactaccgaagtactaccgtacggttcccgttacgttacggaaccgggtcccgtacgttcccgtacccgtttacgtaccgaccggtacccgaacgtaaaccgtacccgtaacgttacccgacggtaccccgtaaccccgtccccgttaaccgtcggtaccgtaacgggtacggtaacggccgtaccgggtaccgtacgggaaccggtccccggttacgggtacccgacggacccgtaactaacgttaacgtttacgttaaccgttacggtaaccggtaaaccggtaaaaccgtaggtaaaccggtccgtaaccgtaccccgttaaccccggtaaacccccggtttaagggttaacccgtttacgtaaaaccccgggttccgggtaaccccgggggg

SEQ ID NO: 126003 - DNA, 542 bp, Homo sapiens
  misc_feature: GYAE6OF01DPMGC.4.38.D05.1.454.CMB.1.raw
  modified_base (241)..(241): a, c, t, g, unknown or other
  misc_feature (241)..(241): n is a, c, g, or t
  modified_base (523)..(542): a, c, t, g, unknown or other
  misc_feature (523)..(542): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccattatattactgtcgaccgaaaaaccngtaagcagcctaccaccccgtaaggtactttgacctacgtcggggaccgagggaacccctggtccacttcgtcctcctcgacgccctccaacccgaacgggccctacgttccggttcccttcccccgtcggcccacccctccctaccaacgcgaccaccgtcggtcggggccacgacggcccggcccgtgggcctcggccgtcggtacgaacggtaccttacccttaccccgtacacgtgtcctcgtggacggcgggctcgggacgagggccgacagtacgnnnnnnnnnnnnnnnnnnnn

SEQ ID NO: 126004 - DNA, 601 bp, Homo sapiens
  misc_feature: GYAE6OF01BTUML.4.38.D05.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccagcaccctgtctttgtctccaggggaangcccacctctcctgcagggccagtcagagtgtagcagcagctacttaccnggtacagcagaacctggccaggcctccgagcctcctnatctagtggtncatccagcgacgggccagtggacacgtcccaagactaggttcaggtcgcgaggtcgggtctagggacacggtactttccgacttccgacacctactccgacgcgacgtacgtacggacgtaccgtagtaacgtagttttagcgtagttagttacttacgtacgtacgtagtcgtagttacggtggttaacgtccgttacgaccggttacggtccggaaccgaacgggtaccgtaagggtaacgaaacgtaaccgaaacggtacgtcggtacggtccgtacgactaccgtacttcgttcgtaccg

SEQ ID NO: 126005 - DNA, 693 bp, Homo sapiens
  misc_feature: GYAE6OF01BRNEO.4.38.D05.1.454.CMB.1.raw
  modified_base (202)..(202): a, c, t, g, unknown or other
  misc_feature (202)..(202): n is a, c, g, or t
  modified_base (681)..(681): a, c, t, g, unknown or other
  misc_feature (681)..(681): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgcccaccctctcctgcagggccagtcagagtgtagcagcagctacttaacctggtaccagcagaaacctggccaggcctcccgaggcctcctcactctagtggtgcatccaggcgacgggcccacgtcggacctaccgtccccgaagtaaccgtagggttccaagggttcggacgtagggttcggggtaccgtggggaactaggtaccctttactaacccgtccttaacccgaacccgtaattaccgaacggtacgtaaccgggtaccgttacgggggaacctacccggttaagggtaaacggtttactttttacggacgttagtttaacgttaagttttaccgtacggtactacggtcgtagggttggttacggtactccgtaccggtaaccggtccggttacgggacccggtaagggtaccgaagggttacggaaacttacggaaacgtcggttggtacgcggtacacccaacgtnttcgtcgttccg

SEQ ID NO: 126006 - DNA, 691 bp, Homo sapiens
  misc_feature: GYAE6OF01BBJ7R.4.38.D05.1.454.CMB.1.raw
  modified_base (417)..(417): a, c, t, g, unknown or other
  misc_feature (417)..(417): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaacggcccggggagtctcgtagaagatcctccgtggtaagggttctggatacattctttaggacctacgtggatcggctgggtgcgccgaggtcggacccggggaaaggcctaggaatggagtggggatcatctatccgtgatcgacttctgactaccagataacgacgttccgtaccttacggaacggccgtcgtacctaccttcncgacgaccgactaacgtccaatcgacgccacccgtaccctaccgtcgacgacggtcggacgccgaacgtcccgtaaggaaccgggtcccgtaccggggaaccgtacggcccgtaaccgtaacgttaacgttaccgtttaaccgtaggttaacccggaaaccggtaaaaacccgtagggttaaacgcccgtaaaccggtacccgttaaccccgtaaacccccgggtaaacggttaccgtttaacggtaaacccgttaaccgggtaacccgggggg

SEQ ID NO: 126007 - DNA, 949 bp, Homo sapiens
  misc_feature: GYAE6OF01DPWUM.4.38.D05.1.454.CMB.1.raw
  modified_base (184)..(184): a, c, t, g, unknown or other
  misc_feature (184)..(184): n is a, c, g, or t
tcagagcactgtagcacgaccggtgctcgatttagtatctgatagttggggtttgggggagtctccctcactgcccagctgggatctcgagggcttctattttctgtcctccaccatcagtggggtcaaccgccatcctcgccctcctcctggctgttctcgaaggagtctgtgccgaggtgcngctggtgcgtagtcgtggagacgaggtaaggtaacggaaaaacgggcccggggtattctcgtagaagtactcgtcgtaggtaaggttcagtatacgtattacgttacgactacgtggtacgtcggtcggtcgggtcgccggcgtacggggtaccggaaccgggggtaaaggtccggtagggaagtgggtacgggtagggtactacgtacgttacgttacgttcccgtagtacgttacgtaccgttacgtaacgtaacctaacgtaaacggttaacttacccggttaacccggttaccccgggtttacggtaacccgggtaaaccgggtccccgttaccccggttaccctttaaccccgtttacccgaccgtaaccccgggtaaaccccgtaaaccggtaacccgttacccgtaaacgtaaccccggtaacccgccccggttaaaaccccgtaccccgttaacggtacccggtaacccgggtaagggttacccggggaaccgtaccgggtaacccggtacccgggtaaaccgggtacccgggtaccccggtaaccgggtaacccggaccgggtacccttaaccgtacgttaaaaccgtttacggtttacccgggtaaacgtaaaacccgggtaaaaccccgttaaacggaggttaacccggtacccgtaaccggttaaacccccgttaaccccgggttaaaacccgggttaacggtttaaccggttacccggtaacccggttaaccgggggttaaacccccggggg

SEQ ID NO: 126008 - DNA, 846 bp, Homo sapiens
  misc_feature: GYAE6OF01C9AJP.4.38.D05.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagactaccaccggagaaattgtgttgacgcagtctccaggccaccctgttctttgtctcgaaggggaaancgccaccctctcctgcagggccagtcagtagtgtancagcagtctacttaccgtgtaaccagacaacgaaacctggacccaacggtcctacccgaggtcctaccctctaacgttccgtaagttggtcgacctacgtccgaggtacgacgggacctacggtcggaccaccgttacccgaaggtaaccgttacggttaccgaggttacgggacgtaaggggtttcgggtaccgtacggggaactacggttaccttaccaccgtttcctaccgaaccctaacgtaccgacggtacctaaacgggaccgttacggggtacctaccgttaaaggttaaacgtttcgttttaacggtaaccgttttaaagtttttaacgttaaccgtttacggaccgtaacggttaccggtaaacggttacccggtaaacggtaaccccgttaaccgggtttcccgggttacccttttaccgggttacccgttaacccggtttacccggtttaaccggggtttaccgggggaacccgggggttaacgggtaaacccgggttaaagggggttacggaaacggttaaacccggttaaaaccgggtaaaaccggtttacgggttacgggtaccgtcggttaaccgtacccgttaaacccg

SEQ ID NO: 126009 - DNA, 589 bp, Homo sapiens
  misc_feature: GYAE6OF01CT53A.4.38.D05.1.454.CMB.1.raw
  modified_base (250)..(250): a, c, t, g, unknown or other
  misc_feature (250)..(250): n is a, c, g, or t
  modified_base (405)..(405): a, c, t, g, unknown or other
  misc_feature (405)..(405): n is a, c, g, or t
  modified_base (446)..(446): a, c, t, g, unknown or other
  misc_feature (446)..(446): n is a, c, g, or t
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtgcagctggtgcagtctggagcagaggtagaaaaaggcccggggatctctgaagatctcctggtaagggttcnggatacattctttaggacctactggatcggctgggtgacgccgaggtcggaccggggaaaggccgtaggaagtggagtggggatcgatctatcctgatgactctagataccagactacgcgtccgtccgttacgaacggccgcgttccaccttcnctacgccgaactacgtccatcacgaccacccgtcctaccgngcaggtgacgcacgcctacggaacggcccgtacggacgacgaccgaccattagtacttacgtacgtacggaaccgtaaaacgtagtacgactacgcctacccgtaacccggtaacgtacgtttacgacgttacggtaccgggg

SEQ ID NO: 126010 - DNA, 509 bp, Homo sapiens
  misc_feature: GYAE6OF01BRO69.4.38.D05.1.454.CMB.1.raw
  modified_base (235)..(235): a, c, t, g, unknown or other
  misc_feature (235)..(235): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(489): a, c, t, g, unknown or other
  misc_feature (487)..(489): n is a, c, g, or t
  modified_base (491)..(509): a, c, t, g, unknown or other
  misc_feature (491)..(509): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctactgcagtggagcagcctgaagcctcggacagcgccatatattactgtgcgaaaaaccngtagcagctcacccgtaagactttgactactggggccagggaaccctggtcactgtctcctcacgcctccaccaagggcccatcggtcttcccctggccaccctcctccaacgcgccacctcgtggggcacgaggccggccctgggctggcctggtccaacggccttaccgttccctacgtacgtgcctacgtcggacggtccgggacctcgggacctaacgggccgacgagtacgngngntncgtcncncnnncnnnnnnnnnnnnnnnnnnn

SEQ ID NO: 126011 - DNA, 585 bp, Homo sapiens
  misc_feature: GYAE6OF01EQ5H8.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaanagccaccctctcctgcagggccagtcagagtgttagcagcagctacttaacctggtaccagcagaaacctggccaggcctcccaggctcctcatctagtggtgcatccgagccgacgggccacgtcggacctacgtcccagaccgtaggttcaggtcggcgtaggtggtcgtggacagtacttcactcacacatcgagcagacgtggacgcgtagaagtagttttacgcgtagttagtaatttacgtgtacagtcgtaggttggtaggtacgtccgttccgaccggtacggttccggaccgtaacgggaccgtaagggtacggtaaacgtaacgaaacggtaacgtggtaggaccgtacgaccaccgtacgttcgtcgttaccg

SEQ ID NO: 126012 - DNA, 611 bp, Homo sapiens
  misc_feature: GYAE6OF01CTTKV.4.38.D05.1.454.CMB.1.raw
  modified_base (370)..(370): a, c, t, g, unknown or other
  misc_feature (370)..(370): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctaccgaagggaaagacgccaccctctcctgcagggccagtcagagtgtagcagcagctacttaacctggtaccagacaacgaaacctggccaggcctcccgaggctcctcatctagtgtgctatccagcgacgggccacgtcgcactcccagactaggttcaggtcggctaggtgggtcgngggacagtacttcactcacacatcagacagactggactaccgtagaagttgtttcgacgttagtacgttatttaccgtggtacgaggtcgtaagggttggttacggtacgcccgttacggtaacccggtacgggttaccggaaccggtaaacggggtacctaaaggggtacggtaaaactacggaaaacggtacgtcgggtacgaccgtcggaaccctacggtacttccgttgttaccccg

SEQ ID NO: 126013 - DNA, 856 bp, Homo sapiens
  misc_feature: GYAE6OF01ACCPY.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaacggcccggggatctcgtagaagtactcctccgttaggttaagggtttcctagggtattacatttcgtttaaggaacccttacgtgggaactccgggtcgttggggttgccggcccgtagggtcgggaccccgggggaaacggtcccgtagggaacgttggggaggttcggggggaacttacgtaacgttaccgttacgtccctaggtaacgtcggtaccttcgtagacgtaaaccgagtaacgttaaaccgtacggttaccccgtttacccgtttacgggaaaccggtccccggtacgttacccctaccctttacgtacccgacggtacccgaaacgtaaccgtacccgtacgtaccgacggtaccccgtaacccgtaccccctttacccggcgtacccggtaaggtcgggaaccgaccgaccggtccccggtaagggtaacccggtcccggtacccgggtaaccgacggtaccccgaaccttaacttaacgtttaacgttaaccggttcggtaaaccgggtaaaccccgaaaaacggttacggtaacggccctaaaccggttaccctaccccggttaaacccccgggttaaacggttaccggttttaacccggtaacccggttaccgggggtaaccccgggggg

SEQ ID NO: 126014 - DNA, 525 bp, Homo sapiens
  misc_feature: GYAE6OF01BK5R4.4.38.D05.1.454.CMB.1.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
  modified_base (502)..(503): a, c, t, g, unknown or other
  misc_feature (502)..(503): n is a, c, g, or t
  modified_base (505)..(525): a, c, t, g, unknown or other
  misc_feature (505)..(525): n is a, c, g, or t
tcagagcactgtagcacgaccggtgctcgatttagtatctgatagtttgggtttaggtgcccgggaaaggcctggaatggatggggatcatctatcctgatgactccgataccagatacagtccgtccttcgaaggccgcgtcaccttctcagccgacaagtccatcagcaccgcctacctgcagtggagcagcctgaaggcctggacagcgccatatattacngtgacgaaaaccngtagcagctcaccccgtaaggactttgactactggggccagggaaccctggtcactgtctcctcagcctccaccagggcccatccggtcttcccccgtggccacccctcctaccaacgacgcaacctcgtcgggggcactacgccggcccctgggcctgcccgtcggtccaaggaccttaccgtttcccctacgacgttcgccttcgtcggacggtcgggcgttcgggccgaacgggccgacacgttaggcncgctncgctcgcnncnnnnnnnnnnnnnnnnnnnnn

SEQ ID NO: 126015 - DNA, 738 bp, Homo sapiens
  misc_feature: GYAE6OF01DHKJ2.4.38.D05.1.454.CMB.1.raw
  modified_base (478)..(478): a, c, t, g, unknown or other
  misc_feature (478)..(478): n is a, c, g, or t
tcagagcactgtagcacgaccggtgctcgatttagtatctgatagttgggtttgggggagtctccctcactgcccagctgggatctcagggcttcattttctgtcctccaccatcagtgggtcaaccgccatcctcgccctcctcctggctgttctccaaggagtctgtcgccgaggtgcagctggtgcagtctggagcgaggaggtaaggaaaaacggccggggagtctcgtagaagtactctccgttaggttaacgggttcgtggtaactacgtagttacgttaacggaccttagtggacgttccggcgtgggtcgccgcggtaggtccggaccgggaagtccgtaggaagtggaggtcgggtactcgagttcgtactccgtagtactacgtaccttcgtagaactaccgagtactaccgtacggttcccgttaccgttacggaacggtcccgtaccgttaccgtaccgtttaccnccggaacgtaccgtaaccgtaacgtaccacgtacgaccgtacccgtacccgtacccgtacgtcgacgtacgggtacgacgtacgaccgtacggtacggaaccggtccgaaccggtacgacgacccgtaacctagttaccgttaagttaccgtagtaaccgtaaaccggtaaaaccgtggtaaccgccgtaaccgtaccgttaaccccggtaaacccggttaacgtttaccgttacggtacccggtacgggttacccgggg

SEQ ID NO: 126016 - DNA, 558 bp, Homo sapiens
  misc_feature: GYAE6OF01C6NUG.4.38.D05.1.454.CMB.1.raw
  modified_base (190)..(190): a, c, t, g, unknown or other
  misc_feature (190)..(190): n is a, c, g, or t
  modified_base (243)..(243): a, c, t, g, unknown or other
  misc_feature (243)..(243): n is a, c, g, or t
  modified_base (358)..(358): a, c, t, g, unknown or other
  misc_feature (358)..(358): n is a, c, g, or t
  modified_base (529)..(532): a, c, t, g, unknown or other
  misc_feature (529)..(532): n is a, c, g, or t
  modified_base (534)..(558): a, c, t, g, unknown or other
  misc_feature (534)..(558): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcggaaggccgcgtcaccttctcagccgacaagtccatcagcaccgcctacctgcagtggancagcctgaacggcctcgggacagcgccatatattactgtagaccgaaaaaccngtagcagcctaccgaccccgtaaggtacctttgactacgtggggccagggaaccctggtcactgtctcctcacgcctacccaccgacgggccctagtccggttcccttcccccgngtcccacccctcctaccgaacgacgcctacccgtcgtcgggggacaccgaggcccggcccgtcgggcctcgccgtcggtaccgaacggtacccttaccgttacccctacgacggttcgtctcgtcggacgggccggggtcgttacgggacgtaacggccgtacgacgtagnnnngnnnnnnnnnnnnnnnnnnnnnnnnn

SEQ ID NO: 126017 - DNA, 599 bp, Homo sapiens
  misc_feature: GYAE6OF01CLCVM.4.38.D05.1.454.CMB.1.raw
  modified_base (288)..(288): a, c, t, g, unknown or other
  misc_feature (288)..(288): n is a, c, g, or t
  modified_base (476)..(476): a, c, t, g, unknown or other
  misc_feature (476)..(476): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgcccctcctcctggctgttctccaaggagtctgtgccgaggtgcagctggtgcagtctgggagcaggaggtagaaaaacggcccggggatctctagaagactctcgtaggtaaggttctggatacattctttacggacctacgtggatcggntgggtgcgcgaggtcgaccgggaagccgtaggatggagtgggatcatctacgtcagactgactcgtgactacagtactacgtacggttccgtaccgttacgaacggtccgtcgtcctaccttcgtaccgacggacccgtaacaacgtcctaagtccacgacccaccgtccctacgtgcgagtcggacncacgtcgagaacggtccacggacacgctaccatacgttacttacgtgtacgaaccgtaaaccgtagtacgcacgtcccgtaaccgtacccggttaagtactttacgaacggtcggtaccgggg

SEQ ID NO: 126018 - DNA, 677 bp, Homo sapiens
  misc_feature: GYAE6OF01EB4T9.4.38.D05.1.454.CMB.1.raw
  modified_base (648)..(648): a, c, t, g, unknown or other
  misc_feature (648)..(648): n is a, c, g, or t
  modified_base (650)..(677): a, c, t, g, unknown or other
  misc_feature (650)..(677): n is a, c, g, or t
tcagagcactgtagcacgaccggtgctcgatttagtatctgataggttgggtttaggtgcccgggaaaggcctgggaatggagtggggatcatctatcctgatgactctgataccagatacagtccgtccttcggaaggccgcgtcaccttctcagccgacaagtccatcacgccaccgcctacctgcaggtggagcagcctggaacggccgtacggacacgccgacctaattaagttatttacgtgtacgaacgaaaaaccagtacgacacgcctaccgaaccccggtaaaggtacctttagaaccgtacggtacggggaccgaaacgggtaacccctcggtcaacgttcgtcctccgtcaacgtcccctaccgaacccggaaccggggtcccctacggttcccggttccccgtttccccccgcggtacccctacccccttccgaacccgaaacggtcgacccgtaccctcggggtacgggggcccaaccgaccgggtcccggccccgggtgggtacccgtcggtacccgtcgggtaaccgtaaaccggtaccctttacccttaccccgtaagtacgggtttcgacgttaccgtaggggacccggtcgggggtacctacggggacgtaagggcccgtagtaacgtgngnnnnnnnnnnnnnnnnnnnnnnnnnnnn

SEQ ID NO: 126019 - DNA, 539 bp, Homo sapiens
  misc_feature: GYAE6OF01BZI42.4.38.D05.1.454.CMB.1.raw
  modified_base (512)..(513): a, c, t, g, unknown or other
  misc_feature (512)..(513): n is a, c, g, or t
  modified_base (516)..(539): a, c, t, g, unknown or other
  misc_feature (516)..(539): n is a, c, g, or t
tcagagcactgtagcacgaccggtgctcgatttagtatctgatagtttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaaccgtagcagctcacccgtaaggactttgactacgtggggccagggaaccctggtccactgtctcctcacgccctcccaccgaacgggcccagttccggtccttcccccctgggccctaccccgtccctaccaacgtacgccacccgtcgtcgggggccaccgacggccggcccgtgggctcggccgtacgggtcgaacggtaccttacccgttcccctacgacggttcgcctcgtaggacgggccgggcgtcgggacgaacgggccgacgactagnngcnnnnnnnnnnnnnnnnnnnnnnnn

SEQ ID NO: 126020 - DNA, 749 bp, Homo sapiens
  misc_feature: GYAE6OF01CY5K9.4.38.D05.1.454.CMB.1.raw
  modified_base (198)..(198): a, c, t, g, unknown or other
  misc_feature (198)..(198): n is a, c, g, or t
tcagagcactgtagcacgaccggtgctcgatttagtatctgatagttgggtttgggggagtctccctcactgcccagctgggatctcgagggcttctattttctgtcctccaccatcagtgggtcaaccgcatcctcgccctcctcctggctgttctccaaggagtctgtgccgaggtgcagctggtgcagtctggancgaggaggtaagaaaaacggcccggggatctcgtagaagtctctccgtaggttaacgggttctaggtactactattaccgtttaacggacctagtggtacgttcggtcgtgggtcgccggcgtagggtcggacccggggaagccgtaggagtggaggtgggatctaatcgtacgtcgagtacgtcgtaacgttcgtaacgactaaccgagttacgtaccgtccggttacccgttaccgtacgggaaccggtcccgtacgttaccctacccgtttccacggaccgtacccgtaactaacgtcccaagtaccgacgtacccctacccgtacccttaccgtacggacgagggtcggaacgtcgaaccggtccggtaacggaacccgggtcccggtacgaccgaccgtaccgacccgttaagttaacttaacgttaccgaacgggtaaccgaaaccgtaaacgtacgtaccgaccgaaccggttaccccgtacccggtaaaaccccggtttaggtacccgtttaacggtacccggtaccggggttaacccggggg

SEQ ID NO: 126021 - DNA, 637 bp, Homo sapiens
  misc_feature: GYAE6OF01BUAEZ.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaacggcccggggagtctctgaagatctccgtgtaagggttctggatacatctttaggacctactggatcggctgggtgcgccgaggtcgacccggggaaaggccgtaggaagtgggagtggggatcatctatccgtagatgactctgactaccgagactacgtcgtccgtcgtacgacggtccgcgtcctaccttctacgacgaccgactaacgtccacgtacacgaccaccccgtacctaccgtcgaccgtagggtacggacgaccgacggtccgtaagggaaccggtacccgtaccgggacaccggcccgtactaacgttacttacgttaccgttggaaccggtaaaccgaaacgtaggtacgacgacgtacccacccgtaaacccgggttaacgtaccgtttacgaccggtacgggtacccgggg

SEQ ID NO: 126022 - DNA, 676 bp, Homo sapiens
  misc_feature: GYAE6OF01EZIGO.4.38.D05.1.454.CMB.1.raw
  modified_base (199)..(199): a, c, t, g, unknown or other
  misc_feature (199)..(199): n is a, c, g, or t
  modified_base (252)..(252): a, c, t, g, unknown or other
  misc_feature (252)..(252): n is a, c, g, or t
  modified_base (296)..(296): a, c, t, g, unknown or other
  misc_feature (296)..(296): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaattgtgttgacgcagtctccaggcacctgtctttgtctccgaggggaanagccacctctcctgcaggccagtcagagtgtagcagcagctactacctgtacngcagaacctggccaggctcccgaggtcctcctcatctagtggtnacatccgagcgagggcctacgtggcactcccgagactaggttcaggtggctaggtgggtctagggacagacttcgactctacacctatccagcagtacgtggaacgtcctaggtaacgtagttttacggacgtaacgtttagttaactttaacgtcggttacgtacggtacgttaagggttcggttacgggtacgtacccgttaccggtaacccgggtaacgggtttacccgggaaccggtaaacggggtaaacccggtaaaagggggttaacgggaaaaacgtttaacccggaaaaaccggttaaaccggttacgggttaaccgggtaccgttaaccgggtaccctaaacccgttaccgttaccgttcggtttaccccg

SEQ ID NO: 126023 - DNA, 655 bp, Homo sapiens
  misc_feature: GYAE6OF01D2CC1.4.38.D05.1.454.CMB.1.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (287)..(287): a, c, t, g, unknown or other
  misc_feature (287)..(287): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaangccaccctctcctgcagggccagtcagagtgtagcagcagctacttaccnggtaccagcagaacctggccaggctccaggctcctnatctagtggtgacatccagcgacgggccacgtggcactcccagacgtggttcaggtggactaggtcgggtactggggaacaggtaccttacgaccttcctaccacctatacacgtcaacgtacgtagggacgtaccgtaggtaacgttattttcggaccttaggttagttaactttacgtacgtacgacgtaacgttaggttacggttacggtacgttaccgtaaccgtaccggttaccgggttaccggaaaccgggtaaacgggaaaccggtaaagggtaaacggtaaaaccgtaaaccggaaacggttacggtacgggtacgtaccgtaccgtaacccgtaaccgttacgttccgttcgttacccg

SEQ ID NO: 126024 - DNA, 721 bp, Homo sapiens
  misc_feature: GYAE6OF01DULI0.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagccggggatctctgaagactctccgtggtaagggttctggatactattcttttaaggacctactggattcggcgtgggtcgcgccgaggtcggacccgggggaaaggcccgtagggaagtgggagtggggatcagttcgtattcctagatgacttcgtagactacgaagactaacgagtccgtacttcggaaacggcccgtcgtacctaacctttctacacggacccgaaccgtaacgttacccaacgttccgaaccggtacccaaccccgtcccgttaacccgttcgaccggtaacggttacgggacgtacccgtaaggtccccgtaggaacccgggtacccgtacggggaacccgtaccgaccggtaacccagttaactttaagttaaccgtacggttacggaaaccggtaaaaaccctagggtaaccgaccgttaaggcccttaaacccggaacccccggttaaacggttaccgttttacggaaccgttaccggggtaacccggggg

SEQ ID NO: 126025 - DNA, 686 bp, Homo sapiens
  misc_feature: GYAE6OF01BGF4S.4.38.D05.1.454.CMB.1.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaggttctggatacntcttagacctacnggatcggngtggtgcgccgaggtcggacccgggaaagccgtaggaagtggagtggggactcgacttcgtactccgtagagtcgacttcgtagaactaaccgaagtactacgtaccgttccgtccgttacggaacggtccgtacgtcctaccgttcacgacgaccgaactaacgtcctactacgacgtacccgtaccgtacccgttaccgtcggacgtacgggtacgacgcctacggtaccctacgggtaaccggtcccgtacgggaccgacggtaccgacctaagttaaccgttaacgttaccgtacggtaccggaaacccgtaaaaccgtacggtaaccggaccaaccgttacccgtaacccgttaaacccccggttaaggttaacccgtttacggtaacccgttacgggtaccccgggg

SEQ ID NO: 126026 - DNA, 780 bp, Homo sapiens
  misc_feature: GYAE6OF01CRSU5.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatgggtcaaccgccatcctcgccctcctcctggctgttctccaaggagtctgtgccgaggtgcagctggtgcagtctggagcaggaggtagaaaaacggcccggggagtctctagaagatcgtccgttaggtaagggttctaggtatactattcgtttaaggaccttagtggacgttcggcgttgggtcgcgccgagggtcggacccgggaaaggtccgtaggaacgtggagtggggatcgattactactccgtagtacgtcgtactcgtagaactaccgaagtaactacgtacgtcccgttaccgttacgggaacggtccccggtacgttaccctaaccctttcgtaccgaacggtacccgtaaaccgtaaccgttaccgtaaccgttacgaaccggacccgtaaccccggtacccttaacccgttaccgggaccgtaacggtacgggtaaacgacccgtaaccggtacccgtaagggaacccgggtacccgttaaccgggaaccgtacggacccgtaccctaagttaacgttaaccgtttacgtacgggtaacggaaacccgtaaaaaccggtgtaacggaacccgtaacggtccccgttaacccggtaaaccccggttaaaggttaccgtttaaccggtaccgttaccgggtaacccggggg

SEQ ID NO: 126027 - DNA, 619 bp, Homo sapiens
  misc_feature: GYAE6OF01DHPE5.4.38.D05.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
tcagagcactgtagcacgaccggtgctcgatttagtatctgatagttggggtttggggagagctgctcagttaggacccagagggaaccatggaaaccccagcgcagcttctcttcctcctgctactctggctcccagataccaccggagaaattgtgttgacgcagtctccaggcaccctgtcttgctcaggggaangccacctctcctgcagggccagtcagagtgtagcagcagctacttacngtaccngcagaactggcagctccaggctctnatctatggtncatccagcgagggccagtggccactcccagacnggttcaggtggctaggtgggtctgggacaggtacttcactctacacatcagcagacgtggacgtccgtaagaacgttagttttcgacgtaagttagttaactttacgtcggttacaaggtcctagggttcggttacgggtacgtccgttaccggtaacccgggtaccggtttaccgggaacccggtaaaacgggggacccgttaaaaggggtacgggtaaaaaccttaccggaaaaacggtacgttacgggtacggtaccgtacgggaccctaaccgtacgttccgttcggtttaaccc

SEQ ID NO: 126028 - DNA, 753 bp, Homo sapiens
  misc_feature: GYAE6OF01ENAGA.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcgagaggtagaaaaaggcccggggatctctgaagatctccgtggtaagggttctggatacattctttaggaccttatggatcggctgggtgcgccgagggtcgacccggggaaaggccgtagggaagtcgggagtgggggatcgatctaactccgtgatgactcgtgataccagatacgacgttccgtaccgttacggaacggccgtcgtcctaccgttcctacgacgtacccgaacgtaacgtacccagttaccaacggaccctaaccccgtacccgttacccgtacggacctacgggttacgggacgtacccgtacggtaccccgtacgggaaccgggtaccccgttaccgggaacgaaccgggtacccgtaacccgtaacgttaacgttaaccgtttaaccggttacggtaaccgggtaaacccggtaaaaacccgtagggttaaccggtaccgtaaccggtacccccgttaaccccggtaaaccccccgggtttaaagggttaacccgttttaaccgggtaacccggttacccggggttaaccccggggggg

SEQ ID NO: 126029 - DNA, 682 bp, Homo sapiens
  misc_feature: GYAE6OF01AOWFH.4.38.D05.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgctccgaggggaaancgccaccctctcctgcagggccagtcagagtgtagcagcagctacttaaccnggtaccagcagaacctggccaggcctccgagcctcctanatctagtggtcgcacgtccaaggccgaaggggccctagtcggaccacgtcccgagacgtacggtcaggtcgcgtaggtgggtcagggactacgtccttccgacttcctaccactactcgacgcaacggtcgtaggacgtaccgtaggtaacgtttagttttcgacgtttaaagtttttaccgttacgtaggtaccgaacgtacgtaacggttaccgtaacggaccgttaaccggttcggaccctttcggtacggttacccttaccgggttaccggtttaccgggggaacccgggtaacgggtaaccggtaagggttacgggaaaccgttacgtaaacccgaaaaccgggttacgttcggggtaaccgggcttaccggtacccgtaaaccg

SEQ ID NO: 126030 - DNA, 713 bp, Homo sapiens
  misc_feature: GYAE6OF01DPO9X.4.38.D05.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
tcagagcactgtagcacgaccggtgctcgatttagtatctgatagttgggtttggggagagctgctcagttaggacccagagggaaccatggaaaccccagcgcagcttctcttccctcctgctactctggctcccagataccaccggagaattgtgttgacgcagtctccaggccacctgtcttgctcgagggaancgccacctctcctgcaggccagtcagngtgtagcagcagtctacttacnggtaccagacaacgaacctggaccacggtcctccgaggctccgtcatcgtagtggcgactacgtaccgaggccgacgggtccctaggtcggacctaaccgtcccgaaggaccgtacggttacgacgggttacggaccgttaaggggttccggggttacgtacggggaactaccggttaccgtttaccgaaccctttcctaccgtaacccgtaagttacccgaccggttaccgaacggtcccgtaggtaccgttacgtcgttacgtagtacgttagttcgttagtacgtttaagttttacgttacttacgtaacctagttacgtaaggtttggtacccggttaacggacccccggtacgtaccgggttaacccggaaccgaaaccgggtaacgaaacgggtaagtaaaccctaacggaaacggtaccggttagacggtacacgttacctaactcgttccgtttaaccg

SEQ ID NO: 126031 - DNA, 744 bp, Homo sapiens
  misc_feature: GYAE6OF01DGWIH.4.38.D05.1.454.CMB.1.raw
  modified_base (208)..(208): a, c, t, g, unknown or other
  misc_feature (208)..(208): n is a, c, g, or t
  modified_base (270)..(270): a, c, t, g, unknown or other
  misc_feature (270)..(270): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagactaccaccggagaaattgtagttgacgcagtctccgaggcaccctgttcttttgcctccgaaggggaaancgcccaccctctcctgcgacgggccagtcaggagttgttagcagcagaccttacttaaccgnggtaaccagacgaacgaaacctcggaccgaacggcctccgacggtcctaccctcattaccgtagttcggtcactaacctccgaacggtccgaacgggtccctacgtcgggacctacctacccgaagtaccgtagggttcaagggtcggacgtagggtcgggttaaccgtaggggtacctacgttaccgttacctaccgttaccgtacctaccgtactacgacgaccgaagggtacgtacggtacgtaccgttaaaggttaacgttacgttttacgaccgttagttacgtttacgtttactcgtacgtagtacgtaggttacggtgggtacctaccgttaaccgttacccggttaccgggtaccgggaaaccggtaaacggggaacgtaacgggtaaacggtaaaactaacggaaaacggtacgttacggtacggtacccgtacgaaccttacctagtttccgtacgtttacccg

SEQ ID NO: 126032 - DNA, 673 bp, Homo sapiens
  misc_feature: GYAE6OF01BI2CW.4.38.D05.1.454.CMB.1.raw
tcagagcactgtagcacgaccggtgctcgatttagtatctgatagttgggtttgggggagtctccctcactgcccagctgggatctcagggcttctattttctgtccctccaccatcagtggggtccaaccgccatcctcgccctcctcctggctgttctccaaggagtctgtgccgaggtgcagctggtgcgagtcgtaggagcgaggtaaggtaagaaaaacgggcccggggagttccgtcgtaggaaagtactccgtccgttaggttaacgggttcgtaggtaactactagttacgtttaacggaccttagtggacgtcggtcgtggtcgcgcgagggtcggaccgggaagtccgtaggagtggacggtagggactactagtactctacgtagtatcgtactacgtagaactacgaagtactaccgtacgttaccgtcgtaccggacggtcccgtacttccgtaccttactacgaaccgtaccggaacctaaccgtcgaactccgaacgtcccaaccggtccctacgtcggacgtagtcggacgacgacggccgtaggaacccggcgtaccggagaccgtcgactagttactacgtgacgaacgaaccgaacgagtacgcgaccgtacctaacccggtaccgttaagttacctacggagtaccggacggg

SEQ ID NO: 126033 - DNA, 711 bp, Homo sapiens
  misc_feature: GYAE6OF01EAJIM.4.38.D05.1.454.CMB.1.raw
  modified_base (163)..(163): a, c, t, g, unknown or other
  misc_feature (163)..(163): n is a, c, g, or t
tcagagcactgtagcacgaccggtgctcgatttagtatctgatagttgggtttgggggagtctccctcactgcccagctgggatctcgagggcttctattttctcgtcctccaccatcagtgggtcaaccgccatcctcgccctcctcctgctgtctcaaggngtctgtgccgaggtgcagcgtggtgctagtcgtgggagcgaaggagggtaaggaaaaacgggcccggggtagttcgtcgtagaagtctccgttaccgttagggttaagggttcgtaggaactaactagtttaccgtttaacggaccttaacggtggtacgttccgggtcggtggggtcggccggtccggtaaggggtcccgggaacccgggggaaacggtccggtaagggacgtgggaggtagggtactacgtactcgttactccgtagtacgtcgacttcgtagtactacgatacgtacgtaccgttccgtacgtacggacgtccgtccgtacctacccttcgacgacgacccgacgtaaccgctacgcaccggacccacccgtcctacggtcgagtacggtgggacaccgacgcgtacggacggacccgtacggacaccgcgtactattagttcgttacgtggaaaccgtaaacgaaccgttaggacaccgtacccgtcgtaaacccgtaccggttaagttcctacgggtccgacggggtaccggg

SEQ ID NO: 126034 - DNA, 668 bp, Homo sapiens
  misc_feature: GYAE6OF01EXXPB.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaacctggtaccagcaagaaacctggccaggcctcccgaggcctcctcatctagtggtgcatccagcgacgggccacgtcggccactcccgaagacgtacggttcgaggtcggacgtagggtcggggtcgtaggggaactacggtactttccgaccttccgtaccgaaccctagtccgaagtccgaaggtaccgtacgggacgtaccgttaaggtaaacgtttagttttcggacgttaggttacgttactttacgtcgtacgagtcgtaggttcggtagggtacgtccgtaccgaccgggtaccgttccgggaacggtaacggggtaccgtaaagggttacggaaaacgtaaccgtaaacggtaaccggttgggtacggaaccgttcggacccttaaccgtcgtttccgtggtttacccg

SEQ ID NO: 126035 - DNA, 532 bp, Homo sapiens
  misc_feature: GYAE6OF01BQUC0.4.38.D05.1.454.CMB.1.raw
  modified_base (238)..(238): a, c, t, g, unknown or other
  misc_feature (238)..(238): n is a, c, g, or t
  modified_base (308)..(308): a, c, t, g, unknown or other
  misc_feature (308)..(308): n is a, c, g, or t
  modified_base (513)..(532): a, c, t, g, unknown or other
  misc_feature (513)..(532): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaacggcctcggacagcgccatatattactgtgacgaaaaccngtagcagctccaccccgtaaggtactttgactacgtggggccacgggaaccctggtcactgtcctcctcncgtccctaccgaaccgaacgggccctagtcccggttcccttccccccgtcggccaccccttccaccaacgacgctaccctcggcggggcaccgacgccggcccgtgggctcggcccttgggtaccaacgggtaccttacccgttcccctacgtaggttcgccgttcgtgggcggcggggtctcgggaccgaacgggtcgcagtgnnnnnnnnnnnnnnnnnnnn

SEQ ID NO: 126036 - DNA, 846 bp, Homo sapiens
  misc_feature: GYAE6OF01DAOXX.4.38.D05.1.454.CMB.1.raw
tcagagcactgtagcacgaccggtgctcgatttagtatctgatagttgggtttggggagagctgctcagttaggacccagagggaaccatacggaaaccccagcgcagcttctcttcctcctgctactctgctcccagactaccacggagaaattgtgttgacgcagtctccgacggcctaccctgttctttcgtacctaccgaaaaggggaaacgacgacccctaccccttcctcccgtaggaccgacggggacccaaggttaccgaaggtaggttacgttacgacgaacggtacctaacgtacctttaaacccgttttaaccgtacggttaaccccaaggaaccgtaaaccggtaaaaacccgttccgggacccgaaccggtccccgttaccccggacggttacccttaccccgtactaacttccggtttaacgtgggtaccgacctaacgtaccccgacggaccggaccggggtaccctaacggtccgggacctaaccccgtaccgaacggtaaccgttacggttacggacgggtacggtacggttaggggttacggtaccgggtacgggtaacctaccggtttaacctaccgtaccgttaccctaacccgtactaccgtacgaccgtaacgtaccggacggtacggtacgaaccgttagtaacgtttacgttgaacggttagtttacgtttaaccgtgcgttaccgagttacgttaggttccggtagttcgacccgttccggtaacggtccgttaaccggaaccggaagtacggaaggtactaaaaccggtacgtaacggtcgttggacctacgtacgaactctacgtcttaacgttacccg

SEQ ID NO: 126037 - DNA, 523 bp, Homo sapiens
  misc_feature: GYAE6OF01B6HIL.4.38.D05.1.454.CMB.1.raw
  modified_base (237)..(237): a, c, t, g, unknown or other
  misc_feature (237)..(237): n is a, c, g, or t
  modified_base (306)..(306): a, c, t, g, unknown or other
  misc_feature (306)..(306): n is a, c, g, or t
  modified_base (493)..(493): a, c, t, g, unknown or other
  misc_feature (493)..(493): n is a, c, g, or t
  modified_base (495)..(499): a, c, t, g, unknown or other
  misc_feature (495)..(499): n is a, c, g, or t
  modified_base (501)..(523): a, c, t, g, unknown or other
  misc_feature (501)..(523): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagctccaccccgtaaggactttcgactacgtggggccagggaaccctggtcactcgtctcctcngccctccaccgaacgggcccagtccggtcccttcccctcggcctaccctccctaccgaacgacgccaccctcgtcgggggccacgacggcccggcccgtgggcctcgccctggtacgaacggaccttaccgttcccctacgcgtcgccgtcgtcggacgcgggtcgtcgggacacgggcgcgatagncnnnnngnnnnnnnnnnnnnnnnnnnnnnn

SEQ ID NO: 126038 - DNA, 799 bp, Homo sapiens
  misc_feature: GYAE6OF01AZ7T9.4.38.D05.1.454.CMB.1.raw
  modified_base (168)..(168): a, c, t, g, unknown or other
  misc_feature (168)..(168): n is a, c, g, or t
tcagagcactgtagcacgaccggtgctcgatttagtatctgatagttgggtttgggggagtctccctcactgcccagctgggatctcgagggcttcattttctgtcctccaccatcagtggggtcaaccgccatccctcgccctcctccgtggctgttctccgaaggngtctgtgccgtaggtgcagctggtgcgagtctggagcaggaggtagaaaacggcccggggtatcgtcgtagaagtactcgtccgtaggtaggttcgaggtatactagttacgttacggacctagtggtacgtcggtcgtgggtacgccggtacgacgggtccggaccggggtaagtccgtaggagtggtaggtacgggactacgacttctacgtcgtaggactcgacctgtacaacgtaacaacgtacgtaaccgtacggttcccgtaccggtacggaacggtcccgtaccgtacctacccgttcgtaccgaccgtacccgtaacgtaaccgtacccgtacgaccgaccggtaccgtacccccgtaccgtttaccgcggtacgtacggtaggtacccgacgtaccggtaccgaacggtaacccgggtaccggtaccggaaccggtaccgtacccctaaggtaaactttaccgtttaaccggtaaccgttacgggtaaacccggtaaaacccggtaaacgtaccggttaaacggcccgttaacccggtaacccgttaaccccgggtaaacccgggttttaacggtacccggttttaccgggaaaacccggttcccgggggtaaaccccgggg

SEQ ID NO: 126039 - DNA, 812 bp, Homo sapiens
  misc_feature: GYAE6OF01BYF84.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcgaggaggtagaaaaacggcccggggagtctcgtagaagtactctccgtaggttaacgggttctaggatacgtattacgtttaacggtaccttacgtggtacgtcgggtcgtgggtcgccggccgtagggtccggacccggggaaaggtccgtaggaagtggaggtgggatcgtatctatccgtagtatcgtactgtagactacgagatacgacgttccgtccgttaggaccgtccgtccgtacctacccgttcgtaccgaccgtacccgtaacgtaaccgtaccctaacgttaccgaaccggtacccctaaccccggtaccccgttaacccggttcggaacccggttaacgggtaccggggtaaccgaccggtaaccgggttaccccgggtaacggggaaacccgggtcccccggtaaccgggaaccggaacccggtacccggtaaccttaacgttaaacgttaaccggtttaaccgttacggttaaacccggaaacccgtaaaaaccggttaggtaccggacctaacccgggtaccccgttaaaccccggttaaaccccggttaaacggttacccgtttaacggtaaacccggttccggggtaaccccggggg

SEQ ID NO: 126040 - DNA, 678 bp, Homo sapiens
  misc_feature: GYAE6OF01CLGFK.4.38.D05.1.454.CMB.1.raw
  modified_base (652)..(678): a, c, t, g, unknown or other
  misc_feature (652)..(678): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtcttcggaaggccgcgtcaccttctcagccgacaacgtccatcagcaccgcctacctgcaggtggagcagccgtaggaacggccgtcggacacgccgacctaattattattactaggtacgaaccgaaaaccagtagcacgctaccgtaacccggtaaggtactttcgacgtacggtcggggaccaacggggaaccccttggtcctacgtcgttcctcctacgaccgtacccctacccgaaccgaaccgggtccctacggttccccggtttccccttcccccgtcgggccccctaacccccttcccgtaaccgaacggacgtacccgtacccggttcgggtaccggggggaccaaccgggccgggcccgggtccccgggttggggtcccgttccgggtcccggttaacgggtaaccgtaaccgggttaaccctttacccgtttaccccgtaacgtacggttccgtccgtacggtacgggaccgggccggggtcggtaccggggacgtaacgggccgtacgtagagcgnnnnnnnnnnnnnnnnnnnnnnnnnnn

SEQ ID NO: 126041 - DNA, 549 bp, Homo sapiens
  misc_feature: GYAE6OF01A3U7A.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaacctggtaccagcagaaacctggccaggctcccaggctcctcatctatgtgcatccagcagggccatggcatcccagcaggttcagtgcagtgggtctgggacagacttcactctacacctatcagcagactggacgccgtagaagtattttgactagttagttattactgtcagcgtaggtgtgggtagcctacgtacccggtacgttccggaccgaacgggaccgtaagggtacggaaacgtacgaaacggtacttagggtacggacgtacgaccgaaccgtactccgttgttacccg

SEQ ID NO: 126042 - DNA, 677 bp, Homo sapiens
  misc_feature: GYAE6OF01DJCY1.4.38.D05.1.454.CMB.1.raw
  modified_base (200)..(200): a, c, t, g, unknown or other
  misc_feature (200)..(200): n is a, c, g, or t
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgctccgaggggaancgccaccctctcctgccgagggccagtcaggagtgtagcagcagctacttacngtaccatcagaacctggccaggcctcccgaggctcctcatctatggtncactccaggcgacgggccacgtggaccactcccgagtacgtaggttccaagggtcgggacgagggttcgggtaccgtaggggaacctacggttacctttaccgaccctttaccgtaccctaacccgtaagttacccgacggtaccgtaacggtaacggtacgggtacggacccgttaaggtaacgttacgttttacgacgttaggttagtttaccgtttacgtacgttacgacggtacgtaggttggttacgggtacgtccgtaccgtaccggtaccggttaccggaaccggaacgggtaccgtaagggtacgtaaaacgtaccggaaacggtacgtcggtacggacttacggactaccgtacttccgtgttcccg

SEQ ID NO: 126043 - DNA, 527 bp, Homo sapiens
  misc_feature: GYAE6OF01A4PT0.4.38.D05.1.454.CMB.1.raw
  modified_base (236)..(236): a, c, t, g, unknown or other
  misc_feature (236)..(236): n is a, c, g, or t
  modified_base (368)..(368): a, c, t, g, unknown or other
  misc_feature (368)..(368): n is a, c, g, or t
  modified_base (505)..(527): a, c, t, g, unknown or other
  misc_feature (505)..(527): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaagcctcggacagcgccatatattactgtgacgaaaaccngtagcagctccacccgtaagtactttgactacgtggggccacgggaaccctggtcacgtcgtctcctcacgcctccaccgaacgggcccacgttccgtccttcccccgtcgccctaccctcctaccaacgcnccaccgtcggtcggggcacgacgccgggcccgtgggcctcgccgtcgggtaccgaacggtaccttacccttacccctacgtacgtcgtcctcgtcggacggccgggtcgtacgggacgaacgggccgacgagtacgnnnnnnnnnnnnnnnnnnnnnnn

SEQ ID NO: 126044 - DNA, 829 bp, Homo sapiens
  misc_feature: GYAE6OF01CV0K5.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaaccggagaaattgtgttgacgcagtctccaggccaccctgtctttgtctaccgagggaaagcgcccacctctcctgcgaggccagtcagtagtgtagcagcagctacttaacctggtaccagacaacgaaccgtcggaccgacggcctacccgacggtcctcctctacttccgtagttcggtacgacctacgtacccgaggaccggtaaccggggaccctaccggttacgggaccctaacccgtacccgaagggtaaccgttagggtttaccgaagggttccgggtacggtacggggtttacggggttaccggtaggggtaaaccgtacgggttaacctttaccgtacccttacctaaccccgtaaccaacgttacccgaacggtaaccgtaacggtaccggtacgggtaccggtaaccgttaaaggttaacggtttacgttttaccggtaacggttaacggtttacgttttaacgtttaacgttccggttaacgtacgttacgtaacgggtttgggttacgggtacgtacccgttaacggtaaccccgggttacggttaccgggaaaccccgggttaaacggggaaacccggttaaagggttaaacgggtaaaacttaacccgggtaaaacgtaacggttacggtacggtccgtacgtacctacggtacttcgttcgtttacccg

SEQ ID NO: 126045 - DNA, 712 bp, Homo sapiens
  misc_feature: GYAE6OF01A3PX6.4.38.D05.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgcccaccctctcctgcgagggccagtcagagtgtagcagcagtctacttaactggtaccagcaagaaccgtggaccacggcctacccgaggcctcctacatctagtggtcncacgtccaggcgacgggccagtcggactactcccgaagaccgtaggttcaggtggacgtaggttcgggtcgtacgggaactacggtaccttccaccttcctacgacctacgtcgacgaccgtacggtacgtacggaccgtaccgttaaggtaacgtttacgttttacggaccgttaaggtttacgttaaccgttttacgttcggtaaccgtaggttaccgttaagggttacggttacgggttacgtacccgttaccggtaaccccgggttacgggtttaccccgggaaaccggtaacggggtaaacccggtaaaggggttaaccggtaaacgttaaccggaaaacgggttacgtagggtacgacgtaccgactaaccgtgttacccggttgttacccg

SEQ ID NO: 126046 - DNA, 933 bp, Homo sapiens
  misc_feature: GYAE6OF01BEUY0.4.38.D05.1.454.CMB.1.raw
  modified_base (163)..(163): a, c, t, g, unknown or other
  misc_feature (163)..(163): n is a, c, g, or t
tcagagcactgtagcacgaccggtgctcgatttagtatctgatagttgggtttgggggagtctccctcactgcccagctgggatctcagggcttcattttctgtcctccaccatcagtggggtcaaccgccatcctcgccctcctcctggctgttctccaggngtctgtgccgaggtgcagctggtgcagtctggagcaggaggtagaaaaacggccggggtagtcgtcgtagaagtactcctaccgtaggttaagggttctaggtaattacgtattaccgtttaacggaccttaacggtggacgttccgggcgttggggttcgccggtaccggacggggtaccgggaacccggggaaacggtccgtagggaagttcggggagtcggggtactcgtatcgtacgtccgtagtacgtagtacctacgtacgacttaacgacgtaacgtaaccgttaccggttacccgttaccggttacggaacccggtccggtaccgttacccttacccgtttactaccggtaacccgaccggtaaaccgtaacgttacccctaaacgtacccgaacgtacccccgtaacccggttaccccgttaacggtccggtaacccgtagggttaacccggacggtaaccccggtaaccgggtttacccggtaaccggggaaacccggggttaccccgtaccgggggaaaccgtacccgggtacccgtaacccggtttaaagtttaacccgttaaccggttttaaccggttaccgggttaaaaccgggtaaaaccccggttaaaaaccggtcgggtttaaacccgggaaccctttaacccggggtaaaccccgttaaccccccgggtttaaaaaccccgggtttaacgggttaaaccccgtttttaccgggtaaaccccgggttaaccgggggtttaaaccccccggggg

SEQ ID NO: 126047 - DNA, 574 bp, Homo sapiens
  misc_feature: GYAE6OF01B4ILM.4.38.D05.1.454.CMB.1.raw
  modified_base (201)..(201): a, c, t, g, unknown or other
  misc_feature (201)..(201): n is a, c, g, or t
  modified_base (554)..(554): a, c, t, g, unknown or other
  misc_feature (554)..(554): n is a, c, g, or t
  modified_base (564)..(564): a, c, t, g, unknown or other
  misc_feature (564)..(564): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgctccgaggggaaancgccaccctctcctgcagggccagtcagagtgtagcagcagctacttaacctggtaccagcaagaacctggccaggcctccgaggcctcctcatctagtggtcgcactccagccgacgggccagtcggccactcccagactaggttcaggtggcgtaggtcgggtcgtgggacacgtacttcactctcaccatcgagcagacgtggacgtcctaagagttatttcgactagttgtatttacgtgtacgagtcgtaggttcggtaggtacgtccgttacgaccggtaggttccggaaccgaaagggtaccctaaagggtacgtaaactacgaaacggtcgtcggtagaccgtanacctaccgtntcgttcgtac

SEQ ID NO: 126048 - DNA, 661 bp, Homo sapiens
  misc_feature: GYAE6OF01D6MUF.4.38.D05.1.454.CMB.1.raw
  modified_base (244)..(244): a, c, t, g, unknown or other
  misc_feature (244)..(244): n is a, c, g, or t
  modified_base (633)..(633): a, c, t, g, unknown or other
  misc_feature (633)..(633): n is a, c, g, or t
  modified_base (635)..(661): a, c, t, g, unknown or other
  misc_feature (635)..(661): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagccaccgcctacctgcaggtggagcagcctggaaggcctcggacagccgccattattattactgtcgacgaaaaccngtagcagcctaccgaaccccggttaaggtacttttaggaccttaacggtcgggggaccaacggggtaacccctggtccaccgttcgttcccttccctcaccgtccctaccgaacccgaacgggtcccctagttccccggttcccctttccccccgcggtaccccaccccgttccctaacccgaaacggccgaccgtaccccgtcgggtacgggggaccaaccggacggccccgggtccccgtcggggtccgtaccggtcccggttacgggtaacccgtaacgggtaaccctttaccccttacccccgttaacgtacggttccgtaccgttcggaagggtccgggcccggggtaggtccgggaccgaaacggggtccgaacacgttaggngnnnnnnnnnnnnnnnnnnnnnnnnnnn

SEQ ID NO: 126049 - DNA, 858 bp, Homo sapiens
  misc_feature: GYAE6OF01C5BD7.4.38.D05.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (320)..(320): a, c, t, g, unknown or other
  misc_feature (320)..(320): n is a, c, g, or t
tcagagcactgtagcacgaccggtgctcgatttagtatctgatagttgggtttggggagagctgctcagttaggacccagagggaaccatcggaaaccccagcgcagcttctcttcctcctgctactctggctcccagactaccaccggagaaattgtgttgacgcagtctccagcaccctgtctttgctcgaggggaaancgccacctctcctgcgaggccagtcagagtgttagcagcagctacttaaccgnggtaaccagcaagaaaccctggaccagggcctcccgaaggtcctcccgtcattacctagttgggtncaacttcccgaaggccgaacggggcccacgtgggacccaacgtccccgaaggtaaccgtacggtttccaagggttcgggaccgttaaggggtcggggttactacggggggaacctaacgggttaccctttaccgtaaaccgtttccccgttaaccaacccgtaaccgtttaccgtaaccggaccgtaaaccggtaaaccggtttaccgggaaccgtaaccccggttaaggggttaaaaccggttttaacttttttacggggaaccgtttaacgggtttacgtttttaaaccgttttaaaccgttcgggtttaacccgtaaggttaaccggttaacggggtttacggtttacggggttaaccggtacccgtttaacccggtaaccccggggttaccgggtttaacccggggaacccggtaaaaacgggggtaaccccggtaaaggggttaaaccggtaaaacgttaacccgtaaaacggtaacggtttacgggacggtacgtacggaaccgtaccctaagttcccgttagttaaccccg

SEQ ID NO: 126050 - DNA, 699 bp, Homo sapiens
  misc_feature: GYAE6OF01CHFXR.4.38.D05.1.454.CMB.1.raw
  modified_base (251)..(251): a, c, t, g, unknown or other
  misc_feature (251)..(251): n is a, c, g, or t
  modified_base (356)..(356): a, c, t, g, unknown or other
  misc_feature (356)..(356): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaaggcccggggagtctctagaagatctcctgtaagggttcnggatacatcgtttaggacctagtggagtcggctgggtgccgccgaggtcggacccggggaaaggccgtaggaagtggagtggggatcatctatcctgatgacctntagactaccagatacgtacgtcccgtaccttacggaacggccgccgtactaccctttcgtccacggacccgaaccgtaacgtacccatccgaacgcctaccccgacccttaccgtcggaccgtaggtacgggacgacgaccggtccgtaggaaccgggccgtaccgggaacctacgggccgtaaccgtaattaacgttaacttaaccggttcggtaacggtaaacccggtaaaaaccgtaggttaaccggcccgtaaccgtaccccgtaacccccggtaaaccccggttaaacgggttaacccgttttaccggaacccggttaaccgggtaaccccggggggg

SEQ ID NO: 126051 - DNA, 661 bp, Homo sapiens
  misc_feature: GYAE6OF01BEBSK.4.38.D05.1.454.CMB.1.raw
  modified_base (263)..(263): a, c, t, g, unknown or other
  misc_feature (263)..(263): n is a, c, g, or t
  modified_base (646)..(646): a, c, t, g, unknown or other
  misc_feature (646)..(646): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccacggagaattgtgttgacgcagtctccaggccaccctgtctttgtctccgaaggggaaacgacgccctaccctctccgtgcgagggccagtcagtagtgttacgcagcagtctacttaacncggtacagacagaacctgcacgctccgagcctctcatctatcggtgactactccagtcgacgggccaacgtcgggtacacgtcccgaagtaccgtaacggttccgaaggtcgggactacggggtcggtcggtacgggactacggacctttacgacttccgtacaaccgtacgtacaacggtcaaacggcgtaacggtacgacgttagtaaacttgtttaacgacgttaggttagttctttaacgtcttacgacgttacggtagttcgggtagttaccgtaccgttcgaacccgggttagtacccgggtaacgaaacgggtaaccgtaaggtaacggtaacgtaccggaaaggtacgtggtagtaccgttaccggactaaccgnttacggtcttacccg

SEQ ID NO: 126052 - DNA, 720 bp, Homo sapiens
  misc_feature: GYAE6OF01DMZAO.4.38.D05.1.454.CMB.1.raw
  modified_base (190)..(190): a, c, t, g, unknown or other
  misc_feature (190)..(190): n is a, c, g, or t
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
  modified_base (696)..(720): a, c, t, g, unknown or other
  misc_feature (696)..(720): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagccaccgcctacctgcagtggancagcctgaacggcctcggacagccgcatatattacctgtacgaacgaaaaccagtagcacgcctaccgaacccgttaaggtacctttacgaaccgttacggtcgggggacccgaacggggtaacccccttgggtacctaccgtttcgttccccttacccgtacaccgtaccccctacccgaacccggaaccggggtcccctaacggtttcccccggtttaccccgtttcccccccgacgggtaccccctaacccccgttccctaaccggaaacggaccgtaccccgtacccggttaccggggtccggggggacccaaccgggacccgggtccccggggccccgggttaggggccccgttacgggtacccgggtttacgggtaacccggttaaaccgggttacccttaacccccgtttaccccgttacgtacggttcccgtacgttcgtcggggacgggtccggggtccggtacgggaaccgacggccgtacgaacgtggcngangnnnnnnnnnnnnnnnnnnnnnnnnn

SEQ ID NO: 126053 - DNA, 728 bp, Homo sapiens
  misc_feature: GYAE6OF01A2OWL.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctgggagcgaggagggtagaaaaacggcccggggagttcctctagaagactccttccgttaggttaagggttctggaatactattcgtttaacggaccttacgtggacgtcgggcgtggggtcgcggccgaagggtcggacccggggaaaggccgtaggaagtggagtgggatcgatcgtactcgtgtagtacgtacctcgtagaactaaccgagtactaaccgtacgttcccgtacgttacgaacggtcccgtaccgttacctacccgttccgtaccgaccgacccggtaacctaacgtacccacgttaccgaaccgtacccgtaaccccgtcccgtaaccgtccggacgtaacggtcggaacgccgaaccggtaccggtacggaacccggtcccgtacgggaaccgtacggacccgtacctaagttaaccttaagttaccgtacggtaaccgaaacggtaaaccgtagtacggcgtacgacccgtaacccgtaaccccggttaaggtaccgttacgaccgtacgggtacccgggg

SEQ ID NO: 126054 - DNA, 753 bp, Homo sapiens
  misc_feature: GYAE6OF01BU143.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcgaggaggtagaaaaacggcccgggggagtcctctagaagactctccgtaggttaagggttctggatacattcgtttaggacctacgtggatcggcgtgggtgcgccgaggtcggacccggggaaaggccgtaggaagtgggagtggggactcatctatcctgatcgactctagactaccgagactacgtacgtcccgttccttacggaacgggtcccgtccgttcctacccgtttctaccgtaccggacccgaaccgtaacgtaccctaacttaccgaacgacccgtaacccccggccccgttaacccgttcggaccgtacgggtcggaacgtacccgtacggaccccgtaagggaacccgggtccccgtaccggggaacccgacggtaccccggaccttaacgttaacgttacgtttaacgtaccgggttaacggaaacccggaaaaccgttaaggttaacccggacgtaaccggtaccccgtaaccccggtaaacccccgggtttaaacggtaaccgttttcgggaaacccgtttccggggtaacccgggggg

SEQ ID NO: 126055 - DNA, 577 bp, Homo sapiens
  misc_feature: GYAE6OF01BL6DN.4.38.D05.1.454.CMB.1.raw
  modified_base (305)..(305): a, c, t, g, unknown or other
  misc_feature (305)..(305): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaaggggaaagacgccaccctctcctgcagggccagtcagagtgttagcagcagctacttaacctggtaccagcagaaacctggccaggctcccagctcctcatctagtggtncatccagcgaggccacgtaggcactcccgaggtacgtaacggttcaaggtggcgtagggtcgggtctaggggaccagtaccttcacgtcctacaccatcagtcaacgagtggacgctagtaagtattttcgngtagtgttattactgtancgngtagtagtggtacgtccgtcgtaccggtacggttaccggacggaacggaccgtaaagggtaggaaacgtaacgaaacggtaacttggtacggcgtacggacacctactcgttcgttacc

SEQ ID NO: 126056 - DNA, 760 bp, Homo sapiens
  misc_feature: GYAE6OF01BC4VK.4.38.D05.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctccagataccaccggagaaattgtgttgacgcagtctcaggcacctgtctttgctcgagggaancgccacctctctgcaggccagtcagngtgtagcagcagcttactaaccgtggtaccagcaacgaaccgtcggccaggtcctcccgaggtcctcctacacgtctagtcggtacgcctaacgtccgaagccggacggcctacgtcggacctacgtcccgaaggtacgtacggttcgacggtgggactacggggttcgggtaccgtagggacctacgtaccctttactaccgttccgacctaaccgtactaccggtaacggtaccgtaacggtaccggtcgggtaaaccgtaccggtaacgggtttaaacggtttagtttttaccggacgttaaacgggtttacgtttaacgttttacggttacgttaaccggtaggtacccggttaagggtttcgggttacgggttaccgtcccgttacccgtaacccggggttacggtacccgggtaacccgggaacggggtaaccggtaaacggggttaacgtaaaaccgttaccggaaaaacgggtccggttagggtacggacgttaccgacccgttaacgtacgttccggtacgtttaacccg

SEQ ID NO: 126057 - DNA, 864 bp, Homo sapiens
  misc_feature: GYAE6OF01C4XWF.4.38.D05.1.454.CMB.1.raw
  modified_base (176)..(176): a, c, t, g, unknown or other
  misc_feature (176)..(176): n is a, c, g, or t
  modified_base (662)..(662): a, c, t, g, unknown or other
  misc_feature (662)..(662): n is a, c, g, or t
  modified_base (772)..(772): a, c, t, g, unknown or other
  misc_feature (772)..(772): n is a, c, g, or t
tcagagcactgtagcacgaccggtgctcgatttagtatctgataggttgggtttgggggagtctccctcactgcccagctgggatctcgagggcttctatttttctgtccctccaccatcagtgggtaccaaccgccatccctcgcccctcctccgtggcttgttctaccgaaggngtctggtcgccgaggtgcagtcgtggtgcgtagtcgtaggagacgaagggagggtaaaggaaaaaccgggccggggtagttacgtacgtaagaagtaccttccgttaccggttagggttaacgggttacgtacggtaacttaacgttacgttttacggtttaaacggtaccgttacggtaggttacggttccgggtggggttacgggggtaccggcccgggtaccggtaacggggggttacccggggaaaccccggggggtaaacggttaccggtaggggtaaggtaggggtaacgggtacggggtaacttacgtaacgttactacgttaccgtagtacgtagtaccgttacgtacgtaacctaacgacgttacgtaccgtaccgttcccgttaccgacggaccgtccgtccgttaccgtaccttcgaccgaaccgtaccgtaaactacccgtcaacgtaccgaaccgacccctcgacccgttacnggtaccggtaggtacgcgtacgtacggacccgtaggaccgtccgaccgggacacggcttaacgtaattacgttacgtaccggagtaaacccgtaaaaccggaaccgtaanaaccggtccgttaacccgtacccggtaaaccccggtaaccggggttttaaatcgggtttaaacccggaccgggtcggggtaaacccccgggg

SEQ ID NO: 126058 - DNA, 708 bp, Homo sapiens
  misc_feature: GYAE6OF01B0HXZ.4.38.D05.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagagcactgtagcacgaccggtgctcgatttagtatctgatagttgggtttgggggagtctccctcactgcccagctgggatctcagggcttcattttctgtcctccaccatcatgggtcaacgccatcctcgccctcctcctggctgttctccaaggagtctgtgccgaggtgcagctggtgcagtctggagcagaggtagaaaaacggcccgggagtctntagaagatctctaggtaaggttcnggatacattacgttaggacctagtcggactcggcgtgggtcgccgccgagggtcggacccgggaaaggccgtaggtaagtggtacgtgggatcatctcgtactgactcgactcgtacgactaacgtagatacgtacgttcccgtccgttacgaacggccgtacgtcctacgttcctacgacgacccgactacgtacctactaccgacgtaccacccgttacccgtaccgtcgaccgtaagggttccggaacgtccgaacggtcccgtaacggaacccggtaccgtaccggaaccgtacggtcccggtaaccttaacgtacgttaaccttaacggttaccggtaaccgtaaacccggttaaaacgccggtaacgtaccgtaacccggtacccttaaccccggtaaacccggttaaacggttacccgtttacggtaaacccggtaccgggttaacccggggg

SEQ ID NO: 126059 - DNA, 723 bp, Homo sapiens
  misc_feature: GYAE6OF01D4YJJ.4.38.D05.1.454.CMB.1.raw
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
tcagagcactgtagcacgaccggtgctcgatttagtatctgataggttgggtttgggggagtctccctcactgccccgagctgggatctcacgggcttcattttctgtcctccaccatcatggggtcaaccgccatcctcgccctcctcctggctgttctccaaggagtctgtgccgaggtgcagctggtgcagtctggagcgagaggtagaaaaagcccggggatctcgtgaagatctccgtgtaagggttctggatacatcttaggacctacnggagtccggntgggcnccgcgaggtcgcccgggaaagccgtaggaatcggagtggggatcgtatcgtactccgtgactcgtactcgtaggactaaccacgataacgtacgtcccgttccgttacggaacggcccgtcgtcccgtaccctttccgccgtaacgtacccgaacgtaacgtaccctaacgtccacggacccgaccccgtaccccgttccgtacggtaccgtaacggtcgggaacgaccacggtacccggtacggtaaaccggtccccgtaaccggggaacccacggcccgtacccggtaatttaacgttacgtttaccgttaggttaacccggaaaccccgtaaaaccgtagggtaacgaccgaccgtaccccgtaaaccccgtaacccccggttaaacggttaccttttaaccggtaccgttaacccgggtaccgggggg

SEQ ID NO: 126060 - DNA, 587 bp, Homo sapiens
  misc_feature: GYAE6OF01D137Z.4.38.D05.1.454.CMB.1.raw
  modified_base (189)..(189): a, c, t, g, unknown or other
  misc_feature (189)..(189): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(587): a, c, t, g, unknown or other
  misc_feature (563)..(587): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcggaaggccgcgtcaccttctcagccgacaagtccatcagcaccgcctactgcagtggancagcctggaagcctcggacagcgccatatattactgtagaacgaaaaccagtagacctagcctaccaccccggtaagtacctttgacttacggtcgggccgacggaacccgtggtccacgttctcctcctcacgccctccaaccggaacggcccgacgtccgtcccttcccccgtcgccctacccctcccgtaccaacgacgaccacccgtccgtacgggggcaccgaccggccggtcccggtcgggccgtcgtacccgtcgggtaacccgaacggtacccttacccgttaccccgtacgtacggtcgtaccctcggttacgggacgggtccggggcggtaccgggacggaacggtccgaccgatacgcncngnnnnnnnnnnnnnnnnnnnnnnnnn

SEQ ID NO: 126061 - DNA, 803 bp, Homo sapiens
  misc_feature: GYAE6OF01EVZMP.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggcctcccagataccaccggagaaattgtgttgacgcagtctaccaggccaccctgtctttcgtctaccggaaggggaaacacgccccaccctctccgtgcgtacggcctagtcagagttgttagcgagcacgtacttaaccttaaccgtcgtaccgagtaccaacgtaaacccgtcggcccaacggccgttacccgacggtcccttacccgtcttaacttaccgttaggttcgggtacgtcccgtaacgtacccgaacggacccgggaccgggtaccccaacggttccggaccctaacccggttacccgaacgaaccggttaacggttccgagggtcggtacggtgggtacgggtcgtacgggaactacggtaaccttctccgtacctaccactaacgtcgacgtcgtaagtaccgtaggaacctacggttaacgtaacgtttagtttccggtaagttacggtttgtttaaccttacgttacgtacgtaggtacgtagggtttacggtcgggttacctaccggtaccgtaaccgggttaccgggtaccggtaaaccgggtaacgggtaaaccgggtaaacggtaaaccggtacttaaaaccgggtaaacgggttcgttacggggtcggtacctaacggtacctaacccgttactttccgggtaccttttacccg

SEQ ID NO: 126062 - DNA, 757 bp, Homo sapiens
  misc_feature: GYAE6OF01CHHS5.4.38.D05.1.454.CMB.1.raw
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (445)..(445): a, c, t, g, unknown or other
  misc_feature (445)..(445): n is a, c, g, or t
tcagagcactgtagcacgaccggtgctcgatttagtatctgatagttgggtttggggagagctgctcagttacggacccagagggaaccatacggaaaccccagcgcagtcttctcttcctcctgctactctggctcccagactaccacggagtaaattgtgtagacgcagtctccaggccaccctgttccttcgtctaccgaggggtaaancgccaccctctccngcaggccagtcagagtntancagcagtctacttaaccngtaccagacaagaacctgggacctagggccctaccgacggtaccttcctacgtaacgtttccgtaacggttgggactaccaacgtacccggaaggtaccggaacggggtacccacggtacgggaccctaaacgtccccgtaagaaccgtaggtttccgagttggaccgtaggtcgggtacnggaactcgtaacttcgaacttcgtaacaccagtacacggtaccagtaccgtagggtacgaccgttagggaaacgtttacgtttacgccgttagttacggtttaaccttagtacgtaccgtggtaacgttaacggtcggtttaaggtaaccgttccggtaacccgtaaccgggttacccgggttaaccgggtaaccgtaaacggggtaaaccgtttaaaacgggagggtaaaaaacctaacggggtaaaccctaaaggttcggtaacgggttacccaggaaacccttaacccggttaactcgtacggtttacc

SEQ ID NO: 126063 - DNA, 704 bp, Homo sapiens
  misc_feature: GYAE6OF01CGRD5.4.38.D05.1.454.CMB.1.raw
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
tcagagcactgtagcacgaccggtgctcgatttagtatctgatagttgggtttgggggagtctccctcactgcccagctgggatctcagggcttcattttatgtcctccaccatcatggggtcaaccgccatcctcgccctcctcctggctgttctccaaggagtctgtgccgaggtgcagctggtgcagtctggngcaggaggtagaaaaacggcccggggagtctctagaagactcttccgtaggtaacgggttcnggtatacattacgtttaaggacccttacgtggacgtcgggcgtggggtcgccggccgagggtcggaccccgggggaaaggccgtaggaagtggaggtggggatcgtattctactccgtgtactcgtacttctacgactaaccgagtaactaccgacgtttcccgtaccgtttacggaaaccgggtcccgtaccgtacccgtaaccctttcgtacccgaccggtaaccccgtaaccgaaccgtaccctaacgttacccgaacggtaccccgtaccccggtaccccttacccggtcgaccgtagggtacggacggccacggcccgtagaacgggtcccgtacggacgacgccgactagttactacgttactggtacgaaaccgaaactaggacgcgacgtaccgacccgtaacccgttacggtaacgttcgtacgtccggtaccgggg

SEQ ID NO: 126064 - DNA, 992 bp, Homo sapiens
  misc_feature: GYAE6OF01DXQMM.4.38.D05.1.454.CMB.1.raw
  modified_base (166)..(166): a, c, t, g, unknown or other
  misc_feature (166)..(166): n is a, c, g, or t
tcagagcactgtagcacgaccggtgctcgatttagtatctgatagttgggtttgggggagtctccctcactgcccagctgggatctcgagggcttctattttctcgtcctccaccatcagtgggtcaaccgccatcctcgccctcctcctgctgttctccgaaggngtctgtgccgaggtgcagtcgtggtcgcagtcgtggagcgaaggtaagggtaacggaaaaacgggccggggtagttccgtacgtaggaaacgtactccgttaccggttagggttaaacgggttcgtaaggtaacttaacgttaactttaccggttttaaaccgggtaaccttacggttacgggtacggttccggggtcggttcgggggttacggcccgggtaccggtaacgggggttacccggggaaaccccggggggtaaaacgggtcccggttaaggggtaacgggttacggggacggggttacggggtaacttacgttaaacgttcgttacgttaccggtaggtaacgttacggtaaccgttccgttaaagtaaccgtaacccgtaaggtaaccttaaccggtaccggtttaccccggtttaccggttaccgggaacccgggtcccgttacccgttaacccgtttacccgtttaccgtacggaacccggtaccggttaaacctaacccggttccgaaactaccggaacccgtacccgttaaccccgtcccgttaaccggtcgaccggttagggtacccggaacggtaccgaccggttacggtaaaccgggtaccccgggttacccggaaccgggtacccgtaaccgggtaccttaacccggttaaactttacgttaaaccgtttacggtaaaccgggtaacggaaaaaccccggttaaacgtacgggtaaccacccggttaacccaaccccgggttaaacccgttaaacccgggttaccgtttaacggttaaccgggtaacccgtcggggtaaaccccggggg

SEQ ID NO: 126065 - DNA, 733 bp, Homo sapiens
  misc_feature: GYAE6OF01DQR39.4.38.D05.1.454.CMB.1.raw
  modified_base (148)..(148): a, c, t, g, unknown or other
  misc_feature (148)..(148): n is a, c, g, or t
  modified_base (196)..(196): a, c, t, g, unknown or other
  misc_feature (196)..(196): n is a, c, g, or t
tcagagcactgtagcacgaccggtgctcgatttagtatctgataggttgggtttggggagagctgctcagttaggacccagagggaaccatggaaaccccagcgcagcttctcttcctctgctactctggctccagactaccacgganaaattgtgttgacgcagtctcaggccacctgtcttgctcgaggggaancgccaccctctccgtgcgagggccagtcaggtagtgtagcagcagctacgtactggaccagacagaacgtgccaggcctaccgacgcctccgtactactcgtagtcggtacactacgtcccgagccgacgggcccacggtcggactaccgtcccaaggtacgtacggttcgaagggtcggacgtaggggttcggtacgagggaactacgtacccgtttccaaccttccgtaccgaacctcgtaccgaacgtaccgtacggtacgtacgggtacgtacgtaaggtaacgttagtttcggacgttacgttagttaaccttcgtacggtacgtacggtcgttaaggtcggttacgggtaccgtacccgttaacgggtaacccgggttacgggttaacccgggaaaccgggtaaaccggggtaaaccggaaaaggggttaaaccgggtaaaccttaaaccgggtaaaaccggttaaccggtaggggttaacccggtgtaacccggtaccctaaccggttactttcggttaccgtttacccg

SEQ ID NO: 126066 - DNA, 741 bp, Homo sapiens
  misc_feature: GYAE6OF01ALIC5.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaacggcccggggatctctagaagatcctccgtggtaagggttctggatacattcgtttaggacctacgtggatcggcgtggtcgcgccgaggtcggacccgggaaaggccgtaggatgggagtggggactacatctatcctgatcgactcgtagactacagtactacgtcgttccgtccgttacggaacggtcccggtacgttccctaccctttccgtcgaccggacccgtaaccgtaacgttcccaacttaccgacgaccccgtaaccccggtacccttacccgtacggaccgtaggtacgggaccgtacgaaccggtacccggtacggaaccgggtccccggtaccgggaaccgtaccggaccgtaccctaactttaacgttaaccgttaccggttacggtaaccggtaaaccggtaaaacccgtaagggtaacggcccgaaccggtaccccgttaaccccggtaaaacccccgggtttaaggttaacccgtttacggtaacccggtttacggggtaacccccgggggg

SEQ ID NO: 126067 - DNA, 836 bp, Homo sapiens
  misc_feature: GYAE6OF01D812O.4.38.D05.1.454.CMB.1.raw
tcagagcactgtagcacgaccggtgctcgatttagtatctgatagttgggtttgggggagtctccctcactgcccagctgggatctcagggcttctattttctgtcctccaccatcagtggggtcaaccgccatcctcgccctcctcctggctgttctaccgaaggagtctgtgccgaggtgcagtcgtggtgacgtacgtcgtgggagcgaagggtaagggtaaacggaaaaacgggcccggggggtattaccgtacgtaggaaaagtacttccgttaccggttaagggttaaacgggtttctaagggtacttaacgtacgtttacggttttaacggaaccttacggtacgggtacgttcgggtcggttggggtaccggccggtaccggtacgggggtaccgggaacccgggggaaacggtccggttaaagggtaacggtggggtaaggtaggggtacttacgtacgtttcgtacgttccgtaaggtacgttacgtaccttacgtaacgtaactaaccgaaggtaaccgttaaccgtaccggttacccggttacccggtttacgggaaccgggttcccggtaccgtttaccctacccttacgtaccgaccggtacccgtaacctacgtacctactacgaacccggtacccgaccccgttaccgtaccgtcgtacgtacggtacgacgaccgtaccggtcgtaacggaccggccggacggtacgacgtccgaacctattaagttacttacggtacgtaaccgaaacgtaacgaggactaccgtacgaccgtaccggtaacgttaacggttacgtaacgtccgtacggggtaccggg

SEQ ID NO: 126068 - DNA, 800 bp, Homo sapiens
  misc_feature: GYAE6OF01A8RRM.4.38.D05.1.454.CMB.1.raw
  modified_base (219)..(219): a, c, t, g, unknown or other
  misc_feature (219)..(219): n is a, c, g, or t
tcagagcactgtagcacgaccggtgctcgatttagtatctgatagttgggtttggggagagctgctcagttaggacccagagggaaccatcggaaaccccagcgcagcttctcttcctcctgctactctggctcccagataccacggagaattgtgttgacgcagtctccgaggccaccctgtctttgtctaccgaggggaagacgcccaccctctccngcagggccagtcagtagtgtagcagcagtcctaacgttaaccgtggtaaccagaccgaacgtaaacccgtggacccgacggccctaccccgaggtcccttcctactacgttccgttagtcgggtcgaccaacgtcccgaggaccggacggggtccccaacgttcggaccaaccttcccggaagtaccgtaacgggtttcaagggtcggccgtagggttggggtcgttaacggggacctaaggtaccctttcgaacccgttccgtaaccgtaaccgtacgtacgacgaccggtaacggtacgttacgggaaccgtaccgttaaggtaacggttacgtttggaacgttaggtttacgtttaacgtttacgtacgtacgtaggtaccggtaggtttcgggttaggtaaccgtaccctttacgggaccccggttaacgggttcccgggaaacccgggtaaacggggtaaacccgtaaaggggttaaaccggaaaaccgttaaccgggaaacggttaaccgggtcggttaccggggaacctaccgggtaccttaaacccggttactttaccggttaccggttaccc

SEQ ID NO: 126069 - DNA, 767 bp, Homo sapiens
  misc_feature: GYAE6OF01D2XLL.4.38.D05.1.454.CMB.1.raw
tcagagcactgtagcacgaccggtgctcgatttagtatctgatagttgggtttgggggagtctccctcactgcccagctgggatctcagggcttcatttttctgtccctccaccatcatgggtcaaccgccatcctcgccctcctcctggctgttctccaaggagtctgtgccgaggtgcagctggtgcgagtcgtggagcgaggaggtaaggaaaacggcccggggagtcctcgtagaagactccgttccgtagggttaagggttcgtaggaacttacgtacgttacgttttaacggaccgttacgtaggacgtcgggtcgttcggggtcgccggccggtacggggtccgggaccccggggaaacggtccggtaagggtaaggttggggtaggttacggggacttaccgtactttaccgttaacgttcccgttaaggtacgttacgtaccgttacgtacgtaaactaaccgaagtacgtaaccgttaccggttcccggttacgttaccggaccgggtccgtaccgttacccttaccctttccgtaccgaaccgtaaccctaaaccgtaaccgtaccctaacgtaccgaaccgtaccccgtacccgtcccttaccgtcgacgtacggtgaacgcgaccgtcgtaacggaccggtaccgacgacgacgccgtactagtacttacgttacgcgtaacgaaccgtaacgtagtacgccgtacgtacccgtacccgtaaccgtaacgttacgtacgtacgtcgggtaccgg

SEQ ID NO: 126070 - DNA, 1046 bp, Homo sapiens
  misc_feature: GYAE6OF01CJ36L.4.38.D05.1.454.CMB.1.raw
tcagagcactgtagcacgaccggtgctcgatttagtatctgatagttgggtttgggggagtctccctcactgcccagctgggatctcgagggtcttctattttctcgtcctccaccatcagtgggtcaaccgccatcctcgccctcctccgtggcttcgttctaccgaaggacgtctgtcgccgagggtcgcgagcgttggtcgacgtaggtcgtaggacggagaagggaacgggtaaacggaaaaaccgggtccccgggggtaattccggttagaacggtaaaggtcttccgtttacgttaacggggttaaaggggttcgtaaggttaacttacgtaacgtttaccgttttaacgggaaccttaggtcggtacggtccggtcggtttcggggacggcccggtccggtaaggggttacccgggaacccgggggtaaacgtccggtaaggtacggtaggttaacgggtcgggacttacgtacgtttacgtaccgttcgtagtacgtacgttaccgtacgtaacgtaacttacgaacttaaccggtaccgtacccggtttaccgttacccggggttaaaccggcccgggttaaccccgttcccgttaacctttaccccgttaaccgtaccggtaacccggtaaaccccgttaaaccgttaaaaccccgtttacgaaaccccgttacccgaaaccggtccccccgttaacccggttacccctaaccgggttggaaacccccgtaggggttaccccgggaaccacggtaaccccgggtaacggttaaccggggtaaccccgggacccgttaacccgggaccgaaacccggttacctaaaccccggttaaatttaacccggttaaaccgttttcgggaaaccccggtttaaaaacggtaaaccccggtaaaaccgggtttaacggtaaacccggttcccgaaaacccccggttttaaccccgtaaacccgggtaaccccggttttaaacggggttttaaaccccggttacggtttaaaaccccggggtaaccccgggggtttacccggggg

SEQ ID NO: 126071 - DNA, 736 bp, Homo sapiens
  misc_feature: GYAE6OF01ELCT8.4.38.D05.1.454.CMB.1.raw
  modified_base (159)..(159): a, c, t, g, unknown or other
  misc_feature (159)..(159): n is a, c, g, or t
tcagagcactgtagcacgaccggtgctcgatttagtatctgatagttggggtttgggggagtctccctcactgcccagctgggatctcagggcttcattttctgtcctccaccatcatggggtcaaccgccatcctcgccctctctggctgtctcaggngtctgtgcgaggtgcagcgtggtgcagtctggagcgaggaggtagaaaacggcccggggtagtctacgtaggaagcttccgtccgtagggttaacgggttctaggtaacttactagtttcgtttacggaccttacgtggacgtcgggtcgtggggtcgccgccggaggggtccggaccggggtaaggccgtagggtacgtgggtaggtaggggactcgtatcgtactccgtagtagtcgactcgtagaactacgagtactacgtacgtcccgttacgtacggacggccgtcgtacctacttcgtacgacgtacccgaataccgtaccactccgacgtcccgtaccccggtacccttacgtcggacgtagggtccggaacgccgaccggtcgtaacgggacccggtcccgtaccgggaccgacggtacccgtaaccttagtttaaccgtacggtttaacgtccgggtaaaccgaaaccggtaaaaccgtgaaaccggtccgaacccggtaccccgttaacccggtaacccgggtttaagttacccggtttacggaccgttaccggggtaacccggggg

SEQ ID NO: 126072 - DNA, 670 bp, Homo sapiens
  misc_feature: GYAE6OF01B2B24.4.38.D05.1.454.CMB.1.raw
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtgcagcgtgggtgcgagtcgtggagcgaaggaaggtaaggaaaaaacggcccgggggattccgtctagaaacgacttccttccgttagggttaaacggggtttctagggtaacttaaccgtatttaccgttttaacgggaaccttacgtgggtacgtcggtcgtggggtcgccggaccggtagggtcggacccggggaaaggccgtaggaagtgggaggtgggatcattctatccgtgatcgactgtagactaccgagtactacgacgttccgtcgtacgacgccgtcgtactaccttctacgacgaccgaactaacgtccaactcgaccgacccacccgtccctacgtgaccgaggcggacgcgacgtacgtacggacgcccgtacggacgacgccgactatacgtattacgtcgaacgtaacgaaacgtagacgcgtacgtcccgtaaccgtaacccggtaagttacgtacgtaccggtacggtaccgggg

SEQ ID NO: 126073 - DNA, 756 bp, Homo sapiens
  misc_feature: GYAE6OF01BTZYI.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagcgtggtgcagtctggagcagaggtagaaaaacggccggggagtctctagaagatctccgtggttaagggttctggatacattcgtttacggacctacgtggacgtcggcgtgggtcgccggccgagggtcggacccggggaaaggccgtaggaagtggagtggggatacgatctactcgtgatcgtctcgtagaactacgagtaactacgtacgttccgtaccgttacggaacggtccgtccgttaccgtacccttcgtaccgacggacccgtaacgtaaccgtaccctaacttaccgaacgaccccgtaaccccgtacccttaacccgtacggaccgtaacgggtacggacggaccgtaccggtaccggtaacgggaacccgggtacccggacccggggtaaccgaccgggtacccgtaccgtaacttaacgttaactttacccgtaagggtaaccgaaaacccggtaaaaccgtaggtaacggtccgaaccgtacccgttaaaccccggtaaacccgggtttaacggttaacccggtttacggtaacccggttccggggtaaaccccgggggg

SEQ ID NO: 126074 - DNA, 221 bp, Homo sapiens
  misc_feature: GYAE6OF01D9LQD.4.38.D05.1.454.CMB.1.raw
  modified_base (97)..(97): a, c, t, g, unknown or other
  misc_feature (97)..(97): n is a, c, g, or t
  modified_base (195)..(195): a, c, t, g, unknown or other
  misc_feature (195)..(195): n is a, c, g, or t
  modified_base (211)..(221): a, c, t, g, unknown or other
  misc_feature (211)..(221): n is a, c, g, or t
tcagagcactgtagcacgaccggtgctcgatttagtatctgatagttgggtttgggcggtgctcgatttagtatctgatagttgggttggggggaanaggaagactgaccggtccccccaggagttcaggtgctgggcacagcggccctgggctgcctggtcaaggactacttccctacagtgctctgagcgggntggcaaggcgcatagnnnnnnnnnnn

SEQ ID NO: 126075 - DNA, 709 bp, Homo sapiens
  misc_feature: GYAE6OF01BX9F8.4.38.D05.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (675)..(675): a, c, t, g, unknown or other
  misc_feature (675)..(675): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(685): a, c, t, g, unknown or other
  misc_feature (683)..(685): n is a, c, g, or t
  modified_base (688)..(709): a, c, t, g, unknown or other
  misc_feature (688)..(709): n is a, c, g, or t
tcagagcactgtagcacgaccggtgctcgatttagtatctgatagttgggtttaggtgcccgggaaaggcctggaatggatggggatcatctatcctgatgactctgataccagatacacgtccgtccttcggaaggccgcgtccaccttctcacgccgacaacgtccatcagccaccgcctacctgcaggtggancagcctaggaacggcctcggacagccgccatatattacgtgtacgaaccgaaaaccngtagcacgcctaccgaacccggtagtactttacgacgtacggtcggggaccgtacgggaacccgttcggcctacggttccgttacctccgtacccgaccgtacccgtacccgaaacccgggaacccgggtccctaaccggttccccggtttaccccgttccccccggtaccgacccccgtaacccccgttccgtaaaccccggaaacggtaccgtccccgtaacccggttccgggaccgggggactaaccccggccggggtcccggtccccggttcggggtccctccgggtaccggtacgggtaacccgtaaacggttcccctttacccgttaacccttaacggcgttccgtaccgttacggccgggtaccggggaccgggttccgggaccgggttaacggacccggacgttaacgaggccngcgngngnnngcnnnnnnnnnnnnnnnnnnnnnn

SEQ ID NO: 126076 - DNA, 749 bp, Homo sapiens
  misc_feature: GYAE6OF01BMF4J.4.38.D05.1.454.CMB.1.raw
  modified_base (246)..(246): a, c, t, g, unknown or other
  misc_feature (246)..(246): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggatctctgaagatctcctgtaaggttcnggtatacatctttaggacctacgtggatcggcgtgggtgccggccgagggtcggaccccggggaaaggccgtagggaagtgggagtggggatcgattactagtcctgatgactctagactacgaagaactacgtacgtcccgttacgttaccggaacggtcccgtccgttacctacccgtttcgtaccgaccggaccccggaaacgtaaccgtccctaacgtaccgaccgtacccgtaaccccggtcccgttaacccgtcggaccgtaacggtccgggaaccggtccgtaaccggtcccggtacgggtaaaccgggcccccggttaacgggacccgtacggacccgtaaccctagttaaacgttacgtttaaccgtacggttaaccggaacccgtaaaaaaccgtgggttaaaccgccggtaaccgaccccgttaaacccccggtaacccggtttaaacggttaaccgttttaccggaaaccggttaccgggtaacccggggg

SEQ ID NO: 126077 - DNA, 684 bp, Homo sapiens
  misc_feature: GYAE6OF01EMXKY.4.38.D05.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (659)..(684): a, c, t, g, unknown or other
  misc_feature (659)..(684): n is a, c, g, or t
tcagagcactgtagcacgaccggtgctcgatttagtatctgatagttgggtttaggtggcccgggaaaggcctggaatggagtggggatcatctatcctgatgactctgataccagatacgacgtccgtccttcggaacggccgccgtccaccttctcagccgacaacgtccatcagccacccgcctacctgcgagtggacncacgccgtaggaacggcccgtaccgggacncgccgacctaattacttattacgtggtacgaaccgaaaaccngtacgccacgtcctaccgtaaccccggtaagtaccgttttgaccgttacggtccggggaccaacgggaacccgtggtacctacgtcgttccctcctcgacgtcccctacccgaaccgaacccgggccctacggttccccggtcccctttacccccgcggtaccccctaccccgtacccgtaaccgaaaccgacccgtcctaccccgggtcgggtacccggggaccaaccggcccgggtccccggggtcccggtcggggtaccctccgggtcccggtacggtaacccggtaaacgggtacccctttacccgttaccccgtacgtacggttcgtaccgtcggtacggtaccgggcgggacgtaccggacgacggaccgtcaagtcgnnnnnnnnnnnnnnnnnnnnnnnnnn

SEQ ID NO: 126078 - DNA, 734 bp, Homo sapiens
  misc_feature: GYAE6OF01CI809.4.38.D05.1.454.CMB.1.raw
  modified_base (200)..(200): a, c, t, g, unknown or other
  misc_feature (200)..(200): n is a, c, g, or t
  modified_base (540)..(540): a, c, t, g, unknown or other
  misc_feature (540)..(540): n is a, c, g, or t
  modified_base (551)..(551): a, c, t, g, unknown or other
  misc_feature (551)..(551): n is a, c, g, or t
  modified_base (597)..(597): a, c, t, g, unknown or other
  misc_feature (597)..(597): n is a, c, g, or t
  modified_base (684)..(684): a, c, t, g, unknown or other
  misc_feature (684)..(684): n is a, c, g, or t
tcagagcactgtagcacgaccggtgctcgatttagtatctgatagtttgggtttgggggagtctccctcactgcccagctgggatctcgagggcttctatttttctgtccctccaccatcagtgggtcaaccgcatcctcgccctcctcctggctgttctccgaaggtgtctgtgccgaggtgcagctggtgcagttcgnggacgcgaaggtaaggtaaaggaaaaacggcccgggggtataccgttcgtaggaaacgtactccgttaccgttagggttaaacgggtttcaaggtactaacctagttttaccggttttaacggacccgtttacgtaggtacggttccggtcggttggggtcgccggtaccggagggggtttcccggaacccgggggaaaacggtccgttagggaagtggggtaaggttcggggtataacggtacttcgttaacgtcccgtagaagttcggaccttcggtactacttaccgaagtaatccgtaacggtccgttacgtcgaacggtcttcggcttaccgtcncgtacgctaanacgtccatcgacaccgacgtccaccgtgacgtagtacggataccgngttacccgaagacccggtccgtaacgggactcgtaccccgaattacgttacgttaattaccgacggttacaaaccggttaaaccggngtaacgactaccgacctaccgtaccgtacttacgtacgcggtacgggtcg

SEQ ID NO: 126079 - DNA, 724 bp, Homo sapiens
  misc_feature: GYAE6OF01D4Y27.4.38.D05.1.454.CMB.1.raw
  modified_base (383)..(383): a, c, t, g, unknown or other
  misc_feature (383)..(383): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaacggcccggggagtctctgaagactctccgtaggtaagggttctaggtatactattcgtttaacggaccttacgtggactcggcgtggggtcgccggaccgtagggtcggacccggggaaaggccgtaggaagtgggaagtggggatcagttactactccgtagatgaccttntagaactaaccgagtactacgtacggttcccgtacgttacggaacggtcccgtcgtacctaccgtttctacgacgccaacgtaacgtcctatccgaacgcctacccggcttaaccgtgcgaggtcggacgtccgacgtcgtacggaaccggccgtacgggacacggacctaccgtaacttacttaacgtttaccgtacgggttaaccggaaacccggtaaaaaccgtagggtaaccgcccgtaacccgggttacccgttaacccccggttaaaacccccgggttaaaggttacccgtttttaaccgggtaaacccgttacccgggggttaaccccgggggg

SEQ ID NO: 126080 - DNA, 751 bp, Homo sapiens
  misc_feature: GYAE6OF01DQJ8G.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgcatcctcgccctcctcctggctgttctccaaggagtctgtgccgaggtgcagctggtgcagtctggagcaggaggtagaaaaacggcccggggagtctacgtagaagtatccgtccgttaggttaacgggttcgtaggtaactactactttacgtttaacggacccttacgtggtacgtcggtcgtggggtcgccgccggtacggtcggacccggggaaacggccgtaggaagtggagtggggatcgattactacgttccgtagtacgtcgtacttcgtagtaactaaaccgagtaactaacgtaccggttcccggttacccgttacgggaaccggtcccgtacccgttaccgtaacccgtttctaccggacccgtaccgaaaccgtaccgttaccctacgtaccgaacgaccctaccccggtacccttaaccgtaccgacgtacgggtacgggtacgaccgacgggtaccgtacgggaaccggtcccggtacggacgtaccgccgtaaccgtacttacgtttaacgtacgtacggtaacgaaaccggtaaaccgagtacgacctaacgcccgtaccgtaacccggtaagttaccgtttaacgacccggttgggaacccgggg

SEQ ID NO: 126081 - DNA, 818 bp, Homo sapiens
  misc_feature: GYAE6OF01EECCC.4.38.D05.1.454.CMB.1.raw
tcagagcactgtagcacgaccggtgctcgatttagtatctgatagttgggtttgggggagtctccctcactgcccagctgggatctcgagggcttctattttctgtccctccaccatcagtggggtcaaccgccatcctccgccctcctcctggctgttctaccaaggagtctgtgccggaggtgcgagcgtggtgctaggtcgtggagcgaaggaagggtaaggaaaaacgggcccggggtagtccgtcgtagaagtacttccgttaccgttagggttaagggttcgtaggtaactacgtagtttaccgttaacggtaccttacggtaggtacggtccggtggtcggggtcggccggaccggtacgggggtacccggggaaccccgggggtaaacgggtccgggttaaggggaaacggttaggggtagggttagggggtacttaccgtacgtttacttacgtccggttaagtacgtcgtacttcgtacgtaactaccgtaagtaactacgtaccggttcccgttaccgtacgggacccgtccggaccgttcctacccttcgtaccgaacgacccaagtaccgtaccacgaccgaccgtcccgaaccccgtcctaccggtcgacgtagggtccgacgccacggtcggtaacggaccggtcccggacggaaccgcgacccgtattaactcgtttaacgtacgtacggaacgtaaaaccggtaaacgtaggaaccggccgaccgttacccccgtaaccccggttaaaccggttacgttaaacccggttcgtaaacccgggtccggggttaaaccccgggg

SEQ ID NO: 126082 - DNA, 742 bp, Homo sapiens
  misc_feature: GYAE6OF01DIENH.4.38.D05.1.454.CMB.1.raw
  modified_base (186)..(186): a, c, t, g, unknown or other
  misc_feature (186)..(186): n is a, c, g, or t
  modified_base (614)..(614): a, c, t, g, unknown or other
  misc_feature (614)..(614): n is a, c, g, or t
  modified_base (679)..(679): a, c, t, g, unknown or other
  misc_feature (679)..(679): n is a, c, g, or t
tcagagcactgtagcacgaccggtgctcgatttagtatctgatagttgggtttgggggagtctccctcactgcccagctgggatctcagggcttcattttctgtcctccaccatcatgggtcaaccgccatcctcgccctcctcctggctgttctccaaggagtctgtgccgaggtgcagctggtnccgagtctcggagcaggaggtagaaaaacggcccggggatctcgtagaagtactacctccgtaggttaagggttctacggtataactattcgtttacggacccgttagtcggacgttccgggcgttcggggtacgccggaccgtaggggtccggtacccgggggaaaggtccgttagggaagtgggacgtggggtaactcgtaacgttctaacgtccgtagtaacgtgtaccttcgtaacgtaacgtaccgaacgtactaccgtaccggttaccgtcccgttacggaacgcccggtactccgtacccttccgtacgtacccgacctaaccgtaagtaccccgtataccgacgtaccccgaccccggtacctacgtccgacgtggtacggcgacacggttccgaacggtaccgggtacccgtggaaccncggtaccgtacgttacgtttaccttaacgttaggaccgttaccgaaacgtaaacggattacggcnccgtaacccgttacccgtacggttaaccgttaccgtttaacgggccgttcgggtaacccgggg

SEQ ID NO: 126083 - DNA, 706 bp, Homo sapiens
  misc_feature: GYAE6OF01AF8LU.4.38.D05.1.454.CMB.1.raw
  modified_base (160)..(160): a, c, t, g, unknown or other
  misc_feature (160)..(160): n is a, c, g, or t
  modified_base (243)..(243): a, c, t, g, unknown or other
  misc_feature (243)..(243): n is a, c, g, or t
tcagagcactgtagcacgaccggtgctcgatttagtatctgatagttgggtttgggggagtctccctcactgcccagctgggatctcagggcttcattttctgtcctccaccatcatgggtcaacgccatcctcgccctcctcctggctgttctccaagngtctgtgccgagtgcagctggtgcagtctggagcagaggtagaaaacgcccggggatctctgaagctctacctgtaaggttcnggatcgtattcgttacgaccgtagtggatcggtcgtaggtcgcgtccgaggtcggacccgggaaaggtctacggaagtggaaggttacggggattacgtattccgtaacgtccgtagtaacgtcgttacacgtacgtaacgttaacacgtaattaccgacgttaccgttaccgtacggtaacgggccctacgtcctacccttcgtaccgaccgtacgtaaccgtacgtaccacgtacgaaccgtaccgtacccgaccctttccgacgtaccgacggtccgagaccgacgttaccgacggtacgacccggtcgaccgtacggcccgacgttaacgttaacttaaaccgttcgttacggtaaccgtaaacgaaaaccgtgtaacgtcgaaaccggtacccctaaacccgggtaaccccgtttaacggtaagttacccggtaaccgttacccggggtaacccgggg

SEQ ID NO: 126084 - DNA, 835 bp, Homo sapiens
  misc_feature: GYAE6OF01A0060.4.38.D05.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctcaggcaccctgtctttgcctcgagggaancgccaccctntcctgcgagggccagtcagagtgttagcagtctacgttacgcctaggtaaccaaacgacggaaacctgggaccctagggtcctcccgaggcctcctactactctaactgactcgtccacgtcccggacgacgggcctacggtcggcctaaccgtccccgaaggtcccgtaacggtttcgaaggttcggggacgtaaggggtttcggggacgtacggggaactaacgtaccgtttaccacccggtttctaacccgaccctacgttaccccgaccgtaaccggtacccgttaagggacctccggttaaggtaaggtttaaccgtttttcgaaccggtttaacgtttttaaccgttacgtcgttaaccgacggttaccgacggtaacggttaaccgtaccggtaaaccgttccgggtaccctttacggttacccgttacccggtttaccgttaccggggttttacccgggggaaccgggggttaacccggggtaaaccggttaacggggggttaacggtaaccggttaaaccgtaaaacccgggtaaaacccgggttacgttacggggttaacccgggtacgtttaacccggacccgtttaccccggttaacgttcccggtttaacccgg

SEQ ID NO: 126085 - DNA, 899 bp, Homo sapiens
  misc_feature: GYAE6OF01AKV4S.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaacggcccggggagtctctagaagactctcctggtaagggttctggatacattcgttaggacctacgtggacgtcggcgtggggtcgccggaccggaggtcgggaccccggggtaaaggccgtagggaactgggaggtagggggatcattctacgtccgtagtagtcgtacttcgtagtaactaccgaagtaactacgtacggttacccgttaccgtttacgggaaaccgggtcccggtcccgtacccgttaccctttccgtaccgtaaccggacccggtaacccgtaaccgggttacccctaacgttacccggaaccggtaccccgtaacccccggtacccccgttaaccccgttcggaaccggtaacggggttaccgggaaccggccgtaaccggtcccggtaaccgggaacccgggtccccgggtaacccggggaacccgaaccggggaccctaacccggttaacttaaaccggtttaacgtttacccggttaaacggggttaccggaaaacccccggttaaaaaacccggtaagggtttaacccgggaacccgttaaacccgggtaccccccgttaaaccccccggggttaaaacccccccggggtttaaacggggttttaacccccggtttttaaacccgggtaaaccccgggtttaaccccgggggttaaacccccgggggggg

SEQ ID NO: 126086 - DNA, 275 bp, Homo sapiens
  misc_feature: GYAE6OF01CW6PI.4.38.D05.1.454.CMB.1.raw
  modified_base (252)..(252): a, c, t, g, unknown or other
  misc_feature (252)..(252): n is a, c, g, or t
  modified_base (254)..(275): a, c, t, g, unknown or other
  misc_feature (254)..(275): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgactgtggctgcaccatctgtcttcatcttcccgcctatcctgacctacagtgctctggagcggctggcaaggcgcatagcngnnnnnnnnnnnnnnnnnnnnnn

SEQ ID NO: 126087 - DNA, 697 bp, Homo sapiens
  misc_feature: GYAE6OF01E2HOT.4.38.D05.1.454.CMB.1.raw
tcagagcactgtagcacgaccggtgctcgatttagtatctgatagttgggtttgggggagtctccctcactgcccagctgggatctcagggcttcatttttctgtcctccaccatcagtgggtcaaccgccatcctcgccctcctcctggctgttctccaaggagtctgtgccgaggtgcagcgtggtgcagtcgtggagcgaaggaggtaagaaaaacggcccggggtagtcctcgtagaagtacttccgtccgttagggttaacgggttcgtaggaacttactagttcgtttaacggaccttagtggacgttcgggcgtggggtcgccggaccggtagggtaccggacccggggaaacggtccgtagggaacgtggtaggtaggggactcgtattacttacgtccgtagagttcggactcgtagaactacgaagtactacgtacgtcccgtcgtacggacgtccgccgtctaccttcgcgacgaccgtaacgaacgtcactacgacgtacccgacccgtcccgtacgtcgacgtaggtcggacgtccacggtccgtagggacccgtccgtaccggacgacgcaacctagttaacttaacgttcgtacggtaacgaaaccgaaacgtagaccgacgacgtcccgtaacccgtaacccggttaagttaccgtttacgaaccggtcgggtacccgggg

SEQ ID NO: 126088 - DNA, 668 bp, Homo sapiens
  misc_feature: GYAE6OF01DSUKM.4.38.D05.1.454.CMB.1.raw
  modified_base (641)..(641): a, c, t, g, unknown or other
  misc_feature (641)..(641): n is a, c, g, or t
  modified_base (647)..(668): a, c, t, g, unknown or other
  misc_feature (647)..(668): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcggaaggccgcgtcaccttctcagccgacaagtccatcagcaccgcctacctgcaggtggagcgacgcctaggaacggccctcggacagccgacctattaattatttacgtgtagaaccgaaaaaccagtacgacacgcctacccgaaccccggttaaaggtaccttttacgaacgttacgggtcggggccgaaacggggtaacccccgttgggtaccaccgttggttccctaccctacgacccgtccctaacccgaacccggtaaccgggcccttaacggtttccccggttacccccgtttccccccggtcggtacccccacccccgttcccaccgaaacggaaccgcccgttaaccgttccgggggacgggggacccaaccgggtccggccccgggtccccgggtggggtccctacgggtcccggttagggtaccctaacgggtacccttacccgttaccctaaggtcgtcgtcgtcgacggcggcgggtcgtagggaccgtaaggcganagtgcnnnnnnnnnnnnnnnnnnnnnn

SEQ ID NO: 126089 - DNA, 713 bp, Homo sapiens
  misc_feature: GYAE6OF01A1EEH.4.38.D05.1.454.CMB.1.raw
  modified_base (616)..(616): a, c, t, g, unknown or other
  misc_feature (616)..(616): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcccggggatctacgtaaagatctccgtggtaagggttctggatacatctttaggacctagtggagtcggctggggtgcggcccgagggtcgacccgggaaagggcctaggaagtggagtggggatcgaatcgtatccgtagtacttgaccttcgtagaacgtaaccgaacgtataaccgacgttcccgttaccgttacgggaaacggccgtccggtcctaacccgtttccgtacgtaacgtacccgaactaaacgtaccctaactccgtaacgaccgtacccgtccgtaccctagccgtaggtcggacgcgacgccgtacggaaccggtccgtaccggtacgaccggaccaccgtaagttaacgttacttaacggtagtaccggtaaccggtaaaaaacccgngggtaaacgcgtaaccgacccgttaaccccggtaacccccggttaaacgggttaccgtttaccgaacccggttacgggtccgggggtaaaccccggg

SEQ ID NO: 126090 - DNA, 856 bp, Homo sapiens
  misc_feature: GYAE6OF01ED4OZ.4.38.D05.1.454.CMB.1.raw
  modified_base (239)..(239): a, c, t, g, unknown or other
  misc_feature (239)..(239): n is a, c, g, or t
  modified_base (789)..(789): a, c, t, g, unknown or other
  misc_feature (789)..(789): n is a, c, g, or t
tcagagcactgtagcacgaccggtgctcgatttagtatctgataggttggggtttgggggagtctccctcactgcccagcgtgggatctcgagggtcttctattttctcgtccctccaccattcagtggggtaccaaccgccactccctccgcccctcctccgtggtcttcgttcctaccgaaggtcgttcgtgtcggccggtaggtcgacgtagtcgtgggtcgacgtacggttcggngggacggacgaagggtaagggtaaacggaaaaccggggtcccggggtattccgtagtagaacgtcttccgttacggttaggttaacggttcgtagatactactttacgtaacgaccttaggaggtacgtccgggtggtcgggtacgccggtacggtacggggcccgggaaccgggtaagtccggtaaggtagtcgggaggtagacctacgttactacttaacgtcgtagtaacgtcgtccgttagactaaccgaacgtagtacgttaacccgttaccgggttccttaaccgggaacccggttacccggccgttcccgttacccttaccgttcgtaaccggacccggtaaccctaacgtaaccggtacctaaaccgtacccgtaaccgtccccgtacccccgtaccgttcgacccggtacggtaacgacccgggaaccgtcccggaacggtacccgtaacgggtaaccccggtccggtaaccggggacttaaccggacccgtaattaacgttaacgttaagtacccgtacgaaaccgtaaaccggacgtanacccggattacccgaccgttaacccggtaaacgttagtaccgtacggacggtcccgggtaaaccggg

SEQ ID NO: 126091 - DNA, 882 bp, Homo sapiens
  misc_feature: GYAE6OF01EE139.4.38.D05.1.454.CMB.1.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtncagtctggtgcagtctggancgagaggtaagaaaaacggccggggatctcgtgaagatctccgtaggttaagggtttctaggaactacgtatttacgtttaacggaccttacgtggtacgttccgggtcggttcggggtacgccggtacccggtaacgggggttacccggggaaccccggggggtaaaagggtcccggtaaggggtaacgggttagggggtaacggttaggggggaacttaccgtacgttacccgtttaacgtacccgttaggtaacgttacggtaacctttacgtaacgtaaacctaacccgaaagggtaaccttaacccgttaaccgggtttccccgtttaacccggtttaccggggaaaccgggttccccggttacccggttaaccccttaaccccgttttaccgtaccgtaaccggtacccggtaaaccgtaacggttacccctaactaccggaacgaccccgtaaccccgttacccgtaccgtacgtacgaagggtaccgggaccgtaacgccggtaaccggtacgggaacccggtcccggtaccggtaacgccgaacggtaccttaagttaaccgtttaacgttacgtacggtaacggaaacccgaaaacgttcgtaacgcctaccgaacccttaaccggtaacccggttaacgtaccgtttacggaaccgttacgggtacccgggg

SEQ ID NO: 126092 - DNA, 849 bp, Homo sapiens
  misc_feature: GYAE6OF01C8WS8.4.38.D05.1.454.CMB.1.raw
tcagagcactgtagcacgaccggtgctcgatttagtatctgatagttggggtttgggagagctgctcagttaggaccagaggaaccataggaacccagcgcagcttctcttcctcctgctactctggctcccagactaccgaaccggagtaaattgtgttgacgcagtctccgaggcctacccttgttcttttcgtacctaccggaaggggaaacgcgcccacccttctcccgtagaccgaagggcctacgtcgaaggtacgttgtacgcagcacgtaccttaacgttaccgtacggtaaccagacaacggaaaccgtcggacccgacggccctaacccgtacggtccctccgactacttcgttaagtcgggtacaccgtacgttacccgaggaccggtaccgggtaaccctacgtcggacctaaccgtacccgaaggtaaccgttggttaccgaaggtcggaggttacggttcgggacgtacggaactagtacccgttcctacgttaccctaccgtaccttaagaccgtaacgtacgacggtaacgtacggacgtaacgttaaggtaaacgttttaggtttacgtaaccgtttaagttaacgtttttaccgttaacgtttacggtaacgtcggttaacgttagggtttacgggttacgttaaccggtcccgttaacccggtaaccggttacggggttaaacccggtaaacccggtaaaacgggggaccgttaaaacggggttaaaccgaaaaacgtaaccccggttaaaaggtaccgggttaacgttacgggttacccgtaccggtaaacccgttcccgtttaaacggtcccgttttacgttaccccg

SEQ ID NO: 126093 - DNA, 565 bp, Homo sapiens
  misc_feature: GYAE6OF01BRWH5.4.38.D05.1.454.CMB.1.raw
  modified_base (202)..(202): a, c, t, g, unknown or other
  misc_feature (202)..(202): n is a, c, g, or t
  modified_base (256)..(256): a, c, t, g, unknown or other
  misc_feature (256)..(256): n is a, c, g, or t
  modified_base (307)..(307): a, c, t, g, unknown or other
  misc_feature (307)..(307): n is a, c, g, or t
  modified_base (387)..(387): a, c, t, g, unknown or other
  misc_feature (387)..(387): n is a, c, g, or t
  modified_base (416)..(416): a, c, t, g, unknown or other
  misc_feature (416)..(416): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgcccaccctctcctgcagggccagtcagagtgttagcagcagctacttaaccnggtaccagcagaacctggccaggcctcccgaggcctcctcatctagtggtncatccgagcgagggccagtggcactcccagcgtaggttcagtcgcgaggtcgggtctgggacagtacttcactctcactntcagcagtacgtggactcgtagtaagttntttgacgtagttgttaacttcgtgtacgagtctaggttggtaggtacgtcgtaccgtaccgtacggttaccggaccgtaacggacgtaagggtagaaactacgaaaccgtacgtggtacgtcgtacgacctacgtcttcgtcgttaccc

SEQ ID NO: 126094 - DNA, 897 bp, Homo sapiens
  misc_feature: GYAE6OF01C06E6.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgcccctcctcctggctgttctccaaggagtctgtgccgaggtgcagcgtggtgcagtctggagcaggaggtagaaaaacggccggggagtctcgtagaagatcctccgtaggttaagggttctaggtactactaagtttcgtttaacggtaaccttagtcgggaactcgggtcgtggggtcgaccgaccggtagggtccgggaaccccgggggaaaggtccgtagggtaagtgggtaggttggggaactctaagttctaacgttccgtagtatcggtaccttgtacgtaactaaccgagtaactaacgtccggtcccgttaccggtacggaacggcccgtacgttacctacccgtttcgaccgaaccggtcccgtaaaccgtaaccggtaccctaacgtaccgaaccggtaaccccgtaccccgtaccccgttaccgtaacgggaccgtaacggggttacgggaaccgtacccgtaaccgggtaccccggtaaaggggaacccggggtacccccggtaaccggggtacccggacccgggtaaccccgttaaccccgtaagttttaaaccgtttaacccggttttaaccggaacgggttaaacccggaaaaacccgggtaaaaaacccttaaggggtaaccggtacccctaaacccgggttacccccctaaaccccgggttaaaaccccccgggttttaaaaggtttacccgttttaaaccggggaaaccccggttacccgggggttaaaccccgggggggg

SEQ ID NO: 126095 - DNA, 886 bp, Homo sapiens
  misc_feature: GYAE6OF01DRVQQ.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctgctgttctccaaggagtctgtgccgaggtgcagctggtgcagtctggagcagaggtagaaaaacggcccggggtagtctacgtagaagactccgttccgtagggttaagggttctcggtattaactaacgtttcgtttaaacggtaacccttacgtagggtaacgttcgggtcgttggggtacggcgcccggtacggggtccggacccgggggaaacggtccgtagggtaaggtgggaaggtagggggactacgtacttacctaagttcccgtagtactcgtaccgttcgtaggtaactaaccgtaacgtaacgtaccgtaaccggttcccggttacccgtttaaccggggaaccgggtccccggttaccccgttacccgtttaacccgttttacccgtaccgtaacccggtaccccggaaaccgttaaaccgtacccgtaacttaaccgaacccggtacccgtaacccccggtaccccgtttaaccgtacccgggtacggtaacgggttccggaaccgttaccggaacccgggtaacccggttaaccgggaaccgggtaccccggtaaccgggaaccgaaccgggtccctaacccgtaagtttacgttaaaccgtttcggtaaacggttaccgaaaaccgtaaaacccgtaaggtaaccgaccgaccgtaacccgttaccccggtaaaccggttaacggttaccgtttaaccgaacccggttcgggtaaccccggggg

SEQ ID NO: 126096 - DNA, 683 bp, Homo sapiens
  misc_feature: GYAE6OF01B8UYS.4.38.D05.1.454.CMB.1.raw
  modified_base (191)..(191): a, c, t, g, unknown or other
  misc_feature (191)..(191): n is a, c, g, or t
  modified_base (632)..(632): a, c, t, g, unknown or other
  misc_feature (632)..(632): n is a, c, g, or t
  modified_base (640)..(640): a, c, t, g, unknown or other
  misc_feature (640)..(640): n is a, c, g, or t
  modified_base (644)..(644): a, c, t, g, unknown or other
  misc_feature (644)..(644): n is a, c, g, or t
  modified_base (647)..(647): a, c, t, g, unknown or other
  misc_feature (647)..(647): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(655): a, c, t, g, unknown or other
  misc_feature (654)..(655): n is a, c, g, or t
  modified_base (664)..(664): a, c, t, g, unknown or other
  misc_feature (664)..(664): n is a, c, g, or t
  modified_base (669)..(670): a, c, t, g, unknown or other
  misc_feature (669)..(670): n is a, c, g, or t
  modified_base (672)..(672): a, c, t, g, unknown or other
  misc_feature (672)..(672): n is a, c, g, or t
  modified_base (675)..(675): a, c, t, g, unknown or other
  misc_feature (675)..(675): n is a, c, g, or t
  modified_base (678)..(678): a, c, t, g, unknown or other
  misc_feature (678)..(678): n is a, c, g, or t
  modified_base (680)..(681): a, c, t, g, unknown or other
  misc_feature (680)..(681): n is a, c, g, or t
  modified_base (683)..(683): a, c, t, g, unknown or other
  misc_feature (683)..(683): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaacggccgcgtcaccttctcacgccgacaagtccatcagcaccgcctacctgcagtgganccagcctggaacgcctcggacagccgacctattagtactttaacgtgtacgaaccgaaaaaccgagtagacgagccgttaccgaaccccgtaaggtacctttacgtacgtaccgtcggggaccgaacgggtaacccctggtacacgttactcctacctcacgtccctaccaccggaaccgggtcccacggttccggttcccgttcccccgtacggtcccaaccccttcccgttaaccgaacgaccgtcccgtaacccgtcgtaccgggggtacaccgacggcccgggtccgtcgggtaccgttcgggtacccgtcgggtactaaccgggtaaccttaacccgtttaccccgacgtaacgggttcccgtacgttaccggtcgggtaaccgggtcccgggtacgttccgggaaccggtacgggcgtacccgtaaggacgcgancgagtccngtcncgnctncncnngtcgtctancgcgnngntcncancnngn

SEQ ID NO: 126097 - DNA, 819 bp, Homo sapiens
  misc_feature: GYAE6OF01ER01K.4.38.D05.1.454.CMB.1.raw
  modified_base (164)..(164): a, c, t, g, unknown or other
  misc_feature (164)..(164): n is a, c, g, or t
  modified_base (191)..(191): a, c, t, g, unknown or other
  misc_feature (191)..(191): n is a, c, g, or t
  modified_base (634)..(634): a, c, t, g, unknown or other
  misc_feature (634)..(634): n is a, c, g, or t
tcagagcactgtagcacgaccggtgctcgatttagtatctgataggttgggtttgggggagtctccctcactgcccagctgggatctcgagggcttctattttctgtcctccaccatcagtgggtcaaccgcatcctcgccctctcgtggctgttctcgaaggngtctgtcgccgtaggtgcagcgtggtnctacggtcgtggacgcgaaggtaaggtaacggaaaaccgggtcccggggtattaccgtacgtaggaaacgtcttaccgttaccggttaagggttaacggttcgtaggtaacttactacgtttacgttaaccgtaccgttacggtagggtaccgttcgggtcggttcgggtcggtacccggaccggttacgggggtacccggggtaaacccgggggaaacggtccggttaaggggtaacggtggggtaacgggtcgggtaacttacgtaacgttaccgttacgtaccggtagtacgtacgtacgttacgtacgtaaacgtaccgtaaggtaccttaccggtacgttcccggttacgttacgggaccgtccggtcttaccgtacttacgccgaaccgtaccacgtactaccgataccgacctacccgtacccgttaccgtacggngtaccgtaagtcgggaacttcggaccgttacggtaacggcccggtacgtacggccacggtcctaagttactacgtttacgacgttacgaaaccggtaaccgtaacgttaggccgtaactaccggtacccgttaacccgggtaaccgtttaagtaccggtacggttaccggtacggtaacccgggg

SEQ ID NO: 126098 - DNA, 894 bp, Homo sapiens
  misc_feature: GYAE6OF01EVC7J.4.38.D05.1.454.CMB.1.raw
  modified_base (95)..(95): a, c, t, g, unknown or other
  misc_feature (95)..(95): n is a, c, g, or t
  modified_base (102)..(102): a, c, t, g, unknown or other
  misc_feature (102)..(102): n is a, c, g, or t
  modified_base (159)..(159): a, c, t, g, unknown or other
  misc_feature (159)..(159): n is a, c, g, or t
tcagagcactgtagcacgaccggtgctcgatttagtatctgatagttgggtttgggggagtctccctcactgcccagctgggatctcagggcttnattttcngtcctccaccatcagtggggtcaaccgccatcctcgccctcctctgctgtctcaggntctgtgcgaggtgcagcgtggtgctaggtcgtggacgacgaggtaacgggtaacggaaaaacggggcccggggtaacgttccgtcgttacggaaagtacttccgtaccgttagggttaacgggtttccgtaggtaacttacgttaacgtttaccgtttaaccggtaaccgttacggtacgggtacgtaccggggttcggttacggggtccgacccgggtaccggtaacggggtaccccgggggtaaaccgggggtaaaaccgggttcgggtaacggggtaaaggttcggggttaacgggttaaccggggggtaacttaccgttacgtttacccgttaacgttcccgttaaaggtacgttacggtacctttacgtagtaaccttacggaacgttactaaccggttccgttacccgttacggtaccggtaacggtcccgtaccgttcgtacccttcgacgtaaccgtacgaaccctacgtacctagtacctaccggacccgtacccgtaccctacggtcgacggtacggacgttacgaccgtaggtacccgaacgggtaacccggtccgtaaccgggtacttaccggaccgtacgtaaaccttttcggaacgtttaacccgacggtaaccggtaaaccgaaacgtaccgggtacaaccggttacccggacccgtttaacccgaaacggggtttaccgttaacccgttccggttaaccgggacgggtaaaccccgggg

SEQ ID NO: 126099 - DNA, 862 bp, Homo sapiens
  misc_feature: GYAE6OF01CUL2E.4.38.D05.1.454.CMB.1.raw
  modified_base (396)..(396): a, c, t, g, unknown or other
  misc_feature (396)..(396): n is a, c, g, or t
tcagagcactgtagcacgaccggtgctcgatttagtatctgatagttgggttgggggagtctccctcactcgcccagcgtgggatctcgaggtcttctattttctgtccctccaccactcagtcggggtcaaccgccatccctcgcccctcctcctggcttcgttcctaccgaaggtagtccgtgtcggccggaggtcgcgagcgttggtgccgtagtcgtggagcgaaggaaggtaacggaaaaaccgggcccggggtaagtcctacgtagaagtcgtccgttccgttaggttaacggttgtacgtactaagtcgttaccgttaaggaccgttacgtaggtgtcggtgtgggtcgaccgcggaggaccgggaacgggaacgtacggtaggtaagngggtaggtcgggtactactagttactcgtactgtaacgtacgtaccgttacgtacgtaaccgtaacgaacgtacgtaacgtccggttacccgttaccgtacgggaccggtacccgtccgttacccgtaccttccgacccgtaacgacccgtaaccgtaacgtacccgtaacgttccgaacccgtaccccgtaccccgttaccgtacccgtaggtacccgtagggtaccgttacgacccggacgtaccggtaaacccgggccggttaacccccggagggttacccaccgggttaaacctacttaagtttaaaccgttacggttccgtaaccgggttaaacgtaaaacccggtaaacgtacgggtaaaccgtcgtaaacccggtaccccctttaaacccgggtaaccccggtttaacgtttaaaccgttaccgggttacccggtaaaccccgggggttaaaccccggg

SEQ ID NO: 126100 - DNA, 660 bp, Homo sapiens
  misc_feature: GYAE6OF01A6TTK.4.38.D05.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (640)..(640): a, c, t, g, unknown or other
  misc_feature (640)..(640): n is a, c, g, or t
tcagagcactgtagcacgaccggtgctcgatttagtatctgatagttgggtttgggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgcccaccctctcctgcagggccagtcagagtgttagcagcagcttaacttaaccgtggtaccagcaacgaaaccgtggccaggccncccgaggcctcctcatctagtggtgcatccgagcgacggccacgtcggcactcccgagacgtacggttcgagtggcgtaggtcgggtacgtgggactacgacttcgactcgtacactgtacacgctacgacgtcggacgtacgtagaagttcgttttacgacgtagtttacgttacgtttacgttgtaccgaggtcctaaggggttcggttacgggtacgtaccgttaccggtaacccgggttacgggttaccgggaaccggtaaacggggtaccgtaaaggggtaaccggtaaaactaccgggaaaacggtacggttacggtacgggtaccttccgaccttaacccgtntttcccggttgtttaccccg

SEQ ID NO: 126101 - DNA, 785 bp, Homo sapiens
  misc_feature: GYAE6OF01A1HNS.4.38.D05.1.454.CMB.1.raw
tcagagcactgtagcacgaccggtgctcgatttagtatctgatagttggggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggagggtagaaaacggcccggggtatcgtcgtagaacgatcctaccgttaggttaacggggtttctaggtaacttacgtaacgtttaccggttttaacggtaaccttacggttagggtacgttccggggtccgtaggggttcggccggtaccggaacggggtaccgggaaccccggggggtaaaaggtccgttaagggtaagttcggggaggttagggggacttacgtaactttcgtacgttcccgttaggtagttcggtaaccttacgtagtaactaacccgagtactacgtacggttcccgtacgttacgaacggtcccgtccgttactcccttaccgtcgacggacccgaacgttaaccgtcccaatccgtagtaccccacccgtacccgtaccgtcggtaaccgtaggacgtacggcaccgtcgacggtaaccggtcccggtacggacctcgcccgtaactattaaccgttagtcgttacgaaccgggtaaccgtaaacgtgaacgcccgaaacgtcccgaaaccccggtttaacccggtaaggtttccccttaaggtacccggttagggtaaccccgggg

SEQ ID NO: 126102 - DNA, 656 bp, Homo sapiens
  misc_feature: GYAE6OF01A5UZR.4.38.D05.1.454.CMB.1.raw
  modified_base (471)..(471): a, c, t, g, unknown or other
  misc_feature (471)..(471): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcacctgtctttgtctccgaggggaaagacgcccaccctctccgtgcgaggccagtcagagtgttagcagcagctacttaacgtggtaccagacaacgaaccgtggaccgacgcctcccgaggcctcctcattcgtagtgtgccagtccgagcgacgggccacgtcggcacgtacccgaagacgtaggttacgaggtcggacgtagggttcgggtacgtcggaactacgacctttcgacctcctaccgaacctcgtacacggatacggtagttacggactaccgtagtaagttgtttnacgttattacgttacttacgtgtactaggacgttaggttcggtacgttacgtccgttaaccggtaccggttacggttaccgggaaccggaaagggttaccggaaagggttaggtaaaaccgtacggtaaaacggtcggttacggtcggacctagaacccgttacgtacgttccgttcgttacccg

SEQ ID NO: 126103 - DNA, 256 bp, Homo sapiens
  misc_feature: GYAE6OF01E5HUT.4.38.D05.1.454.CMB.1.raw
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (190)..(190): a, c, t, g, unknown or other
  misc_feature (190)..(190): n is a, c, g, or t
  modified_base (217)..(256): a, c, t, g, unknown or other
  misc_feature (217)..(256): n is a, c, g, or t
tcagagcactgtagcacgaccggtgctcgatttagtatctgatagttgggtttgggcggtgctcgatttagtatctgataggttgggtttgggggaagaggaagactgaccggtccccccaggagttcaggtgctgggcacagcggcctgggctgcctggtacaaggacctactccctangtnctcgtgnggcgggctgggacaaggtcgacatagnnnnnnnnnnnnnnnnnnnnnnnnnnnnnnnnnnnnnnnn

SEQ ID NO: 126104 - DNA, 760 bp, Homo sapiens
  misc_feature: GYAE6OF01DZOT7.4.38.D05.1.454.CMB.1.raw
  modified_base (206)..(206): a, c, t, g, unknown or other
  misc_feature (206)..(206): n is a, c, g, or t
  modified_base (314)..(314): a, c, t, g, unknown or other
  misc_feature (314)..(314): n is a, c, g, or t
  modified_base (596)..(596): a, c, t, g, unknown or other
  misc_feature (596)..(596): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccacggagaaattgtgttgacgcagtctccaggctaccctgttctttcgtctaccgaaggggaaanacggcccaccccgtctcccgtgccgacggggcctagtccgaaggtagttggttacgcagcgaacgtacttaactttaaccgtcggtaaccacgacaacggtaaaccgnggtaccgacggcctacccgtacggtcccttcctacgtacttcgttacgtgggtacgactacgtaccggacggtccggacgggtacccacgttcggacctaacctcccgaaggtaccgttacggtcgtacgggtggaacgtgggttcggggtacgtcggtaacacgttacttaccgaccgttcctaaccgacctaagccgtaacgacgtaacgtacggtcggtaggtaccgtaagttaaggtttacttttggacgttacggtttacgtactttaccggttaancgtagtacgttacggtagggttacgggtacgttacccgtaaccggtacccggggttacggttacccgggaaccggtaacgggaacccgttaaggggtaaacgtaacgtaaccgaaacggtcgttggaccgtcgtacaaccgttacctacggttccttgttaccc

SEQ ID NO: 126105 - DNA, 773 bp, Homo sapiens
  misc_feature: GYAE6OF01C53VF.4.38.D05.1.454.CMB.1.raw
  modified_base (325)..(325): a, c, t, g, unknown or other
  misc_feature (325)..(325): n is a, c, g, or t
tcagagcactgtagcacgaccggtgctcgatttagtatctgatagttgggtttggggagagctgctcagttaggacccagagggaaccatcggaaaccccagcgcagcttctcttcctcctgctactctggctcccagactaccaccggagaaattgtgttgacgcagtctccaggccaccctgtctttgtctccgaaggggaaagacgcctaccctctcctgcgaggccagtcagtagtgtagcagcagacttacttaaccgtggtaccagacaacgaaaccgtggaccgaggcctcccgaggcctccactatactagtggtcncacgtccgagcgcgggaccacgtcggaccacgtcccaaggaccgtaggttacgacggtggacgtagggtcgggtacgtacgggaactacggtaccttccgaccttccgtaccctacctaacgtaccgaacgtaaccgaacggtaccgtacgggtaaccgtaccggttaaggttaaccgtttagttttacgggtaccgttaggtttacgtttaacgtttacgtccgggttaacgacggttacgtaacggggttcgtttacgggggttaaccaccggttacccggtaacccgggttaccgggtttaacccgggaaacccgggtaaacggggtaaacccggtaaggggttaaacgggtaaaaccgttaaacccggtaaaaaccgggtaacggttaccggtacgggaccgttaccgggaacctaacccgtaccttacggttccgtttaaccc

SEQ ID NO: 126106 - DNA, 725 bp, Homo sapiens
  misc_feature: GYAE6OF01A4Z8K.4.38.D05.1.454.CMB.1.raw
  modified_base (713)..(713): a, c, t, g, unknown or other
  misc_feature (713)..(713): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggccaccctgtctttgtcctccgaggggaaagcgcccaccctctccgtcgcgacggggccagtcgagtagtcgtagcacgcacgctaacgttaaccgtggtaccagcctaagaaccctggacccgaggtcctacccgaggtccttccctacgtacttccgttaggtcggtacgcctacgtcccgtaggaccgacggggtaccctacggtggacccgaccttaccccgaagtaaccggtagggttaccacggtcgggacgtagggtttcgggtacgtacggggaactacggtaccttaccgaccgttcctaccgaccctaacgtaccgaacggaccgtacggtaaccgtcggtaaccggtaccgttaggtaaacgttcgttttacgcgttaagtttacgttaacttcgttacgtccgtaggtacgttagggtacgttacggggtacaccgttaacccggaccggtaccggttacccgggaaccgtaacgggaaccgtaggtaacggaaacttacgaacgtcgtgtacggctacgactacctntccgtcgttacc

SEQ ID NO: 126107 - DNA, 757 bp, Homo sapiens
  misc_feature: GYAE6OF01BMT59.4.38.D05.1.454.CMB.1.raw
  modified_base (295)..(295): a, c, t, g, unknown or other
  misc_feature (295)..(295): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtcctttcgaaggccgcgtcaccttctcagccgacaagtccatcagcaccgcctacctgcagtggagcacgctgagcctcggacagcgcatatattactgtgaacgaaaacagtagacagcctaccgacccggtaagtacttgacgtacgtgggaccgacggacctggtacncgtcgtctctcacgtacctaccgaccgaacggccctacgttaccggttcccttaccccgtcggacccctacccctcccgtaaccgtaaacgaccgtaccgtaaccccgttacggtccggggggaccaaccggaccggtaccccggggtacccgtccggggtccgtaccggtaccccggttacgggttaacccgtaaaccggggtacccctttaacccgtttacccccgttaacggtaccggtaccggttacccttaccggtttaacggggacgggtacccgggggtaccttaacccgggggaccggttaaacccggggaccggtaacccttaagggtaacgtacgcgtaccgtacgtacggtaccgtacgacggacgtacgtacggtacgtacggtacgtacgtacgtaccgtagtacgtaccgtacgtacgtacgtacggtacgtagacgtcgtacgtacg

SEQ ID NO: 126108 - DNA, 729 bp, Homo sapiens
  misc_feature: GYAE6OF01BJYTG.4.38.D05.1.454.CMB.1.raw
  modified_base (186)..(186): a, c, t, g, unknown or other
  misc_feature (186)..(186): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (356)..(356): a, c, t, g, unknown or other
  misc_feature (356)..(356): n is a, c, g, or t
  modified_base (394)..(394): a, c, t, g, unknown or other
  misc_feature (394)..(394): n is a, c, g, or t
tcagagcactgtagcacgaccggtgctcgatttagtatctgatagttgggtttggggagagctgctcagttaggacccagagggaaccatggaaaccccagcgcagcttctcttccgtcctgctactctggctcccagataccgacggagtaaattgtgttgacgcagtctccaggccacccgttnttcgttcgccagggaagacgccaccctcctctcgcgacggccgnaccgagaggtgttacgtanacgnacgtccttaacgttaacccttaacggtacctaagaccgacgtaaaccggaccgtccgacggactcccgacggtctccttaccacttactagtggtacgctacnccgtacgacgtaacgggccacgtggccacgacctacgngtacggtacgcgtaggcgagtccgggtagtcggtaacacgggtacttccgactaccgtccaaccgtacgtcgaacgtcgaaccgtaggtccgaaggtacgtaccggttaagttaaagttccgttagtaacggttattacgttacgttaagtccaggtacgagttacggtaggtccggtaactccgggttaccgtaacccgggttgaccccggggtaaaccgtaacgggtaaacggtaaacgggttaaccggaaaccggttaaaccgggaaccggttggaccccgttaggcgttaaacccgaccgtccggtttaaccttggtttacccgtacccgg

SEQ ID NO: 126109 - DNA, 704 bp, Homo sapiens
  misc_feature: GYAE6OF01BWAIH.4.38.D05.1.454.CMB.1.raw
tcagagcactgtagcacgaccggtgctcgatttagtatctgataggttggggtttgggggagagctgctcagttaggacccagagggaaccatcggaaaccccagcgcagcttctcttcctcctgctactctggctccagactaccgaccggagaattgtgttgacgcagtctcaggcaccctgtctttgtctcgagggaacgcgcccacctctcctcgcgacggccaggtcaggagtgtacgcagcagtctaccttaacgtcggtaccagacaacgaaccgtcggacccgaacggcctacccgaaggtcccttccccgtactacttacgtagttcgggtcgacctacgtcgacggtccggacgggccctaacggtcggacctacctacccgaaggtactacggtttcgaggtcgggtacgtaaggggtcgggtcgtacgggaactcgtacctttcgacgtaccgtactacccattccgacgacgacggtaacgtcggacgtacgtaaggtagttagttttacggagttacgttacgttaacttcgttggtactcggtagtaggttcggttacggtacgtcgtacccggtaccggtaccggtaccgggaccgggtaaacggaccggtaacggtaacggtaaaccgtaacggaaacggtcgtacgggtacgtacggtacgacctaaccgtcttcgtccggttacc

SEQ ID NO: 126110 - DNA, 703 bp, Homo sapiens
  misc_feature: GYAE6OF01CWM5O.4.38.D05.1.454.CMB.1.raw
  modified_base (669)..(669): a, c, t, g, unknown or other
  misc_feature (669)..(669): n is a, c, g, or t
  modified_base (675)..(703): a, c, t, g, unknown or other
  misc_feature (675)..(703): n is a, c, g, or t
tcagagcactgtagcacgaccggtgctcgatttagtatctgatagttgggtttaggtgcccgggaaaggcctggaatggatggggatcatctatcctgatgactctgataccagatacagtcccgtccttcggaaggccgcgtcaccttctcacgccgacaagtccatcagccacccgcctacctgcaggtggagccagccgtaggaacggcccgtaccggacacggccgaccaagttaacttacttaccgtaggtacggaaccgtaaaaacccgaggtaacgccgaacggtccttaccccgaacccccgggttaaagttaccgttttacggaaccgttaccgggtcgggggtacccgaacggggtaccccgttcgggtcctaccttcggttcccgtccctccgacgtacccccgtacccgaaacccggaaccggggccccttaacggttcccccgggttccccgtttcccccgtacggtcccctaccccgtccctaccgaacgacgaccctaccggtacgggcgggacctaccggcggtcccggccgtcgggcctcggccggttacggtaccgaacggtacccttaccccgttacccgtaacgcggttacccgttcctacggtacgggtaccgggcgggtcccgtaggggaccggtaacgggccaagnaggtcnnnnnnnnnnnnnnnnnnnnnnnnnnnnn

SEQ ID NO: 126111 - DNA, 217 bp, Homo sapiens
  misc_feature: GYAE6OF01ASD2N.4.38.D05.1.454.CMB.1.raw
  modified_base (211)..(217): a, c, t, g, unknown or other
  misc_feature (211)..(217): n is a, c, g, or t
tcagagcactgtagcacgaccggtgctcgatttagtatctgatagttgggtttgggcggtgctcgatttagtatctgatagttgggttgggggaagaggaagactgaccggtcccccaggagttcaggtgctgggcacagcggccctgggctgcctggtcaaggactacttcccctacagtcgctcgtgagcgggctggcaaggcgcatgnnnnnnn

SEQ ID NO: 126112 - DNA, 770 bp, Homo sapiens
  misc_feature: GYAE6OF01BRUTD.4.38.D05.1.454.CMB.1.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
tcagagcactgtagcacgaccggtgctcgatttagtatctgataggttggggtttgggggagagctgctcaggttacggacccaggagggaaccagtacggaaaccccagcgcagcttctcttcctcctgctactctcggctccagactaccgacggagtaattgtgtgacgcagtctaccacggcctaccttgttctttcgtaccgtaccggaaggggaaacnccgtccctacctctccgngcgacggcctagtcgagtagtgtagacagcacgtacttacgttacgacgtacacgacgaacgtaaccgcggaccgtacgcctaccgacgtcctacctacaactcgttacgtcggtacgacctacgtccggacgaccggacggcctacgccggactaccgtaccgacgtaacggttacggtacggagggtcggtacggtacgggttcgggtaccgtagggtaaccgtacggttcctaccgtaaccttaccggaacctaacggtaccgtaccgaggaaccggttactacgggacggttaacctacgttaaggaacgtttttcgtaacggacgttaagtttacgtactttacggagtaacggtggtacgttttaccggtaggggtacgttaccctaccgggttaacccggtcccgggtaacggttacggaaaaccggggtacgtaaacggttaagggtaactaaaacgtaacccgggaggttcgtacgggacctacggttacccgactagttaacgttcgtttaacctcgg

SEQ ID NO: 126113 - DNA, 922 bp, Homo sapiens
  misc_feature: GYAE6OF01D1VDN.4.38.D05.1.454.CMB.1.raw
  modified_base (176)..(176): a, c, t, g, unknown or other
  misc_feature (176)..(176): n is a, c, g, or t
tcagagcactgtagcacgaccggtgctcgatttagtatctgatagttgggtttgggggagtctccctcactgcccagctgggatctcagggcttctatttttctgtcctccaccatcagtggggtcaaccgcatcctcgccctcctctggctgttctcaggagtctgtgcgaggtncgagctggtgcgagtcgtggagcgaaggagggtaacggaaaaacgggcccggggtaagtctcgagaacgtacttcctaccgttaggttaagggttcgtaggactacttacttcgtttaacgaccgttacgtgacgtcggtgtgggtcgcgccgtagggtccggaccgggaacggccgtaggacgtacgggaggtacgggtactacgtacttccgttagttcccgtagtacgttacgtaccttcgtaacgtacgtaaccgaagtaccgttaaccggtaccggttccgttaccggttaaccgggaccgggtacccgtcccgttaccgttacccgtttactaccggtaacccggaaccggtaacccgtaaccggttacctaacgtacccgaaccggtaccccgtaacccccggttccccgttaaccggttacgggaaccgttacggggtaaccgggtaacccgtaccccgggtaacgggttaccccggtaaaccggggtaaccccggttacccgggaacccggggtaacggttaaccccgggaccgttaaaccccgtttaatttaacccggtttaaccggtttaaaccgggttccggttaaaacccgggaaaacccgttaaaaccgtcggggtaaacccgtcccgggttacccgtaacccgggtttaaaccccccggtaaacccgggtttaaacggttttacccgtttaaccgggtaacccgggttaacccgggggttaacccgggggg

SEQ ID NO: 126114 - DNA, 771 bp, Homo sapiens
  misc_feature: GYAE6OF01D77NE.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaggcccggggagtctctgaagatcctcctggttaaggttctggaatacgtattacgttaggaccttacgtggagttcggcgtggggtcgcggccgtagggtcggacccggggaaaggccgttagggaagttgggaggtaggggtataccgtaagtaccttacggttcctaggacgtacggtaacctcgtacggtaaactaccgaaggttaactaacccgtaaccggtttcccggtttaccgtaccgggtaaacgggcccgtcccgttaccgtacccgtttcccggtacaaccgggtaccccgtaaacgtaaccgttacccgtaacgttaccgaacgaccccgtaacccgtaccccgttaccgtacggtccggacgggttaccgggaacgtccgaaccgtcccgggtaaccggaacgggtccccgtacgggacctaccggaccgacccttaagtagtttaacttacgttacgacgtaaaccgaaaccgtagacgacgtaccgtaacctacccggttaaccccggtaagtacgtttacggaaccgttacgggtaacccggggg

SEQ ID NO: 126115 - DNA, 776 bp, Homo sapiens
  misc_feature: GYAE6OF01CVA96.4.38.D05.1.454.CMB.1.raw
  modified_base (154)..(154): a, c, t, g, unknown or other
  misc_feature (154)..(154): n is a, c, g, or t
  modified_base (177)..(177): a, c, t, g, unknown or other
  misc_feature (177)..(177): n is a, c, g, or t
  modified_base (221)..(221): a, c, t, g, unknown or other
  misc_feature (221)..(221): n is a, c, g, or t
tcagagcactgtagcacgaccggtgctcgatttagtatctgatagttgggtttggggagagctgctcagttaggacccagagggaaccataggaaaccccagcgcagcttctcttcctcctgctactctggcctcccagaactacccaacgganaaattgtgttgacgctacgtccncgacgcctaccgttgttctttcgcctacgggaaagggaacaccncccgtaccctctccgacgcggtacggacctaagtacgaggtagttcgtaacgcgagactacgtaaccttaaccgttaccgaggaaccgacgtacaaaccggtaccgtacgccgacgtacctaccgacggtcctactacaagtcgttaacgtcggaccaacctcgaacgtaccggaccggaccggtaacccttagggcccgtaaccttaccgtacccggaacgtaccgggtttaggacgttaacgggtccgggcgttacggggtcggtttcgggaaaggtaaccgacctttacgtacccctaccttacggtaacccctagtacgtacggaactaccggagaaccgtgtaaccgtaacgttaaggtaacgtttagtcgtaacggtgttacgtttaagttccgtagttaccgcgttacgtagggtcgttaacggtcgtaccgtaaccggtacgtaccggtacgggaacgaaccgggttagtaaggtaaaccggtaactaaaccgtaaggtcgtaacggtccgtaacgtccgtaaacacgttacctcgttcgttaaccg

SEQ ID NO: 126116 - DNA, 653 bp, Homo sapiens
  misc_feature: GYAE6OF01AS65L.4.38.D05.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (625)..(625): a, c, t, g, unknown or other
  misc_feature (625)..(625): n is a, c, g, or t
  modified_base (629)..(633): a, c, t, g, unknown or other
  misc_feature (629)..(633): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (641)..(642): a, c, t, g, unknown or other
  misc_feature (641)..(642): n is a, c, g, or t
  modified_base (644)..(645): a, c, t, g, unknown or other
  misc_feature (644)..(645): n is a, c, g, or t
  modified_base (648)..(648): a, c, t, g, unknown or other
  misc_feature (648)..(648): n is a, c, g, or t
  modified_base (651)..(653): a, c, t, g, unknown or other
  misc_feature (651)..(653): n is a, c, g, or t
tcagagcactgtagcacgaccggtgctcgatttagtatctgatagttgggtttaggtgcccgggaaggcctggaatggatggggatcatctatcctgatgactctgataccagatacacgtccgtcttacggaacggccgcgtcaccttctcagccgaacaacgtccatcagccacccgcctacctgacaggtggacncacgtcctaggaacggtcccgtacggaccagtccgacctaattaacttatttacgnggtacgaaaccggaaaaccgtaggtacgaccacggtcctacccgtaaaccccggttaaggttaaccttttacggaaccgttaccgggtacgggggaaccgaaccgggtaacccgttgggacctaacgttcgtccctacctacgccgacctacccgaacgaccggccctagttcccggtacccttccccgcgacctacccgtcctacgaacgaccgtcaccggtcggtacgggacaccgacgggcccgtcggcggccttcgaccgtaggtaccgtaacgtaccttacccgtacctacgtacgtcgtaccgtgacggtacggccgggtctacggaaccggtacggcgactaagngcgntacnagtcatcgacngcannnnncantcncnncnncanctnnn

SEQ ID NO: 126117 - DNA, 804 bp, Homo sapiens
  misc_feature: GYAE6OF01B1VNS.4.38.D05.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctccagactaccacgganaattgtgttgacgcagtctcgaggctacctgtctttgcctacgaagggaancgccacccgtctccgtgcgaggccgagttcgaggtagttacgttagactacgacgtacggtaccttaaaccgttaaccggtcggtaaccacggaccgtaacggtaaaacccgtcgggaaccctaacggggcccttaccccggaaccgggtcccttacccctacgtacttaccggtttaacggttcgggtcgtacccgtacgttacccgaacggtccgggaaccgggtacccgtacggttacgggacccgtaccgttaacccccggaagtaaccggtaacggtttacgaaccggggttggtaacccggttgggttacggggttaccggtaagggtaacccgtacggttaacccttaccgtacccgttacgtaacccgtaacctacgttaccgaaccgtacgtaacggtacgaccgtacgaccgttaagtaaacgtttcgttcgtaacgtagttacttaacgttcgttacgacgtagtcgtagggttacgtggttaccgaccgttacgaccgttacggtaccggaccggtaaaggaccgtaagggtaacgtaaacgtacggaaacgtgttacggcgttacgcgtacaacgttctacgttcgttaccc

SEQ ID NO: 126118 - DNA, 598 bp, Homo sapiens
  misc_feature: GYAE6OF01B4XXE.4.38.D05.1.454.CMB.1.raw
  modified_base (200)..(200): a, c, t, g, unknown or other
  misc_feature (200)..(200): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (423)..(423): a, c, t, g, unknown or other
  misc_feature (423)..(423): n is a, c, g, or t
  modified_base (585)..(585): a, c, t, g, unknown or other
  misc_feature (585)..(585): n is a, c, g, or t
tcagagcactgtagcacgaccggtgctcgatttagtatctgataggttggggtttggggagagctgctcagttaggacccagagggaaccatggaaaccccagcgcagcttctcttcctcctgctactctggctcccagataccaccggagaaattgtgttgacgcagtctcaggcaccctgtcttgtctccgagggaanagccaccctctcctgcagggccagtcagagttgttagcagcagctacttaacngtacancagaacctgacagctccaggcctcncatctatggtcgctatccagcacgggcacgnggacactcccagaccgtagttcgagtcggctaggtcggtcgtagggacctagtacttcgaactctaccaccatcagactagtaacgtggacgtaccgtagtaacgttntttacgacttaggttacgttaactttacgtcggttaccaagggtctagggtacggttggtaaccgtcttaaccggacgttaccggttaccggacgtaaacgggtaccgaagggtaacggtaaactacgaaaccggtgtacgtacggacgtacgactaacccngttcctgttaccc

SEQ ID NO: 126119 - DNA, 719 bp, Homo sapiens
  misc_feature: GYAE6OF01BKZYN.4.38.D05.1.454.CMB.1.raw
  modified_base (170)..(170): a, c, t, g, unknown or other
  misc_feature (170)..(170): n is a, c, g, or t
  modified_base (672)..(672): a, c, t, g, unknown or other
  misc_feature (672)..(672): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
  modified_base (697)..(697): a, c, t, g, unknown or other
  misc_feature (697)..(697): n is a, c, g, or t
  modified_base (700)..(700): a, c, t, g, unknown or other
  misc_feature (700)..(700): n is a, c, g, or t
  modified_base (703)..(703): a, c, t, g, unknown or other
  misc_feature (703)..(703): n is a, c, g, or t
  modified_base (707)..(707): a, c, t, g, unknown or other
  misc_feature (707)..(707): n is a, c, g, or t
  modified_base (710)..(710): a, c, t, g, unknown or other
  misc_feature (710)..(710): n is a, c, g, or t
  modified_base (712)..(712): a, c, t, g, unknown or other
  misc_feature (712)..(712): n is a, c, g, or t
  modified_base (714)..(716): a, c, t, g, unknown or other
  misc_feature (714)..(716): n is a, c, g, or t
  modified_base (718)..(718): a, c, t, g, unknown or other
  misc_feature (718)..(718): n is a, c, g, or t
tcagagcactgtagcacgaccggtgctcgatttagtatctgatagtttgggtttaggtgcccgggaaggcctggaatggatggggatcatctatcctgatgactctgataccagatacagtccgtccttcggaaggccgcgtcaccttctcacgccgacaacgtccaacncgacgaccacccgtacccttaccgtgacgaggtcggacgcgacgccgtaggacgccggacgacacgcgactaagtacttattacgtcgtaacggaaccgtaaaactaggacgacacgaccgtacccgtaaccggtaacggtttacgttacggtaaccgttaccggggccgggaccggaaccggttaccgtcggtaccgttacgttacttccctctacccgacgttacccgacccgaaccggtaccggaccttaccggtccgtttaccccgttccccgtacggacctaccgtaacccttccgaaccgaacgcccggtaccgtacccggtcgggtaccggggacctaccggaccgggtaccccggtccgggacggtcgttccggcgggttaacgggaaccgtttaaccggttacctttaccccgtaaccgtcggtagttccgtacggttcggacgggacgggtccggtaacggcggtaaccggcggtaccgaaggtagtacggngcgngngcncncngatcgntcncanacncgncgcncgncnannntnc

SEQ ID NO: 126120 - DNA, 220 bp, Homo sapiens
  misc_feature: GYAE6OF01A7MHT.4.38.D05.1.454.CMB.1.raw
  modified_base (210)..(220): a, c, t, g, unknown or other
  misc_feature (210)..(220): n is a, c, g, or t
tcagagcactgtagcacgaccggtgctcgatttagtatctgatagttgggtttgggcggtgctcgatttagtatctgatagttgggtttgggggaagaggaagactgacggtcccccaggagttcaggtgctgggcacagcggccctgggctgccgtggtcaaggactacttccctacagtgctctgagcgggctggcaaggcgcatagnnnnnnnnnnn

SEQ ID NO: 126121 - DNA, 621 bp, Homo sapiens
  misc_feature: GYAE6OF01D0GU8.4.38.D05.1.454.CMB.1.raw
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
  modified_base (598)..(599): a, c, t, g, unknown or other
  misc_feature (598)..(599): n is a, c, g, or t
  modified_base (601)..(606): a, c, t, g, unknown or other
  misc_feature (601)..(606): n is a, c, g, or t
  modified_base (608)..(621): a, c, t, g, unknown or other
  misc_feature (608)..(621): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcggaaggccgcgtcaccttctcagccgacaagtccatcagcacccgcctactgcagtggagcagcctggaacggcctcggacagccgaccaattatattactgtacgaaccaaaacctgtacgcagcctaccctaaccccggtaaagtactttacgactacggtcggggaccacgggtaacccctggtccacttcgtccttcccgtcgaccgtcccctacccgaaccgaaccgggtccctacgttcccggttccccttcccccgtcggcccctaccccgttcccaccgaaaccgcgcccgtacccgtcgggcgggggacctaaccggcggcccggtcccgtcgggtcgaccggtcccggtaggtacccgtaacggttacccttaccctttacccgtacgtacgttcgtccttcggtcgggacggccgggtacgtgggaccgacggcgacgtaagtgncacgncgnacgnncnnnnnngnnnnnnnnnnnnnn

SEQ ID NO: 126122 - DNA, 826 bp, Homo sapiens
  misc_feature: GYAE6OF01CEEGH.4.38.D05.1.454.CMB.1.raw
  modified_base (166)..(166): a, c, t, g, unknown or other
  misc_feature (166)..(166): n is a, c, g, or t
  modified_base (270)..(270): a, c, t, g, unknown or other
  misc_feature (270)..(270): n is a, c, g, or t
  modified_base (723)..(723): a, c, t, g, unknown or other
  misc_feature (723)..(723): n is a, c, g, or t
tcagagcactgtagcacgaccggtgctcgatttagtatctgatagttgggtttgggggagtctccctcactgcccagctgggatctcgagggcttctattttctgtcctccaccatcagtgggtcaaccgccatcctcgccctcctcctggctgttctccgaaggngtctgtgccgaggtgcagcgtggtgcgtagtcgtggagcgaggaggtaaggaaaacggccggggatctcgtagaagtacttccgtacgttaggttaacgggttntaggtaacttacgtacgttacgtttaacggaccgtagtgggacgtccgggtggtcgggtcgccgaccggtaggggtaccgggaacccggggaagccggtaggaagtggaggtgggtactacgtattcgtaacgtccgtgtaacgtcggtacctagtacggaaccttaacgaagtacgtaacggtccgttcccggttaccgttaccgggaacggtcccgtaccggttaccctaccgtttaccgaccggaccgtaaccggtaaccgtaacgtccctaaccgggttccaaccgaccccgacccggtaccctaccgtcggacggtaggtaccggaacgccgaaccggtcccgtaacgggacccggtaaccccggacgggaaccaccggtaccgtaaccctttaagtaaccgttacggttttaccgacggtaaacccggaaaaccgttaaaaccggtnaacggtaccccgaaccttacccgggtaaacccccggttaaaacccggttaggttttaaccctaacccgggttaaccggggttaaccggggtaaaccccggggg

SEQ ID NO: 126123 - DNA, 825 bp, Homo sapiens
  misc_feature: GYAE6OF01BQQZD.4.38.D05.1.454.CMB.1.raw
  modified_base (791)..(791): a, c, t, g, unknown or other
  misc_feature (791)..(791): n is a, c, g, or t
  modified_base (793)..(793): a, c, t, g, unknown or other
  misc_feature (793)..(793): n is a, c, g, or t
  modified_base (795)..(795): a, c, t, g, unknown or other
  misc_feature (795)..(795): n is a, c, g, or t
  modified_base (799)..(800): a, c, t, g, unknown or other
  misc_feature (799)..(800): n is a, c, g, or t
  modified_base (802)..(802): a, c, t, g, unknown or other
  misc_feature (802)..(802): n is a, c, g, or t
  modified_base (805)..(807): a, c, t, g, unknown or other
  misc_feature (805)..(807): n is a, c, g, or t
  modified_base (809)..(810): a, c, t, g, unknown or other
  misc_feature (809)..(810): n is a, c, g, or t
  modified_base (812)..(814): a, c, t, g, unknown or other
  misc_feature (812)..(814): n is a, c, g, or t
  modified_base (816)..(820): a, c, t, g, unknown or other
  misc_feature (816)..(820): n is a, c, g, or t
  modified_base (822)..(825): a, c, t, g, unknown or other
  misc_feature (822)..(825): n is a, c, g, or t
tcagagcactgtagcacgaccggtgctcgatttagtatctgatagttgggtttaggtggcccgggaaaggcctggaatggatggggatcatctatcctgatgactctgataccagatacagtccgtccttcgaaggccgcgtcaccttctcagccgacaacgtccatcagccaccgcctacctgcagtggagcacgctggaacgccgtcggacagcgccaatatattacgtacgtacgaaccgaaaaaccgaggtacgcacgtccgtacccgaaaccccggttaaggttaccgttttaggaacccgttaaccgggtccgggggaaccggtaacccggggaaaccccgttgggttaccctaacttccggttcccctttacccgtaacccgtaccggtacccccgtaacccgtaacccggtaaacccggggtacccccgttaaccggtttccccggtttccccccgtttcccccccggttaccgggtaccccccttaccccccgttaccccgtaaccggaaacgtaaccgtcccccgtaaccccgggttccggggtaaccggggggtacccaaacccggggtacccgggtcccccgggttccccgggggttaccggggtaaccccggtcccgggtttccccggggttaccgggttaaaacccgggttaaacccgggtaaccccttttaccccgtttaaccccgtaccggttaacgttccgggtacccgttcggttacgggaccggggtcccgggtacggtaccgggaccgacgggtacccgagtaacgtacgncncntgcnngncgnnncnngnnncnnnnnannnn

SEQ ID NO: 126124 - DNA, 826 bp, Homo sapiens
  misc_feature: GYAE6OF01DNN12.4.38.D05.1.454.CMB.1.raw
  modified_base (148)..(148): a, c, t, g, unknown or other
  misc_feature (148)..(148): n is a, c, g, or t
  modified_base (210)..(210): a, c, t, g, unknown or other
  misc_feature (210)..(210): n is a, c, g, or t
tcagagcactgtagcacgaccggtgctcgatttagtatctgatagttgggtttggggagagctgctcagttaggacccagagggaaccataggaaacccagcgcagcttctcttcctcctgctactctgctccagactaccaccgganaattgtgttgacgcagtcctccgaggcctaccctgttctttgtcctaccggaaggggaaacncgccctaccctctcctgcgacgggccctagtcaagtaggttagtacgcacggcacgtaccttaaccttaccgtaggtaccagacaacgaaccgttcggacccgacggtcctaccgacggtcctacctcgattacgtacgttggctacctactccggacggcggaccgggcctaacggtcggaccctaacgtcccgaaggtaccggttacggttacgacgggtcggacgttacgggtttcggggtaccggtacgggtaacacgttaccgttaccacgtaccctacgtacctagtccgaacgtacgacgtacggtcggtaactaccggttaggaacgttttacgtttacgacggttaacgtttcgtttaacgtttacgtacggtacgtaacggttaccggttgggtttaacgggttcgtaacccggttccggttaaccgtaccccggggttaccgggttaaacggggtaacccccggtaaagggggttaaaccgggtaaacggggttaaacggtaaaaacccgttaaaccgggtaaacccggttggggttacccggtaacgggttcccgaaccgtaacccttaaccgttttcggtaaccgttttcccggtttaacccg

SEQ ID NO: 126125 - DNA, 735 bp, Homo sapiens
  misc_feature: GYAE6OF01DFIMR.4.38.D05.1.454.CMB.1.raw
  modified_base (439)..(439): a, c, t, g, unknown or other
  misc_feature (439)..(439): n is a, c, g, or t
  modified_base (713)..(713): a, c, t, g, unknown or other
  misc_feature (713)..(713): n is a, c, g, or t
  modified_base (720)..(720): a, c, t, g, unknown or other
  misc_feature (720)..(720): n is a, c, g, or t
tcagagcactgtagcacgaccggtgctcgatttagtatctgatagttgggtttgggggagtctccctcactgcccagctgggatctcgagggtcttctattttctcgtcctccaccatcagtgggtcaaccgcatcctcgccctctcctggctgttctcaggatcgtgtgccgtaggtgcagtcgtggtagcgtagtcgtggagcgaaggaggtaacggaaaaacggtcccggggattcgtacgtagaacgtattccgttaccgtagggttaacgggttcgaggtatactagttcctttaacggaacctagtggtacgtcggtcgtagggtcgccggtaccggtagggtaccgggaaccggggaacggtcgttaggaagtcgggtaaggtaggggtactacgtaagtttacctacgtcccgtagtacgtcgtaccgttntaacggtaacttaacgattaacgtacgtaccggttccgttaccgggttacggacggcccgtcgttaccctaccgttactaccggaccgtccgtaacgtacgtaccctactaccgaccacccgtacccgtaccgtcgtccggagtacgcggtacgaccgacggtccgacgtaccggcccgtagacccgtagtacccgacttagttaccgttcgtaaactcggtaacgaaacctaacggcgtaagcctacggtaccacccggtaacggtaacgttntaccggngttacgggacccggg

SEQ ID NO: 126126 - DNA, 922 bp, Homo sapiens
  misc_feature: GYAE6OF01B690S.4.38.D05.1.454.CMB.1.raw
tcagagcactgtagcacgaccggtgctcgatttagtatctgatagttggggtttgggggagagctgctcagttaggacccaggagggaaccatcggaaaccccagcgcagtcttctcttcctcctgctactctggcctcccagactaccaccggaagtaaattgtgttcgacgcacgtcctccgacggcctacccttgtttcctttcgtccgtaccggaagggggaaacgaccgtacccctaccccttcctccgtcggacggacggggccctacggtaccgaaggtaggttacggttacgcgacggcctacgtaccctttaaccgtttaaacccggttacgggtaacccaacggaccgtaaaccggtaaaccccggtcgggacccggtaaccggtccccgtaccccggaccggtcccctttacccgtacctaacgttaccgttacggtcggttaccgacctaccgtacccgacggaccggtacccgggccgtaccgcggtaccctacctacccggaagtaacggtacggttaccgtagggtcggacggttacgggtcgggtaccggtagggacctaacggttccttaccgtaccgttacctaccgaccttacgacgtacgtacgtaacggtcgtacgggaccgttacgtaaggttacgttacgtttacgacgttacgtttacgttaacggtttacgttacggtaccgtacgttaggttacgggtttacggttaacggggtcccgtaaccgttacccgggtaacccggggttaccgggtaacccgggaaccgggtaaacggggtaaacccgggtaaacggggtttaaacgtaaacccggtaaaccgtaaaccgggttccgggttagggtaccccggttacgtaccggtaacccctacggtttaccttcggtacccgtttaccc

SEQ ID NO: 126127 - DNA, 647 bp, Homo sapiens
  misc_feature: GYAE6OF01D0N88.4.38.D05.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagtaaattgtgttgacgcagtctccaggcacctgtcttgctcaggggaangccacctctcctgcgaggccagtcagagtntagcagcagctactacngtaccagcagaactggcaggctccaggctcctcatctagtggtcgacactccgagtccgacgggcctaacgtggcctaacgtcccgaagaccgtaggttacagtggctaggttgggtactcggggaactaggtaccctttcgaaccttccgtaaccgacctacgttacgacgtacgtacggtaacgtacgggaacgtaccgttaggtaaacgttacgttttacggacgttaagttacgttaacgtttacgtacggtaccgtagtaccgtaggttggtacgggtactccgtacgtaccggtacggttaccggaaccggtaaagggacccgtaaagggtacgtaaacgtaacgtaaacggtacgtcggtacgaccgttacgacctacgtacttcgttcggttacc

SEQ ID NO: 126128 - DNA, 300 bp, Homo sapiens
  misc_feature: GYAE6OF01BKBOS.4.38.D05.1.454.CMB.1.raw
  modified_base (51)..(51): a, c, t, g, unknown or other
  misc_feature (51)..(51): n is a, c, g, or t
  modified_base (230)..(230): a, c, t, g, unknown or other
  misc_feature (230)..(230): n is a, c, g, or t
  modified_base (268)..(269): a, c, t, g, unknown or other
  misc_feature (268)..(269): n is a, c, g, or t
  modified_base (271)..(271): a, c, t, g, unknown or other
  misc_feature (271)..(271): n is a, c, g, or t
  modified_base (273)..(300): a, c, t, g, unknown or other
  misc_feature (273)..(300): n is a, c, g, or t
tcagagcactgtagcacgaccggtgctcgatttagtatctgatagtgggtntgggacagacttcactctcaccatcagcagactggagcctgaagtattttgcagtgtattactgtcagcagtgtggtagctcaccgtacgttcggaccgaaagggacaaaggtgaaaatacaaaacgactgtggctgcaccatctgtcttcacttccttcccgctatccgtgacctacngtcgactgtgacggcggcgtggacaaggcgtacaatgnngnannnnnnnnnnnnnnnnnnnnnnnnnnnn

SEQ ID NO: 126129 - DNA, 758 bp, Homo sapiens
  misc_feature: GYAE6OF01BRJGC.4.38.D05.1.454.CMB.1.raw
  modified_base (721)..(721): a, c, t, g, unknown or other
  misc_feature (721)..(721): n is a, c, g, or t
  modified_base (725)..(729): a, c, t, g, unknown or other
  misc_feature (725)..(729): n is a, c, g, or t
  modified_base (731)..(731): a, c, t, g, unknown or other
  misc_feature (731)..(731): n is a, c, g, or t
  modified_base (734)..(734): a, c, t, g, unknown or other
  misc_feature (734)..(734): n is a, c, g, or t
  modified_base (736)..(736): a, c, t, g, unknown or other
  misc_feature (736)..(736): n is a, c, g, or t
  modified_base (738)..(739): a, c, t, g, unknown or other
  misc_feature (738)..(739): n is a, c, g, or t
  modified_base (742)..(751): a, c, t, g, unknown or other
  misc_feature (742)..(751): n is a, c, g, or t
  modified_base (753)..(753): a, c, t, g, unknown or other
  misc_feature (753)..(753): n is a, c, g, or t
  modified_base (755)..(756): a, c, t, g, unknown or other
  misc_feature (755)..(756): n is a, c, g, or t
  modified_base (758)..(758): a, c, t, g, unknown or other
  misc_feature (758)..(758): n is a, c, g, or t
tcagagcactgtagcacgaccggtgctcgatttagtatctgatagttgggtttaggtgcccgggaaggcctgggaatggatggggatcatctatcctgatgactctgataccagatacacgtccgtccttacgaacgggcccgcgtcctaccttctacacgaccgaacaacgtccatcacgccacccgaccctaccgtgacgaggtggacgcgacgccgtagggaacggtcccgtacggacacggaccactattaactttattacgtacgtacggaaaccgtaaaaacgaggtacgacacgacctaacccgtacccggttaaaggtacctttacggaacgttaccggtacggggaccggtaaccgggtaacccggttgtactacttccgttcctcccgtcaccgtaccccgtaccgaaccggaacccgggtccctaccggttccccggtttcccccgtttaccccccgtcggtaccccctacccctacccgacgtaaaccggccaccccgtaccggttccggggtacggggacccaaccgggccgggtaccccgggtcccggtcggggtaccgtccggtaccggttacggggtaccgttaaacccgggttaaccctttacccctttaaccgtacggtacccggtttcgccccgttgggtaaccggggccgggtaccggggtacgtacggggaaaccgtacgggacccggagtaccgagctncgannnnngngcncncnncgnnnnnnnnnnancnngn

SEQ ID NO: 126130 - DNA, 827 bp, Homo sapiens
  misc_feature: GYAE6OF01E4U24.4.38.D05.1.454.CMB.1.raw
  modified_base (260)..(260): a, c, t, g, unknown or other
  misc_feature (260)..(260): n is a, c, g, or t
tcagagcactgtagcacgaccggtgctcgatttagtatctgatagttggggtttggggagagctgctcagttaggacccagagggaaccatggaaaccccagcgcagcttctcttcctcctgctactctggctcccagactaccacggataaattgtgttgacgcagtcctaccgacggcctacccgttgttcttttgtcctaccgaagggggaaacaccgcccaccctcgtcctggcgacgggccagtcagtagtgtancagcacgtacttaacttaccgtggtaaccagaccaacgtaacccgtggaccgacgcctacccgacggcctcctactacgttccgtaggtcggtcgtactacgttaccggacggtccgaaccgggtcccctaacggccggtaacctacccgtacccgaacggtaaccggttacgggttccgtaacgggtcgggtaacggtacggggtttccgggtcggtaacggggtaactaccggttaacccttccggtacccttaccgtacccgtaaccttacgtcccaaacgggtcccgtaagggtacgttaccgggtaaacgtcccgttttaaagggttaacttttacggtttaggacccgtttaggtacctttaagttcgttacggtacgtagtcggttaacgtgggttaccgtacccggtcttaacccgggtaccgggttaccgttaaccggggaaccgttaacggggtaaacccgtaaaggttaaccgggtaaacccttaaacggaaaccgggttcgttacgggtccctacggtacccgtacctaacctttcggttccgttgttaaccccg

SEQ ID NO: 126131 - DNA, 758 bp, Homo sapiens
  misc_feature: GYAE6OF01BAPIE.4.38.D05.1.454.CMB.1.raw
  modified_base (187)..(187): a, c, t, g, unknown or other
  misc_feature (187)..(187): n is a, c, g, or t
  modified_base (714)..(714): a, c, t, g, unknown or other
  misc_feature (714)..(714): n is a, c, g, or t
  modified_base (720)..(720): a, c, t, g, unknown or other
  misc_feature (720)..(720): n is a, c, g, or t
  modified_base (724)..(724): a, c, t, g, unknown or other
  misc_feature (724)..(724): n is a, c, g, or t
  modified_base (729)..(729): a, c, t, g, unknown or other
  misc_feature (729)..(729): n is a, c, g, or t
  modified_base (732)..(732): a, c, t, g, unknown or other
  misc_feature (732)..(732): n is a, c, g, or t
tcagagcactgtagcacgaccggtgctcgatttagtatctgatagttgggtttaggtgcccgggaaagcctgaatggatggggatcatctatcctgatgactctgataccagatacagtccgtccttgaaggccgcgtcaccttctcagccgacaagtccatcagtcaccgcctacctgccaggtgncagcctggaacggcccgtacggacgacgccgcctaattatacttaaccgtggtacgaaaccgaaaaaccgtaggtacgccgaacggcctacccgtaacccccggttaaagggtaccttttacgaaccgttaccggacggggtacccgaacggggtaaccccttcgggtcctaacgttcggttcctacccgttacgaccgtccctaaccgaacccgtaaacggggtccctaacggttccccgggtttacccttccccccgtcggtaccccaccccgttcccgtaaccgaaacggtccgtacccgtaaccccgttcgggtaccggggggccaaccggtaaccggcccgggtacccggcgggtacccgttcgggaccccggtttgggaaaccgtaaccgggttaacctttacccccgttaccggtaacggtagggttccccgtacgttaccgtagggtaccggtccggggtactcccggggtacgaacgggtcccgaatacgacgacgtgaagttccatctatcacgacncgcgcncgcncgcgnacncgcgagacgacacgagtactgtgtcg

SEQ ID NO: 126132 - DNA, 915 bp, Homo sapiens
  misc_feature: GYAE6OF01AF4XA.4.38.D05.1.454.CMB.1.raw
  modified_base (151)..(151): a, c, t, g, unknown or other
  misc_feature (151)..(151): n is a, c, g, or t
  modified_base (209)..(209): a, c, t, g, unknown or other
  misc_feature (209)..(209): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggcctccagactaccgaccgganaattgtgttgacgcagtctccgaggccaccctgttctttgtcctaccgaaagggaacncgccctaccctctccgtgccgacgggccaggtccagagttgtacgcagcagtaccttaacttaaccgtggtaaccaggacctaaacggtaaacccgtcgggacccgacggtcccttaccccggaacggtccccttaccccgtactaacgtttaccgttaggttcggttccgaaccgtaaccggttacccggaacggtaccggtaaccgggggtacccctaaccggttcgggtaacccctaacccgtacccccggtaaagggtaaaccggtttaaccgggtttaccgtaacggggtcggggtaccggtttaacggggttccggggttaccgggtaaggggtaaaccctaaccggtttacccttacccgttaccgttaccgtaaccccgaaccgttacgtacccgtaacgaccggtaacggtacccgtagggaaccgttacgtaacggttaaacgtttcggttttaacgacgttacgggttttacgtttaacgtttaccggttacgtacggtaacgttcgggtaaggggttcggttaaccggtaccgtacccggttaaccgggtaccccgggtttaacgggtaaccccgggtaaccgggtaaaccgggtaaacccggttaaaggggtaaaccgaaacgtaaccgggtaaaacggttcgtacgggtacgtacgtaccgaccttaaccgtctttaccggtctttaacccg

SEQ ID NO: 126133 - DNA, 250 bp, Homo sapiens; identical to SEQ ID NO: 125865
  misc_feature: GYAE6OF02F799H.4.38.D05.1.454.CMB.1.raw
  modified_base (249)..(250): a, c, t, g, unknown or other
  misc_feature (249)..(250): n is a, c, g, or t

SEQ ID NO: 126134 - DNA, 208 bp, Homo sapiens
  misc_feature: GYAE6OF02FXM0P.4.38.D05.1.454.CMB.1.raw
  modified_base (205)..(208): a, c, t, g, unknown or other
  misc_feature (205)..(208): n is a, c, g, or t
tcagagcactgtagcacgaccggtgctcgatttagtatctgatagttgggtttgggcggtgctcgatttagtatctgatagttgggttggggaagaggaagactgacggtccccaggagttcaggtgctgggcacagcggcctgggctgcctggtcaaggactacttccctacagtgctctgagcgggctggcaaggcgcatagnnnn

SEQ ID NO: 126135 - DNA, 250 bp, Homo sapiens
  misc_feature: GYAE6OF02GD9VS.4.38.D05.1.454.CMB.1.raw
  modified_base (248)..(250): a, c, t, g, unknown or other
  misc_feature (248)..(250): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcgaccaagggaccaaggtggaaatcaaacgaactgtggctgcaccatctgtcttcatcttccgccatctgactacagtgctctgagcgggctggcaaggcgcatagnnn

SEQ ID NO: 126136 - DNA, 206 bp, Homo sapiens
  misc_feature: GYAE6OF02G6DE6.4.38.D05.1.454.CMB.1.raw
  modified_base (206)..(206): a, c, t, g, unknown or other
  misc_feature (206)..(206): n is a, c, g, or t
tcagagcactgtagcacgaccggtgctcgatttagtatctgatagttgggtttggcggtgctcgatttagtatctgatagttgggtttggggaagaggaagactgacggtccccaggagttcaggtgctgggcacagcggccctgggctgcctggtcaaggactacttccctacagtgctctgagcgggctggcaaggcgcatagn

SEQ ID NO: 126137 - DNA, 250 bp, Homo sapiens; identical to SEQ ID NO: 125865
  misc_feature: GYAE6OF02H1IY0.4.38.D05.1.454.CMB.1.raw
  modified_base (249)..(250): a, c, t, g, unknown or other
  misc_feature (249)..(250): n is a, c, g, or t

SEQ ID NO: 126138 - DNA, 251 bp, Homo sapiens
  misc_feature: GYAE6OF02GHO34.4.38.D05.1.454.CMB.1.raw
  modified_base (249)..(251): a, c, t, g, unknown or other
  misc_feature (249)..(251): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgccatctgactacagtgctctgagcgggctggcaaggcgcatagnnn

SEQ ID NO: 126139 - DNA, 210 bp, Homo sapiens; identical to SEQ ID NO: 125860
  misc_feature: GYAE6OF02FZ4IN.4.38.D05.1.454.CMB.1.raw
  modified_base (209)..(210): a, c, t, g, unknown or other
  misc_feature (209)..(210): n is a, c, g, or t

SEQ ID NO: 126140 - DNA, 444 bp, Homo sapiens
  misc_feature: GYAE6OF02I8PA1.4.38.D05.1.454.CMB.1.raw
  modified_base (437)..(444): a, c, t, g, unknown or other
  misc_feature (437)..(444): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaagggcccatcggtcttccccctggcaccctcctccaagacgcacctctgggggcacagcggccctgggctgcctggtcaaggactacttccctacagtgctctgagcgggctggcaggcgcatagnnnnnnnn

SEQ ID NO: 126141 - DNA, 251 bp, Homo sapiens; identical to SEQ ID NO: 126138
  misc_feature: GYAE6OF02FLAS0.4.38.D05.1.454.CMB.1.raw
  modified_base (249)..(251): a, c, t, g, unknown or other
  misc_feature (249)..(251): n is a, c, g, or t

SEQ ID NO: 126142 - DNA, 498 bp, Homo sapiens
  misc_feature: GYAE6OF02H8QAG.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggagcctgaagtattttgctagtgtattactgtcagcagtgtgtagctcaccgacgttcggccgaaggaccgaaggtaggaaatacaaacgaactgtaggctgcaccatctgtc

SEQ ID NO: 126143 - DNA, 443 bp, Homo sapiens
  misc_feature: GYAE6OF02G8GGF.4.38.D05.1.454.CMB.1.raw
  modified_base (236)..(236): a, c, t, g, unknown or other
  misc_feature (236)..(236): n is a, c, g, or t
  modified_base (436)..(443): a, c, t, g, unknown or other
  misc_feature (436)..(443): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggcaccctcctccaagagcacctctgggggcacagcggccctgggctgcctggtcaaggactacttccctacagtgctctgagcgggctggcaggcgcatagnnnnnnnn

SEQ ID NO: 126144 - DNA, 251 bp, Homo sapiens; identical to SEQ ID NO: 126138
  misc_feature: GYAE6OF02FH6ZY.4.38.D05.1.454.CMB.1.raw
  modified_base (249)..(251): a, c, t, g, unknown or other
  misc_feature (249)..(251): n is a, c, g, or t

SEQ ID NO: 126145 - DNA, 210 bp, Homo sapiens; identical to SEQ ID NO: 125860
  misc_feature: GYAE6OF02I0WA2.4.38.D05.1.454.CMB.1.raw
  modified_base (209)..(210): a, c, t, g, unknown or other
  misc_feature (209)..(210): n is a, c, g, or t

SEQ ID NO: 126146 - DNA, 503 bp, Homo sapiens
  misc_feature: GYAE6OF02I3F24.4.38.D05.1.454.CMB.1.raw
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
  modified_base (388)..(388): a, c, t, g, unknown or other
  misc_feature (388)..(388): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaaccnggtaccagcagaaacctggccaggctcccaggctcctcatctatggtncatccagcagggccactggcatcccagacaggttcagtggcagtgggctgggacagtacttcactctcaccatcagcagactgganccgtagaagtatttgcagttgttattactgtcagcagtgtggtagctcgacgtacgttcgaccgaagggaccgaaggtaggaaatacgaaacgaactgtggctgcaccatctgtc

SEQ ID NO: 126147 - DNA, 209 bp, Homo sapiens; identical to SEQ ID NO: 125890
  misc_feature: GYAE6OF02IZBGT.4.38.D05.1.454.CMB.1.raw
  modified_base (209)..(209): a, c, t, g, unknown or other
  misc_feature (209)..(209): n is a, c, g, or t

SEQ ID NO: 126148 - DNA, 251 bp, Homo sapiens; identical to SEQ ID NO: 125855
  misc_feature: GYAE6OF02F0YV6.4.38.D05.1.454.CMB.1.raw
  modified_base (249)..(251): a, c, t, g, unknown or other
  misc_feature (249)..(251): n is a, c, g, or t

SEQ ID NO: 126149 - DNA, 445 bp, Homo sapiens
  misc_feature: GYAE6OF02FYMJG.4.38.D05.1.454.CMB.1.raw
  modified_base (236)..(236): a, c, t, g, unknown or other
  misc_feature (236)..(236): n is a, c, g, or t
  modified_base (437)..(445): a, c, t, g, unknown or other
  misc_feature (437)..(445): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcacccgtaaggactttgactactggggccagggaaccctggtcactgtctcctcagcctccaccaagggcccatcggtcttccccctggccaccctcctccaagagcacctctgggggcacagcggccctgggctgcctggtcaaggactacttccctacagtgctctgagcgggctggcaaggcgcatagnnnnnnnnn

SEQ ID NO: 126150 - DNA, 651 bp, Homo sapiens
  misc_feature: GYAE6OF02HYKYC.4.38.D05.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (233)..(235): a, c, t, g, unknown or other
  misc_feature (233)..(235): n is a, c, g, or t
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
  modified_base (317)..(317): a, c, t, g, unknown or other
  misc_feature (317)..(317): n is a, c, g, or t
  modified_base (428)..(428): a, c, t, g, unknown or other
  misc_feature (428)..(428): n is a, c, g, or t
tcagagcactgtagcacgaccggtgctcgatttagtatctgatagttgggtttgggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcaggntgtnnngacnctacctagtcgacacanaaacgtacgcgacgacgtccctacggacgtcccttcactacttactaggttggcactaccnccgacgacgggaccggacctacggtcgactacccctaccgaacgtacggttcgtacgtagggtcgacgtaggggtcgtggacggagacgttactactacctcgaccactanacgacacgaacgtggaggacctacgtaaggtaattttgtcgaacgttaggttattaacttgtacgacgacgtacgttagggtgggtttacgaccttccgtaaccgtaccgggttcggtacccgaacgggaaccgggtaaccgtaaggggttaagaacctacggaacgggtaaaccttacggtgggtacggtaccgtaccaacccgtaacttccgtgtttaccg

SEQ ID NO: 126151 - DNA, 464 bp, Homo sapiens
  misc_feature: GYAE6OF02JUO7R.4.38.D05.1.454.CMB.1.raw
  modified_base (236)..(236): a, c, t, g, unknown or other
  misc_feature (236)..(236): n is a, c, g, or t
  modified_base (439)..(440): a, c, t, g, unknown or other
  misc_feature (439)..(440): n is a, c, g, or t
  modified_base (442)..(464): a, c, t, g, unknown or other
  misc_feature (442)..(464): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcacccgtaaggactttgactactgggccagggaaccctggtcactgtctcctcagcctccaccaacgggcccatccggtcttccccctggccaccctcctccaacgacgccacctcgtgggggcacgacgcggccctgggctgcctggtcaaggctactcctacagtgctctgagcggctggcaggcgcatagnngnnnnnnnnnnnnnnnnnnnnnnn

SEQ ID NO: 126152 - DNA, 506 bp, Homo sapiens
  misc_feature: GYAE6OF02IGP2A.4.38.D05.1.454.CMB.1.raw
  modified_base (202)..(202): a, c, t, g, unknown or other
  misc_feature (202)..(202): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggagccctagaagtatttgctagttgtattactgtcagcagtgtggtagctcaccgacgttcggccgaagggaccgaaggtaggaaatacgaaacgaactgtaggcgtgacaccactctgtc

SEQ ID NO: 126153 - DNA, 500 bp, Homo sapiens
  misc_feature: GYAE6OF02FTANT.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaacctggtaccagcagaaacctggccaggctcccaggctcctcatctatggtgcatccagcagggccactggcatcccagacaggttcagtggcaggtggtctgggacagacttcactctcaccatcagcagactggagcctagaagtattttgctagtgtattactgtcagcagtgtggtagctcaccgacgttcggaccaagggaccaaggtaggaaatacgaaacgaactgtaggctgcaccatctgtc

SEQ ID NO: 126154 - DNA, 475 bp, Homo sapiens
  misc_feature: GYAE6OF02GM7PO.4.38.D05.1.454.CMB.1.raw
  modified_base (239)..(239): a, c, t, g, unknown or other
  misc_feature (239)..(239): n is a, c, g, or t
  modified_base (448)..(475): a, c, t, g, unknown or other
  misc_feature (448)..(475): n is a, c, g, or t
tcagagcactgtagcacgaccggtgctcgatttagtatctgatagttgggtttaggtgcccgggaaaggcctggaatggatggggatcatcctatcctgatgactctgataccagatacagtccgtccttcgaaggccgcgtcaccttctcagccgacaagtccatcagcaccgcctacctgcagtggagcagcctgaaggcctcgggacaggcgccatatattactgtgcgaaaaccngtagcagctcaccccgtaaggactttgactactggggccagggaaccctggtcactgtctcctcagcctccaccaagggcccagtcggtcttcccccgtggcaccctcctccaagagacacctctcgggggcactagcggccctgggctggccctggtcaaggactacttccctacacgtgctctgagcgggctggcaaggcgcatagnnnnnnnnnnnnnnnnnnnnnnnnnnnn

SEQ ID NO: 126155 - DNA, 443 bp, Homo sapiens
  misc_feature: GYAE6OF02HBWS2.4.38.D05.1.454.CMB.1.raw
  modified_base (436)..(443): a, c, t, g, unknown or other
  misc_feature (436)..(443): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaagggcccatcggtcttccccctggcaccctctccaagagcacctctggggcacagcggccctgggctgcctggtcaaggactacttccctacagtgctctgacgcgggctggcaaggcgcatagnnnnnnnn

SEQ ID NO: 126156 - DNA, 210 bp, Homo sapiens; identical to SEQ ID NO: 125860
  misc_feature: GYAE6OF02F3YRV.4.38.D05.1.454.CMB.1.raw
  modified_base (209)..(210): a, c, t, g, unknown or other
  misc_feature (209)..(210): n is a, c, g, or t

SEQ ID NO: 126157 - DNA, 444 bp, Homo sapiens
  misc_feature: GYAE6OF02GXY8R.4.38.D05.1.454.CMB.1.raw
  modified_base (236)..(236): a, c, t, g, unknown or other
  misc_feature (236)..(236): n is a, c, g, or t
  modified_base (437)..(444): a, c, t, g, unknown or other
  misc_feature (437)..(444): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggcaccctcctccaagagcacctctgggggcacagcggccctgggctgcctggtcaaggactacttccctacagtgctctgagcgggctggcaaggcgcatagnnnnnnnn

SEQ ID NO: 126158 - DNA, 249 bp, Homo sapiens
  misc_feature: GYAE6OF02G7YNA.4.38.D05.1.454.CMB.1.raw
  modified_base (249)..(249): a, c, t, g, unknown or other
  misc_feature (249)..(249): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgccatctgactacagtgctctgagcgggctggcaaggcgcatagn

SEQ ID NO: 126159 - DNA, 442 bp, Homo sapiens
  misc_feature: GYAE6OF02IZ90E.4.38.D05.1.454.CMB.1.raw
  modified_base (236)..(236): a, c, t, g, unknown or other
  misc_feature (236)..(236): n is a, c, g, or t
  modified_base (428)..(428): a, c, t, g, unknown or other
  misc_feature (428)..(428): n is a, c, g, or t
  modified_base (434)..(442): a, c, t, g, unknown or other
  misc_feature (434)..(442): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttcccctggcaccctcctccagagcacctctgggggcacagcggcctgggctgcctggtcaaggactacttccctacagtgctctgagcgggctggcaaggcncatagnnnnnnnnn

SEQ ID NO: 126160 - DNA, 552 bp, Homo sapiens
  misc_feature: GYAE6OF02JIUML.4.38.D05.1.454.CMB.1.raw
  modified_base (253)..(253): a, c, t, g, unknown or other
  misc_feature (253)..(253): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgtagcagcagctacttaaccnggtaccagcagaacctggccaggctcccaggcctcctcatctatggtcgcatccagcagggcccactggccatcccagacaggttcagtgcagtggtactgggacagacttcactctacaccatcagcagacgtggacgcgtagaagtatttcgacgtacgtagtattacgtgtcacgcgtagtgtagtagtacgtcgtaccgtacgttacggaccgaacgggtacgtaaggtacggaaacgtacgaaacgtaacgtacgtacggacgtacgtaccgtaccgtacgttacgtgttaccg

SEQ ID NO: 126161 - DNA, 560 bp, Homo sapiens
  misc_feature: GYAE6OF02H7V41.4.38.D05.1.454.CMB.1.raw
tcagagcactgtagcacgaccggtgctcgatttagtatctgatagttgggtttgggagagctgctcagttaggacccagagggaaccatggaaaccccagcgcagcttctcttcctcctgctactctggctcccagataccaccggagaaattgtgttgacgcagtctccaggcaccctgtctttgtctccaagggaaagagccaccctctcctgcagggccagtcagagtgttagcagcagctacttaactggtaccagcagaaactggccaggctcccaggctcctcatctatggtgcatccagcagggccacgtggcactcccagacaggttcaggtgcaggtgggtctgggcagacttcactctcacatcagcagactggagcctgaagtatttagctagtgtatttacgtgtacagtcgtaggttgtaggtacgtccgttacgacccggtacgttccgggaccgtaacgggaccgtaagggttacggaaacgtaccgaaacggtaaccgttaggtacggtacgtacggacctaacccgtacttaccgtgttaccg

SEQ ID NO: 126162 - DNA, 526 bp, Homo sapiens
  misc_feature: GYAE6OF02HUU4A.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgtagcagcagctacttaacctggtaccagcagaaacctggccaggctcccaggctcctcatctatggtgcatccagcagggccactggcatcccagacaggttcagtggcaggtgggtctgggacagtacttcactctcaccatcagcagactggagcctgaagtattttgctagtgttattactgtacagctaagtgtaggtagctcgaccgacgttccggaccgaacgggaccgtaaggtacggaaatacgaaaacgaactaggtggactcggccaaccacgttctgttacc

SEQ ID NO: 126163 - DNA, 518 bp, Homo sapiens
  misc_feature: GYAE6OF02HBV6W.4.38.D05.1.454.CMB.1.raw
  modified_base (389)..(389): a, c, t, g, unknown or other
  misc_feature (389)..(389): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaagggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcaggtgggtctgggacagacttcactctcaccatcagcagactggancctgaagtatttgctagttgtattactgtcagcagtgtggtagctcgaccgtacgttcggaccgaacgggaccgaagggtaggaaatacgaaacggtaactggtaggcgtacggccaccattctgttcc

SEQ ID NO: 126164 - DNA, 500 bp, Homo sapiens
  misc_feature: GYAE6OF02FSX55.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggacgcctgaagtattttgcagtgtattactgtcagcagtgtggtagctcaaccgcgttcggccgaagggaccgaaggtaggaaatacaaacgaacgtgtggctgcaccatctgtc

SEQ ID NO: 126165 - DNA, 549 bp, Homo sapiens
  misc_feature: GYAE6OF02JOZ1W.4.38.D05.1.454.CMB.1.raw
  modified_base (384)..(384): a, c, t, g, unknown or other
  misc_feature (384)..(384): n is a, c, g, or t
  modified_base (492)..(492): a, c, t, g, unknown or other
  misc_feature (492)..(492): n is a, c, g, or t
tcagagcactgtagcacgaccggtgctcgatttagtatctgatagttgggtttgggggaggtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaagcctggaatggatggggatcatctatcctgatgactctgactacagatacagtccgtcttacgaacggccgcgtcacctttcncacgccgacaacgtccatcacgcacccgcctacctgcaggttggacgcacgcctggaacggccctcgggaccaggccgccatatacttactagtacgaccgaaaacgngttacgacacgcttacccgaacccggtaaggtactttacgaccgtacggtaccgggg

SEQ ID NO: 126166 - DNA, 504 bp, Homo sapiens
  misc_feature: GYAE6OF02H18LZ.4.38.D05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctntcctgcagggccagtcagagtgtagcagcagctacttaacctggtaccagcagaaacctggccaggctcccaggctcctcatctatggtgcatccagcagggccactggcatcccagacaggttcagtgcagtgggtctgggacagacttcactctcaccatcagcagactggagcctagaagtattttgactagttgtattactgtcagctagtgtggtagctcaccgacgttcggcgaaggaccaaggtaggaaatacgaaacgaactgtggctgcaccgattctgttacg

SEQ ID NO: 126167 - DNA, 796 bp, Homo sapiens
  misc_feature: GYAE6OF02FFN5R.4.38.D05.1.454.CMB.1.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
tcagagcactgtagcacgaccggtgctcgatttagtatctgatagttgggtttgggagagctgctcagttaggacccagagggaaccatcggaaaccccagcgcagcttctcttcctctgctactctggctcccagactaccacggagaattgtgttgacgcattcctccaggctaccctgtctttgactaccgaagggaacncgcccacctctcctgccgagggcccagtcagtagtgtacgcagcacgtacctaacttaaccgnggtaacccagaccagaacccgtggcctacggcctcccgagtcctcctcattcgtagtcggtacacgaacctccgaggtaccgaccgggaccctacggtacggacctaacccgttacccgaagggtacgtaccggttacgacggggtacgccggttaacggggtcgggttacgtaacgggtaacctacggttacccttaccacccgtaccctaccgaaccgtatacgaacgtacgacgtaacggtggtaaccgttacgtaaggtaacgtttacgtttccggacgttaagggtttaacttacgttacggtaccgtacggtacggtaccggttaacggggttacgttaccgggtaacccgtaacccggttaacccgggtaacccgggtttaaaccgggtaccggaaaacccggggtaacgggtaacccggtaaagggtaaccgttaaaacccggtacgaaaacccgggttacgtccgggttaccgccgttaacggtaccccctaaggttcctttcccggttacgtttaccccg

SEQ ID NO: 126168 - DNA, 505 bp, Homo sapiens
  misc_feature: GYAE6OF02GUU67.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaggcctcggacagcgccatatattactgtgacgaaacagtagcagctacacccgtaagactttgactagtcgggg

SEQ ID NO: 126169 - DNA, 448 bp, Homo sapiens
  misc_feature: GYAE6OF02HLDE3.4.38.D05.1.454.CMB.1.raw
  modified_base (236)..(236): a, c, t, g, unknown or other
  misc_feature (236)..(236): n is a, c, g, or t
  modified_base (352)..(352): a, c, t, g, unknown or other
  misc_feature (352)..(352): n is a, c, g, or t
  modified_base (432)..(432): a, c, t, g, unknown or other
  misc_feature (432)..(432): n is a, c, g, or t
  modified_base (438)..(448): a, c, t, g, unknown or other
  misc_feature (438)..(448): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcttccaccaagggcccatccgtcttccccctggccgccctgctccaggancacctccgagagcacagcccgccctgggctgcctggtcaaggactactccctacagtgctctgagcgggctggcaaggcncatagnnnnnnnnnnn

SEQ ID NO: 126170 - DNA, 212 bp, Homo sapiens; identical to SEQ ID NO: 125913
  misc_feature: GYAE6OF02G33ZF.4.38.D05.1.454.CMB.1.raw
  modified_base (209)..(212): a, c, t, g, unknown or other
  misc_feature (209)..(212): n is a, c, g, or t

SEQ ID NO: 126171 - DNA, 519 bp, Homo sapiens
  misc_feature: GYAE6OF02F4UR2.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtccttcgaaggccgcgtcaccttctcagccgacaagtccatcagccaccgcctacctgcagtcggagcagcctggaacggccctcggacacgccgccatatattactgtcgacgaaaccagtacgacagctccaacccgtagacctttgacctagtcgggg

SEQ ID NO: 126172 - DNA, 535 bp, Homo sapiens
  misc_feature: GYAE6OF02HEATI.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaacctggtaccagcagaaacctggccaggctccaggctcctcatctatggtgcatccagcagggccactggcatcccagacaggttcagtgcaggtgggtctgggacagacttcactctacaccatcagcagactggacgcctagaagtatttgactagtgttattactgtacagctagtgtgtagctcgaccgtacgttcggaccgtaagggaccgtaaggtacggtaaacgtaccgaaacggtaacgtaggtaggacgtacggaccaccgtagttccgtgttacc

SEQ ID NO: 126173 - DNA, 442 bp, Homo sapiens
  misc_feature: GYAE6OF02GJRGT.4.38.D05.1.454.CMB.1.raw
  modified_base (438)..(442): a, c, t, g, unknown or other
  misc_feature (438)..(442): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaaggcccatcggtcttccccctggcaccctcctccaagacgcacctctgggggcacagcggccctgggctgcctggtcaacggactacttccctacagtgctctgacgcgggctggcaggcgcatagnnnnn

SEQ ID NO: 126174 - DNA, 558 bp, Homo sapiens
  misc_feature: GYAE6OF02G4TJR.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaacctggtaccagcagaaacctggccaggctcccaggctctcatctatggtgcatccagcagggccactggcatcccagacaggttcagtggcaggtggtctgggacagacttcactctacaccatcagacagactggagcctagaagtatttgctagtgttattacgtgtacagtctagtgtggtagtcttacgaccggtacggttaccggaccgaacgggaccgtaagggtacggtaaacgtaccgaaacggtaaccgttacggtaggtaccgtacggtacctaccgtaacgttccgtagttacccg

SEQ ID NO: 126175 - DNA, 514 bp, Homo sapiens
  misc_feature: GYAE6OF02JB3W3.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaacctggtaccagcagaaacctggccaggctcccaggctcctcatctatggtgcatccagcagggccactggcatccagacaggttcagtgcagtggtctgggacagacttcactctcaccatcagcagactggagcctagaagtattttgctagttgtattactgtcagcagtgtgtagctcgaccgtacgtcgaccgaaggaccgaaggtacggaaactacgaaacgtaacgtagtacggacgtcgaccaccacgtcgtgtacc

SEQ ID NO: 126176 - DNA, 568 bp, Homo sapiens
  misc_feature: GYAE6OF02J21W7.4.38.D05.1.454.CMB.1.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
tcagagcactgtagcacgaccggtgctcgatttagtatctgatagttgggtttggggtaggaggctgctcagttaggacccagagggaaccatggaaacccagcgcagcttctctcctcctgctactctggctcccagataccaccggagaaattgtgttgacgcagtctccaggcaccctgtctttgtctccaggggaaanagccaccctctcctgcagggccagtcagagtgtagcagcagctacttaaccnggtaccagcagaacctgccaggctcccaggctcctcatctatggtgcatccagcaggggccaacgtcggcactccagtaccaggttcaggtgggcaggtcgggtctgggacagacttcactctcaccatcagtcagactggagccgtagaagtagtttgctagtgttattactgtcagctagtgtggtacgtctccgaccgtacggttacggccgaacgggtaccgaagggttacggaaaacgttaccgaaacggtaaccgttacggtacgggtacgtacggaccgtaccccgaagttccgttacggttacccg

SEQ ID NO: 126177 - DNA, 439 bp, Homo sapiens
  misc_feature: GYAE6OF02IMVH1.4.38.D05.1.454.CMB.1.raw
  modified_base (236)..(236): a, c, t, g, unknown or other
  misc_feature (236)..(236): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (430)..(439): a, c, t, g, unknown or other
  misc_feature (430)..(439): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaccctggtcactgtctcctcagcctccaccaagggcccatcggtcttcccctggcaccctctccaagagcacctctggggcacagcggccctgggctgcctggcaggactactccctanagtgctcngagcgggctggcaaggcgcatagnnnnnnnnnn

SEQ ID NO: 126178 - DNA, 445 bp, Homo sapiens
  misc_feature: GYAE6OF02GHIN2.4.38.D05.1.454.CMB.1.raw
  modified_base (236)..(236): a, c, t, g, unknown or other
  misc_feature (236)..(236): n is a, c, g, or t
  modified_base (431)..(431): a, c, t, g, unknown or other
  misc_feature (431)..(431): n is a, c, g, or t
  modified_base (437)..(445): a, c, t, g, unknown or other
  misc_feature (437)..(445): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggccaccctcctccaagagcacctctgggggcacgagcggccctgggctgcctggtcaaggactacttccctacagtgctctgagcggctggcaggcncatagnnnnnnnnn

SEQ ID NO: 126179 - DNA, 521 bp, Homo sapiens
  misc_feature: GYAE6OF02G4CKM.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccacgtggcatcccagacaggttcagtgcaggtgggtctgggacagacttcactcctcaccatcagcagacgtggagcctagaagtatttgctagttgttattactgtcagctagtgtggtagctcgaccgtacgttcgaccgaagggaccgtaaggtaggaaactacgaaacgtacgtggtaggtacgtacgcactactcgtgttc

SEQ ID NO: 126180 - DNA, 537 bp, Homo sapiens
  misc_feature: GYAE6OF02FLFZP.4.38.D05.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaaccnggtaccagcagaaacctggccaggctcccaggctcctcatctatggtgcatccagcagggccacgtggcatcccagacaggttcagtggcaggtggtctgggacagacttcactctcaccatcagcagactggacgccgtagaagtattttgactagttgttattactgtcagtcgtagtgtaggtagtctcgaccgtacgttcggaccgaacgggaccgaaggtaggaaacgtacgaaacggtaacgtaggtaggctacggaccaccgtattccgtgttccg

SEQ ID NO: 126181 - DNA, 210 bp, Homo sapiens; identical to SEQ ID NO: 125860
  misc_feature: GYAE6OF02HF8KK.4.38.D05.1.454.CMB.1.raw
  modified_base (209)..(210): a, c, t, g, unknown or other
  misc_feature (209)..(210): n is a, c, g, or t

SEQ ID NO: 126182 - DNA, 250 bp, Homo sapiens; identical to SEQ ID NO: 125865
  misc_feature: GYAE6OF02GD6CB.4.38.D05.1.454.CMB.1.raw
  modified_base (249)..(250): a, c, t, g, unknown or other
  misc_feature (249)..(250): n is a, c, g, or t

SEQ ID NO: 126183 - DNA, 547 bp, Homo sapiens
  misc_feature: GYAE6OF02F29AZ.4.38.D05.1.454.CMB.1.raw
  modified_base (202)..(202): a, c, t, g, unknown or other
  misc_feature (202)..(202): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccacctctcctgcagggccagtcagagtgttagcagcagctacttaacctggtaccagcagaacctggccaggcctcccaggcctcctcatctagtggtgcatccagcgacgggccacgtggcatcccagacctaggttcagtcggcaggtgggtctgggacagaccttcactccacaccatcagcagacgtggacgtccgtagaacgtagtttgcgtagttgtattactgtcacgtcgagtgtggtagccgttacgaccggtacgtccggacgaacgggacgaaggtaggtaaacgtacgaacgtaacgtaggtacggtcgtacgaccactactcgtcgttcc

SEQ ID NO: 126184 - DNA, 514 bp, Homo sapiens
  misc_feature: GYAE6OF02I1161.4.38.D05.1.454.CMB.1.raw
  modified_base (254)..(254): a, c, t, g, unknown or other
  misc_feature (254)..(254): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaaccnggtaccagcagaaacctggccaggctcccaggctcctcatctatggtgcatccagcagggccactggcactcccagacaggttcagtggcaggtggtctgggacagacttcactctcaccatcagcagactggacgctagaagtatttgctagttgtattactgtcagcagtgtggtagctcgaccggtacgttcggaccgaacgggacaaggtaggaaactacgaaacgtaacgtagtggctcgaccaccatctgttcc

SEQ ID NO: 126185 - DNA, 558 bp, Homo sapiens
  misc_feature: GYAE6OF02INOA0.4.38.D05.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctaccgaggggaaanagcccaccctctcctgcagggccagtcagagtgttagcagcagctacttaactggtaccagcaagaactggccaggctcccagctccncatctanggtncatccagcagggccacgtggcatcccagacaggttcaggtggcaggtggtcngggacagacttcactncacatcagcagactggacnctagaagtatttgactagtgtacttactgacagcgtagttggtaggtacgcctaccgaaccggtacggttccggaccgtaacgggaccgtaagggtacggaaacgttaaccgaaaaccgtaaccgtaggtacggtaccgtacgacccgtaacgacttcgttacggtacc

SEQ ID NO: 126186 - DNA, 605 bp, Homo sapiens
  misc_feature: GYAE6OF02IPOPJ.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggcgtgggtgcgccaggtcggacccgggaaggcctggaatggagtggggatcatctatcctgatgactctgactaccagatacacgttccgtaccttaggaacggccgcgtcctaccttctcgacgaccgacaacgtccatcacgccacccgccctaccgtgaccgagtcggacgccacggccgtaggaaccggtcccgtaccgggaaccacggcccgaccgtaattaacttaatttaccgtgtacggaaccggaaaaccctaggtaacgacgacgtaccgttaccgaaccccggttaaggtaccttttacgaccgttacggtaccggggg

SEQ ID NO: 126187 - DNA, 251 bp, Homo sapiens; identical to SEQ ID NO: 126138
  misc_feature: GYAE6OF02FMEGV.4.38.D05.1.454.CMB.1.raw
  modified_base (249)..(251): a, c, t, g, unknown or other
  misc_feature (249)..(251): n is a, c, g, or t

SEQ ID NO: 126188 - DNA, 658 bp, Homo sapiens
  misc_feature: GYAE6OF02ILEAP.4.38.D05.1.454.CMB.1.raw
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
tcagagcactgtagcacgaccggtgctcgatttagtatctgatagttgggtttggggtaggagctgctcagttaggacccagagggaaccatggaaaccccagcgcagcttctcttcctcctgctactctggctcccagataccaccggagaaattgtgttgacgcagtctccaggcacctgtcttgtctcaggggaanagccacctctcctgcaggccagtcagagtgtagcagcagctacttacnggtaccagcagaacctggaccaggcctccaggcctcctnacttctagtggtcgcatcccgagcacggggccacgtggctactcccaaggacctggttccaaggtcggctaggtgggtcgtagggacagtaccttcaccgtctaccgactaactcagcgaagtacgtagggacgaccgttagggaaacgtttaagttttcggacttaaggtttcgttaacgtttaactggttacgacgtaccgtaaggttgggtacggttacgtacctacgtaacccggttacgggttcccggaaccggtaacggggaacccgtaaagggttacggtaaaacgtaaccggtaaaccggtaaacggttccggtacgggaacgttccacccggtaacccgtaacgttacgttacgtttacccgg

SEQ ID NO: 126189 - DNA, 505 bp, Homo sapiens
  misc_feature: GYAE6OF02IRBMN.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtcttcgaaggccgcgtcaccttctcagccgacaagtccatcagcaccgcctacctgcagtggagcagcctgaacggcctcggacagcgccatatattactgtgacgaaaacagtagcagctcacccgtagactttgactactcgggg

SEQ ID NO: 126190 - DNA, 451 bp, Homo sapiens
  misc_feature: GYAE6OF02F65CD.4.38.D05.1.454.CMB.1.raw
  modified_base (236)..(236): a, c, t, g, unknown or other
  misc_feature (236)..(236): n is a, c, g, or t
  modified_base (438)..(439): a, c, t, g, unknown or other
  misc_feature (438)..(439): n is a, c, g, or t
  modified_base (441)..(451): a, c, t, g, unknown or other
  misc_feature (441)..(451): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggccaccctcctccaagacgcacctctggggcacagcgccctgggctgcctggtcaaggactacttccctacagtgctctgacgcgggctggcaaggcgcatagnngnnnnnnnnnnn

SEQ ID NO: 126191 - DNA, 683 bp, Homo sapiens
  misc_feature: GYAE6OF02IDPYE.4.38.D05.1.454.CMB.1.raw
  modified_base (646)..(646): a, c, t, g, unknown or other
  misc_feature (646)..(646): n is a, c, g, or t
  modified_base (652)..(656): a, c, t, g, unknown or other
  misc_feature (652)..(656): n is a, c, g, or t
  modified_base (659)..(660): a, c, t, g, unknown or other
  misc_feature (659)..(660): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (669)..(675): a, c, t, g, unknown or other
  misc_feature (669)..(675): n is a, c, g, or t
  modified_base (677)..(679): a, c, t, g, unknown or other
  misc_feature (677)..(679): n is a, c, g, or t
  modified_base (681)..(683): a, c, t, g, unknown or other
  misc_feature (681)..(683): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcgggacagccgacctatattattacgtggtcgaaaccgaaaacctaggtacgacgagtcctacctaccgtaccggtaaacggttacgtttacgtaaccttacgggtcgggggaccggaaaccgggtaacccgttcggtacctacgttcgttcccttccgttacgacggtcccctacccgaaaccggaaccggggacccctacgtttcccggttccccttttcccccggtcggcccctaccccttccctaacccgaaacggcgacctacccgttcgggtcgggggaccaacgacgggcccggtcccggtcgggtcgttccgtccggttcggtaacgaaacggttaccctttaaccccgttacccgtaacgtacggtaccgtccttacggtcggacgggtcccgggtcgtacgggacggaaaccgggccgtacgtaacgtacggngcgcgnnnnncgnncncngngcnnnnnnncnnncnnn

SEQ ID NO: 126192 - DNA, 556 bp, Homo sapiens
  misc_feature: GYAE6OF02GW65J.4.38.D05.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaactggtaccagcagaacctggccaggctcccaggctcctcatctatggtncatccagcaggccactggcatcccagacaggttcagtgcagtggtctgggacagcttcactctcacatcagcacgactggagtccgtagaagtattttgcgtagttagttattacgtgtacagtacgtagtgtggtacgtcttccgaccggtacgttccggaccgtaacgggaccgaagggtacggtaaacgtaccgaaaccggtaacgttacggtacggacgtacggaccgtaaccgtacgttccgtacgttaccg

SEQ ID NO: 126193 - DNA, 543 bp, Homo sapiens
  misc_feature: GYAE6OF02JCAFA.4.38.D05.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgtagcagcagctacttaacctggtaccagcagaaacctggccaggcctcccaggctcctcatctatggtncatccagcagggccacgtggcactcccagacaggttcagtgcaggtcggtctgggacagtacttcactctacaccatcagcagacgtggacgcctagaagtagtttgctagttgttattactgtcagtcgtagtggtgtacgtcgttacgtaccgtacgttccggaccgaacgggacgtaagggtacggaaactacgaaacgtacgtaggtacggactacggaccacgtacttcgtgttacg

SEQ ID NO: 126194 - DNA, 588 bp, Homo sapiens
  misc_feature: GYAE6OF02GWK94.4.38.D05.1.454.CMB.1.raw
  modified_base (202)..(202): a, c, t, g, unknown or other
  misc_feature (202)..(202): n is a, c, g, or t
  modified_base (389)..(389): a, c, t, g, unknown or other
  misc_feature (389)..(389): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccgaccctctcctgcagggccagtcagagtgttagcagcagctacttaacctggtaccagcagaaacctggccaggctcccaggcctcctcatctatggtgcatccagcagggccacgtggcatcccagacaggttcagtgcagtggtctgggacagacttcactcacaccatcagcagactggancctagaacgtatttgctagttagttaacttacgtgtaccaagtcgtaaggttggtaggtacgtccgttaccgaccggttacggtttaccggaccgtaaaggggacccgtaaggggttacggaaaacgttaccgaaaacggtaaccgttacggtacggtacttacggaccctaacccgtacgttaccgttacggttaccg

SEQ ID NO: 126195 - DNA, 510 bp, Homo sapiens
  misc_feature: GYAE6OF02GG3H1.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtccttcgaaggccgcgtcaccttctcagccgacaagtccatcagcaccgcctacctgcagtgagcagcctgaaggcctcggacacgcgccatatattactgtagacgaaaaccagtagcagctcacccgtaaggactttgactacgtcgggg

SEQ ID NO: 126196 - DNA, 539 bp, Homo sapiens
  misc_feature: GYAE6OF02GYSZY.4.38.D05.1.454.CMB.1.raw
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (397)..(397): a, c, t, g, unknown or other
  misc_feature (397)..(397): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtgtagcagcagctacttaacctggtaccagcagaacctggccaggctcccaggcctcctcatctatggtgcatccagcgagggccacgtggcatcccagacaggtcagtgcaggtggctgggacngactcactcncacatcagcagacgtggacgcgtagaagtntttacgctagttgtattactgtcgagtcgtagtgtggtacgtcgttcgaccgtacggtcggaccgaacggggtaccgaagggtaggtaaacgtaacgaaacggtaacgtaggtggtacgtcgacctaccgtactcgtgttcg

SEQ ID NO: 126197 - DNA, 510 bp, Homo sapiens
  misc_feature: GYAE6OF02FY1HJ.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcaggtgggtctgggacagacttcactctcaccatcagcagactggacgcctagaagtattttgctagttgttattactgtcagcagtgtgtagctcaccgacgttcgaccgaagggaccgaaggtaggaaactacgaaacgaacgtagtggctcgaccacactctgtc

SEQ ID NO: 126198 - DNA, 514 bp, Homo sapiens
  misc_feature: GYAE6OF02FNUPX.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtcttcgaaggccgcgtcaccttctcagccacaagtccatcagcaccgcctacctgcagtggagcagcctgacggcctcggacagcgccatatattactgtgacgaaaaccagtacgacagctaccacccgtaaggtactttacgactacgtcgggg

SEQ ID NO: 126199 - DNA, 541 bp, Homo sapiens
  misc_feature: GYAE6OF02H7DZY.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgcaggtgccccggggaaaggccgtggaatggatggggatcatctatcctgatgactctgataccagatacagtccgtccttcgaaggccgcgtctaccttctcacgccgaacaacgtccatcagccaccgcctacctgcagtggagcacgcctaggaacggcctacggacacgccgaccatactattactgtacgacgaaaccagtacgacacgcctaccgacccggtaagtaccgtttacgacctacgtaccgggg

SEQ ID NO: 126200 - DNA, 441 bp, Homo sapiens
  misc_feature: GYAE6OF02G8JSN.4.38.D05.1.454.CMB.1.raw
  modified_base (437)..(441): a, c, t, g, unknown or other
  misc_feature (437)..(441): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaagggcccatcggtcttccccctggccaccctcctccaagacgcacctctgggggcacgagcgcctgggctgcctggtcaggactacttccctacagtgctctgagcgggctggcaaggcgcatagnnnnn

SEQ ID NO: 126201 - DNA, 512 bp, Homo sapiens
  misc_feature: GYAE6OF02GANT7.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagcttcactctcaccatcagcagactggagcctagaagtagtttgcagttgtattactgtcagctagtgtggtagctcgaccgcgtcggcgaacgggaccaaggtacggaaataccgaaacgaacgtggtaggctcggccaccatccgtgttccg

SEQ ID NO: 126202 - DNA, 699 bp, Homo sapiens
  misc_feature: GYAE6OF02F4NOJ.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaaggcccgggagtctctagaagatctcctaggtaagggttctggatacattcgtttacggacctactggagttcggcgtgggtcgcgccgagggtcggacccggggaaaggccgtagggaacgtgggagtgggggaatcgatctatccgtgatgacttcgtagaactaccagtactactacgttccgtaccgtttacggaacggtcccgtccgttaccctacctttcctccgaacgtcccgaaacgtaacgtaccctaactccgaacgaccctaaccccggaccctacccgttcgaccgtaaggtcgggaacgaccgacggtcccgtacggaacgggtcccgtacgggacgtacggaccgacctataacttaacgttacgttaggtacgaaacccggaaaaaccgtagtaaccggacctacggtcccgtacccgtaaccccgggtttaaacggtacccttttacgggtaaccgttacgggtaacccggggg

SEQ ID NO: 126203 - DNA, 253 bp, Homo sapiens; identical to SEQ ID NO: 125884
  misc_feature: GYAE6OF02GW3LZ.4.38.D05.1.454.CMB.1.raw
  modified_base (249)..(253): a, c, t, g, unknown or other
  misc_feature (249)..(253): n is a, c, g, or t

SEQ ID NO: 126204 - DNA, 499 bp, Homo sapiens
  misc_feature: GYAE6OF02FNK46.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaacctggtaccagcagaaacctggccaggctcccaggctcctcatctatggtgcatccagcagggccatggcatcccagacaggttcagtggcaggtgggtctgggacagacttcactctcaccatcagcagactggagccgtagaagattttgctagtgtattactgtcagcagtgtgtagctcaccgacgttcgaccgaaggaccgaaggtaggaaatacaaacgaactagtggctgacaccatctgtc

SEQ ID NO: 126205 - DNA, 214 bp, Homo sapiens
  misc_feature: GYAE6OF02HB0T2.4.38.D05.1.454.CMB.1.raw
  modified_base (210)..(214): a, c, t, g, unknown or other
  misc_feature (210)..(214): n is a, c, g, or t
tcagagcactgtagcacgaccggtgctcgatttagtatctgatagttgggtttgggcggtgctcgatttagtatctgatagttgggtttgggggaagaggaagactgacggtccccccaggagttcaggtgctgggcacagcggccctgggctgcctggtcaaggactacttccctacagtgctctgagcgggctggcaaggcgcatagnnnnn

SEQ ID NO: 126206 - DNA, 539 bp, Homo sapiens
  misc_feature: GYAE6OF02GJE8E.4.38.D05.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
  modified_base (419)..(419): a, c, t, g, unknown or other
  misc_feature (419)..(419): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgtagcagcagctacttaacctggtaccagcagaaacctggccaggcctcccaggcctcctcatctatggtncatccagccagggccacgtggcatcccagacaggttcagtggcaggtgggtctgggacagtacttcactctcaccatcagcagacgtggactccgtagaagtatttgacgtagttntattctgtacagtctaggtgtggtactccgtcgaccggtcgttaccgaccgtaagggaccgtaagggtacgaaactaccgaaacgtagtcggtacggtctcgaccactacgtctgttacc

SEQ ID NO: 126207 - DNA, 535 bp, Homo sapiens
  misc_feature: GYAE6OF02G9BR7.4.38.D05.1.454.CMB.1.raw
  modified_base (305)..(305): a, c, t, g, unknown or other
  misc_feature (305)..(305): n is a, c, g, or t
tcagagcactgtagcacgaccggtgctcgatttagtatctgatagttggggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggcctcccaggcctcctcatctatggtncatccagcagggccacgtggcactcccagacaggttcagtggcaggtggtctgggacagtacttcactctcaccatcagcagactggacgccgtagaagtatttgacgtagttgtattactgtcagcgtagtgtggtagtctcaccggtacgtcggaccgaacgggaccgaagggtacggaaacgtacgaaacgtaacgtaggtagacgtacgaccactacgtcgtagtc

SEQ ID NO: 126208 - DNA, 448 bp, Homo sapiens
  misc_feature: GYAE6OF02FP0MT.4.38.D05.1.454.CMB.1.raw
  modified_base (437)..(448): a, c, t, g, unknown or other
  misc_feature (437)..(448): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccagtagcagctcaccccgtaaggactttgactactggggccagggaaccctggtcactgtctcctcagcctccaccaagggcccatcggtcttccccctggccaccctcctccaacgagcacctctgggggcacagcggccctggctgcctggtcaagactacttccctacagtgctctgagcgggctggcaaggcgcatagnnnnnnnnnnnn

SEQ ID NO: 126209 - DNA, 520 bp, Homo sapiens
  misc_feature: GYAE6OF02HCW4Z.4.38.D05.1.454.CMB.1.raw
  modified_base (201)..(201): a, c, t, g, unknown or other
  misc_feature (201)..(201): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagcccaccctctcctgcagggccagtcagagtgttagcagcagctacttaacctggtaccagcagaaacctggccaggctcccaggctcctcatctatggtgcatccagcagggccacgtggcatcccagacaggttcaggtggcaggtgggtctgggacagacttcactctcacntcagcagacgtggagctagaatntttgctagttgttattacgtgtcagcgtagttgtgtagtctcgaccggtacgtcggaccaacgggaccgaaggtaggaaatacgaaacgtaacgtaggtaggactcgacacctatctgtc

SEQ ID NO: 126210 - DNA, 447 bp, Homo sapiens
  misc_feature: GYAE6OF02FX4JW.4.38.D05.1.454.CMB.1.raw
  modified_base (236)..(236): a, c, t, g, unknown or other
  misc_feature (236)..(236): n is a, c, g, or t
  modified_base (439)..(447): a, c, t, g, unknown or other
  misc_feature (439)..(447): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggcaccctcctccaagagcacctctgggggcacacgcggccctgggctgcctggtcaaggactacttccctacagtgctctgagcgggctggcaaggcgcataggnnnnnnnnn

SEQ ID NO: 126211 - DNA, 527 bp, Homo sapiens
  misc_feature: GYAE6OF02GLFWK.4.38.D05.1.454.CMB.1.raw
  modified_base (302)..(302): a, c, t, g, unknown or other
  misc_feature (302)..(302): n is a, c, g, or t
  modified_base (522)..(522): a, c, t, g, unknown or other
  misc_feature (522)..(522): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaagggaaagagccaccctctcctgcagggccagtcagagtgttagcagcagctacttaacctggtaccagcagaaacctggccaggctcccaggctcctcatctatggtncatccagcagggccactggcactcccagacaggttcagtggcaggtggtctgggacagacttcactctcaccatcagcagactggacgccgtagaacgtatttgactagtagttattactgtacagcgagttgtggtacgcttacgaccgtcggttcggaccgaacgggaccaagggtacgaaagtacgaaacgaacgtggtcggactcgaccacactcngttac

SEQ ID NO: 126212 - DNA, 255 bp, Homo sapiens
  misc_feature: GYAE6OF02HLC2P.4.38.D05.1.454.CMB.1.raw
  modified_base (248)..(255): a, c, t, g, unknown or other
  misc_feature (248)..(255): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttcccgccatctgactacagtgctctgagcggctggcaaggcgcatagnnnnnnnn

SEQ ID NO: 126213 - DNA, 545 bp, Homo sapiens
  misc_feature: GYAE6OF02HFHS5.4.38.D05.1.454.CMB.1.raw
  modified_base (403)..(403): a, c, t, g, unknown or other
  misc_feature (403)..(403): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggcctcctcatctagtggtgcatccagcacgggccacgtggcatcccagactaggttcagtggcaggtcggtctgggacagacttcactctcacatcagcagactggacgctagaagtntttgactaggttgtaattcgtgtcagcgtaggttgtaggtacgtctaccgaccggtacggttacggaccgtaagggaccgaagggtacggaaactacgaaacgtacgtggtacggtctaggccaccgtacttcgtcgttacc

SEQ ID NO: 126214 - DNA, 555 bp, Homo sapiens
  misc_feature: GYAE6OF02HDGEO.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaagggaaagagccaccctctcctgcagggccagtcagagtgttagcagcagctacttaacctggtaccagcagaaacctggccaggctcccaggctcctcatctatggtgcatccagcagggccacgtggcactcccagacaggttcagtggcagtcgggtctgggacagtacttcactctcacatcagcagacgtggacgccgtagaagtagtttgctagtgttattctgtcagctagtgtaggtatcctacgtaccggtacggttcggaccgaacggggacctaagggtacggaaacgtaccgaaaacggtaacgtggtacggtacttacggaccctaaccgtacgttcgttacgttaccg

SEQ ID NO: 126215 - DNA, 571 bp, Homo sapiens
  misc_feature: GYAE6OF02FVHBI.4.38.D05.1.454.CMB.1.raw
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
  modified_base (334)..(334): a, c, t, g, unknown or other
  misc_feature (334)..(334): n is a, c, g, or t
  modified_base (381)..(381): a, c, t, g, unknown or other
  misc_feature (381)..(381): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaaccnggtaccagcagaaacctgccaggctcccaggctccncatctatggtgcatccaggcacgggccactggcactcccagacnggttcagtggcaggtgggtctagggacagacttcactctcacatcancagacgtggacgcgtagaagtagttttgctagttcgtattactgtacagtcgagtggtggtacgcgttccgaaccggtaccggttacggaacccggaacggggtaccgtaagggtaacggtaaaactaccggtaaaacggtaacgttgggtacggtcgtacggacccgtaaccgacttacgtgttacccg

SEQ ID NO: 126216 - DNA, 519 bp, Homo sapiens
  misc_feature: GYAE6OF02FTGGH.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtccttcgaaggccgcgtcaccttctcagccgacaagtccatcagccaccgcctacctgcagtggagcagcctgacggcctcggacacgcgccatatattactgtgacgaaaaccagtagcagcctaccaccccggtaagacctttgaccgtacgtacgggg

SEQ ID NO: 126217 - DNA, 695 bp, Homo sapiens
  misc_feature: GYAE6OF02H5FBQ.4.38.D05.1.454.CMB.1.raw
  modified_base (213)..(213): a, c, t, g, unknown or other
  misc_feature (213)..(213): n is a, c, g, or t
  modified_base (259)..(259): a, c, t, g, unknown or other
  misc_feature (259)..(259): n is a, c, g, or t
tcagagcactgtagcacgaccggtgctcgatttagtatctgatagttgggtttgggaggagctgctcagttaggacccagagggaaccatggaaaccccagcgcagcttctcttcctcctgctactctggctcccagataccaccggagaaattgtgttgacgcagtctccaggcaccctgttctttgtcctccaggggaaagcgccaccctntccctgaccagggccagtcagagtgttagcagcagctacttaaccnggtacagcagaaactggcaggctcccaggctactcatctatgtagcatccagcagggccacgtgcatcccgagacaggttcagtgggcaggtgggtctaggggcaagtaccgttcactcgttaccaaccgtataccgagaccgtagtaaccggtaggtacgacccgtaaggtaacgggttaatttttcggaaccgtagggttacggttaactttttaaaccggtcggttaccgtaaggtaccggtaaggttcggtaagggttaccgtacccgttaaccgtacccgggtaaccggttacccgggtaaccggtaaacggggtaacccggttaaacgggtaacgggtaaaacggttaaccggtaaaacgggtaaaccgtttacgggttaccgggtaccgtaacggtaccgtaacccggtacgtttacgttacgttaccg

SEQ ID NO: 126218 - DNA, 453 bp, Homo sapiens
  misc_feature: GYAE6OF02FR2H9.4.38.D05.1.454.CMB.1.raw
  modified_base (236)..(236): a, c, t, g, unknown or other
  misc_feature (236)..(236): n is a, c, g, or t
  modified_base (438)..(453): a, c, t, g, unknown or other
  misc_feature (438)..(453): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtctcctcagcctccaccaagggcccatcggtcttccccctggcaccctcctccaagacgcacctctgggggcacagcgccctgggctgcctggtcaaggactacttccctacagtgctctgagcgggctggcaaggcgcataggnnnnnnnnnnnnnnnn

SEQ ID NO: 126219 - DNA, 454 bp, Homo sapiens
  misc_feature: GYAE6OF02HOI2D.4.38.D05.1.454.CMB.1.raw
  modified_base (236)..(236): a, c, t, g, unknown or other
  misc_feature (236)..(236): n is a, c, g, or t
  modified_base (442)..(442): a, c, t, g, unknown or other
  misc_feature (442)..(442): n is a, c, g, or t
  modified_base (444)..(454): a, c, t, g, unknown or other
  misc_feature (444)..(454): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggactttgactactggggccagggaaccctggtcactgtcctcctcagcctccaccaaggcccatcggtcttcccctggccaccctcctccaagcgccacctctggggcacgagcggccctgggctcgccgtggtcaaggaccttacttcccctacagtcgctctgaggcgggtctggcaggcgcangnnnnnnnnnnn

SEQ ID NO: 126220 - DNA, 257 bp, Homo sapiens
  misc_feature: GYAE6OF02G6RYD.4.38.D05.1.454.CMB.1.raw
  modified_base (248)..(257): a, c, t, g, unknown or other
  misc_feature (248)..(257): n is a, c, g, or t
tcagagcactgtagcacgaccggtgctcgatttagtatctgatagtgggtctgggacagacttcactctcaccatcagcagactggagcctgaagattttgcagtgtattactgtcagcagtgtggtagctcaccgacgttcggccaagggaccaaggtggaaatcaaacgaactgtggctgcaccatctgtcttcatcttccgccatctgactacagtgctctgagcgggctggcaaggcgcatagnnnnnnnnnn

SEQ ID NO: 126221 - DNA, 577 bp, Homo sapiens
  misc_feature: GYAE6OF02I18JZ.4.38.D05.1.454.CMB.1.raw
  modified_base (383)..(383): a, c, t, g, unknown or other
  misc_feature (383)..(383): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtcgcccgggaaaggcctgggaatgggatgggggatcagtctatcctgatgactctgataccagatacagtcctctcgaagccgcgtcacttcncagccgacaagtccatcacgcaccgcctaccgtgctaggtcggaagccacgtccgtgaacggcccgtacggaactcggaccgcccaaagttactaatttacgtgttggaaccgaaaacccgtagtaacggacacggtccctacccgtaaccccggttaacggtaccttttacggtaccttacggtacccggggg

SEQ ID NO: 126222 - DNA, 211 bp, Homo sapiens; identical to SEQ ID NO: 125880
  misc_feature: GYAE6OF02GCMUR.4.38.D05.1.454.CMB.1.raw
  modified_base (209)..(211): a, c, t, g, unknown or other
  misc_feature (209)..(211): n is a, c, g, or t

SEQ ID NO: 126223 - DNA, 638 bp, Homo sapiens
  misc_feature: GYAE6OF02HFBCX.4.38.D05.1.454.CMB.1.raw
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgcaggtgcccggggaaaggcctggaatggagtgggggatcgatctatcctgatgactctgactacagatacagtccgtcttcgaacggccgcgtcctaccttctcacgccgacaacgtccatcacgaccacccgccctacctcgacacggtcggacgcgacgccgtaggaacgggtcccgtaccgggaacctacgggcccgaacccgtaattaacttaacgtttaccgtcggttacggaacccgtaaaaacccgtaaggtaaccggaccgaccgtaccgttaaccccgtaacccccgggtttaaagggttaaccccgttttacggtaacccgttaccgggttaacccgggggg

SEQ ID NO: 126224 - DNA, 584 bp, Homo sapiens
  misc_feature: GYAE6OF02FZ6EW.4.38.D05.1.454.CMB.1.raw
  modified_base (407)..(407): a, c, t, g, unknown or other
  misc_feature (407)..(407): n is a, c, g, or t
  modified_base (527)..(527): a, c, t, g, unknown or other
  misc_feature (527)..(527): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaggcccggggagtctctgaagatctcctgtaagggttctggatacattcttaggacctactggatcggctgggtgcgccagggtcgacccggggaaaggccgtagggaagtggagtggggatcatctatcctgatgactctagactaccagactacacgttccgtaccttacggaacggtcccgcgtccaccgttcncacgccgaactacgtcatcacgccaccgcctaccgtgacaggtacggcgcagcccgtaggaaccggcctacgggaccacgccgaccattaactacttacgtgtacggaaccgtaaaacgngtaagccagaccttacccgacccggttaaggtctttacggacctacgggtaccgggg

SEQ ID NO: 126225 - DNA, 539 bp, Homo sapiens
  misc_feature: GYAE6OF02HC4B8.4.38.D05.1.454.CMB.1.raw
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgtagcagcagctacttaacctggtaccagcagaaacctggccaggctcccaggctcctcatctatggtgcatccagcagggccacgtggcatcccagacaggttcagtgcagtgggtctgggacagacttcactctcaccatcagcagactggacgcctagaagtntttgctagtgtattctgtcagctagtgtggtagcgtacgaccggtacgttccggaccgaacgggaccgaagggtacggaaacgtacgaaacggtaacgtggtacggtacgtacggcctaacccgtacttccgtagttaccg

SEQ ID NO: 126226 - DNA, 621 bp, Homo sapiens
  misc_feature: GYAE6OF02FRJK6.4.38.D05.1.454.CMB.1.raw
  modified_base (304)..(304): a, c, t, g, unknown or other
  misc_feature (304)..(304): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtgttagcagcagctacttaacctggtaccagcagaaacctggccaggcctcccaggctcctcatctatggtncatccagcagggccacgtggcactcccagacaggttcagtggcaggtgggtctggggacaggtaccttacgaccttccgtaccaaccctactacgaacgaccgaacgtacgtcgggacgtcctaggaagtagttttgacgtagttagttaatttacgtgtacgtagtacgtaggttggtaggtacgtccgttaccgtaaccggtacggttaccgggaccgtaacggggaccgtaacgggtaacggtaaacgtaaccggaaaacggtaacgttacggtaggtaccgtacggtaccgaccgtacgttcgtacgttaccg

SEQ ID NO: 126227 - DNA, 546 bp, Homo sapiens
  misc_feature: GYAE6OF02FPZE2.4.38.D05.1.454.CMB.1.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (496)..(496): a, c, t, g, unknown or other
  misc_feature (496)..(496): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (528)..(530): a, c, t, g, unknown or other
  misc_feature (528)..(530): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (541)..(543): a, c, t, g, unknown or other
  misc_feature (541)..(543): n is a, c, g, or t
  modified_base (545)..(546): a, c, t, g, unknown or other
  misc_feature (545)..(546): n is a, c, g, or t
tcagagcactgtagcacgaccggtgctcgatttagtatctgataggttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattacngtgcgaaaaaccngtagcagctcaccccgtaaggctttgactactgggccagggaaccctggtcactgtctcctcacgcctccgaccgaacgggcccagtcggtccttccccgtggccaccctcctccaacgacgcaccgtcgtggggcacgacggccggcccgtgggcctcggcccgtggtacgaacggtacctaccgtttccctaacgtagtcgcttcgtcggacggtccggcgtcggaccgtaacgggccgacgtaacgtaggtacgngacgcagtgcgcgcgcgcgngcngngcgcgcnnncncgcgcgngnnngnn

SEQ ID NO: 126228 - DNA, 596 bp, Homo sapiens
  misc_feature: GYAE6OF02HLB4M.4.38.D05.1.454.CMB.1.raw
  modified_base (202)..(202): a, c, t, g, unknown or other
  misc_feature (202)..(202): n is a, c, g, or t
  modified_base (447)..(447): a, c, t, g, unknown or other
  misc_feature (447)..(447): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgtagcagcagctacttaacctggtaccagcaagaaacctggaccaggcctcccaggcctcctcatctatggtgcatccagccgagggccacgtggccactcccgaagcgtaggtcaggtggctaggtggtcgtgggacagtacttcactctcacatcagcgagacgtggacgtcgtagaagttatttgactagttagttattacgtgtacgtagngtaggttggtaggtacgtctaccgacccggtaccgttaccgggaccgtaacggggaccgtaagggtaacggtaaacgtaaccggtaaaacggtaacgttaggtacggtaccgtacggaacctacccgtacgttaccgttacgttacccg

SEQ ID NO: 126229 - DNA, 500 bp, Homo sapiens
  misc_feature: GYAE6OF02JC4WH.4.38.D05.1.454.CMB.1.raw
  modified_base (236)..(236): a, c, t, g, unknown or other
  misc_feature (236)..(236): n is a, c, g, or t
  modified_base (473)..(500): a, c, t, g, unknown or other
  misc_feature (473)..(500): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcaaaaaccngtagcagctcaccccgtaagactttgactactgggccagggaaccctggtcactgtctcctcacgcctccaccaacgggcccatccggtccttcccctggcccaccctccgtaccaacgacgccacccgtcgtcgggggccacacggccgcccgtcgggcctcggccgtcggtaccgaacggtactaccgttccctacgacgtcgctctgacgcggcgtggcgaacggcgcactagnnnnnnnnnnnnnnnnnnnnnnnnnnnn

SEQ ID NO: 126230 - DNA, 576 bp, Homo sapiens
  misc_feature: GYAE6OF02JMI9J.4.38.D05.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
  modified_base (389)..(389): a, c, t, g, unknown or other
  misc_feature (389)..(389): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaangccaccctctcctgcagggccagtcagagtgtagcagcagctacttaacctgactaccagcaagaaacctggaccaggctcccgaggcctcctacatctagtggtcncatccgagcgagggccctacgtggaccactacccgagacgtacggtcaggtgacgtaggtcgggtcagggacagtaccttnaccgttcctacaccatacagacagtacgtggacgccgtagtaacgtagtttgacgtagttattagtacgtgtacagtacgtagtagtggtacgtcgtacgtaccggtacgttcggaccgtacggaacgtaggtaacgaactacggaaacgtaccgtggacgtacgtacgactacgtacgtcgttacg

SEQ ID NO: 126231 - DNA, 756 bp, Homo sapiens
  misc_feature: GYAE6OF02IJT8O.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagccgctcagttaggacccagagggaaccatggaaaccccagcgcagcttctcttcctcctgctactctggctcccagataccaccggagaaattgtgttgacgcagtctccaggcaccctgtctttgtctccaggggaaanagccacctctctgcagggccagtcagagtgttagcagcagctactacgtgacagcaagaacctgccaggcctccgaggcctcctcatctagtggtcgctactccagcgacgggtccaagtggctaactaccccgaagaaccgtaggtcgtaaggtcggacgtaagggttcgggtacgtacgggaactacggtaacctttacgaccttcctacaccgtaatacgagaccaagtacgtacggacgtacccgtaggaaacgtttagttttacggacgttaaggttacgttaactttaacttgggtaactaggtaccgtaagggtttacggttacgggttaaccgtaccgttaacccgtaaacccgggttaaccggggttttacccgggaaaccccgggtaaaaccgggggtaaaacccgtaaccgggggttaaacgggtaaaaaccgttaaaccggtaaaaaacccgggttaacgttaacgggggttaccggttaaccgttaccggaacccgtaaccgttaacccggtttaccgttaccggtttacccgtttaacccg

SEQ ID NO: 126232 - DNA, 212 bp, Homo sapiens
  misc_feature: GYAE6OF02HTL93.4.38.D05.1.454.CMB.1.raw
  modified_base (211)..(212): a, c, t, g, unknown or other
  misc_feature (211)..(212): n is a, c, g, or t
tcagagcactgtagcacgaccggtgctcgatttagtatctgatagttgggtttgggcggtgctcgatttagtatctgatagttgggtttgggggaagaggaagactgaccggtccccccaggagttcaggtgctgggcacagcggccctgggctgcctggtcaaggactacttccctacagtgctctgagcgggctggcaaggcgcatagnn

SEQ ID NO: 126233 - DNA, 699 bp, Homo sapiens
  misc_feature: GYAE6OF02IQOF8.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaacggcccggggagtctctagaagatctccgtgtaagggttctggatacattctttaggacctactggagtcggcgtgggtgcgccgagggtcggacccggggaaaggtccgtagggaagtggagtggggatcgatctatcgtgagtcgactctagactaccgagtactacgacgttcccgtacgttacggaacggtccgaccgtcctaccttctacgacgaccgaacaacgtccatcgacgccacccgtaccctaccgtgaccgaggtcggacgccgacgtaccgtacggaaccggtcccgtacgggaaccgaccgaccgaccctaaagttaaccgttaactttaccggttacggtaaccggtaaacccggtaaaaacccgtaacggttaacggaaccgttaacggtaccccgttaaccccggtaacccccggttaaacgggttacccttttaaccgggtaacccggttacccgggtaacccggggggg

SEQ ID NO: 126234 - DNA, 225 bp, Homo sapiens
  misc_feature: GYAE6OF02IMAGQ.4.38.D05.1.454.CMB.1.raw
  modified_base (213)..(225): a, c, t, g, unknown or other
  misc_feature (213)..(225): n is a, c, g, or t
tcagagcactgtagcacgaccggtgctcgatttagtatctgatagttgggtttgggcggtgctcgatttagtatctgatagttgggtttgggggaagaggaagactgaccggtccccccaggagttcaggtgctgggcacagcggccctgggctgcctggtcaaaggactacttccctacagtgctctgagcgggctggcaaggcgcaatagnnnnnnnnnnnnn

SEQ ID NO: 126235 - DNA, 516 bp, Homo sapiens
  misc_feature: GYAE6OF02IRE8L.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaagggaagagccaccctctcctgcagggccagtcagagtgttagcagcagctactaacctggtaccagcagaaacctggccaggctcccaggctcctcatctatggtgcatccagcagggccactggcatcccagacaggttcagtgcaggtggtctgggacagacttcactctcaccatcagcagctggacgacctgaagtattttgctagtcgttattactgtcagcgagtgtggtagctcacggtaccgttcggaccgaagggaccaaggtacggaaactaccgaaacgaacgttgtacggctggactaccgatcgtgtcc

SEQ ID NO: 126236 - DNA, 518 bp, Homo sapiens
  misc_feature: GYAE6OF02F5982.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaacctggtaccagcagaaacctggccaggctcccaggctcctcatctatggtgcatccagcagggccactggcatcccagacaggttcagtggcaggtgggtctgggacagacttcactctcaccatcagcagactggagcctagaagtatttgctagttgtattactgtcagcagttgtgtgctcaccgtacgttcggccgaagggaccgaaggtaggaaataccaaacggaacgtaggtggtctcggaccacgtacgttcctagttcc

SEQ ID NO: 126237 - DNA, 527 bp, Homo sapiens
  misc_feature: GYAE6OF02JIZC1.4.38.D05.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttaaccngtaccagcagaacctggccaggctcccaggctcctcatctatggtgcatccagcagggccacgtggcatcccagacaggttcagtgcagtggtctgggacagtacttcactctcaccatcagcagactggacgccgtgaagtagttttgcagtgtattactgtcagcagtgtgtagctcaccggacgttcggacgaacgggaccgaaggtaggtaaacgtaccaaacggtaactcggtacggtcgtacgaccgacctacgtccgtacgttaccg

SEQ ID NO: 126238 - DNA, 566 bp, Homo sapiens
  misc_feature: GYAE6OF02HFRXU.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgccccgggaaaggcctggaatggatggggatcgatctatcctgatgactctgataccagatacagtccgtcttcgaacggccgcgtcaccttctcagccgacaagtccatcagcacccgcctacctgcacgtggagccgagcctaggaaggcccgtacgggacctaaggccgtacccattaattaactttacgtggtgaaccggaaaaacctaggttaacggacacgcctaccaaccccggttaaggtacctttacggaccttacgtaccggggg

SEQ ID NO: 126239 - DNA, 583 bp, Homo sapiens
  misc_feature: GYAE6OF02IGKCB.4.38.D05.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggccaccctgtctttgtctccgaaggggaaanacgccaccctctccngccagggccagcagagtgtagcagcagctactaaccnggtaccagcaagaaccnggaccaggtcnccgagctcctcatctatggtnctacnccagcgacgcacgcgactacaccgagtacncgtagagcggcgtagggtcggaggtacggactacgtcctacactacaccaacacncgagacgacgacgtcgagtacgtaagtaagtttagtttgtaacgtatttaacgtacgtgacgaagtgtagggtgtagtacgacgtaccgaccggttcgtaacggaacgaacgggacggaaggtaacgtaaacaacggtaaacgaggtcggtcgtagaccgtaacaacgtacgtcttactaccgttacg

SEQ ID NO: 126240 - DNA, 519 bp, Homo sapiens
  misc_feature: GYAE6OF02HEIJN.4.38.D05.1.454.CMB.1.raw
  modified_base (388)..(388): a, c, t, g, unknown or other
  misc_feature (388)..(388): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggatctctgaagatctcctgtaagggttctggatacattctttaggacctatggatcggctgggtgcgccaggtcgacccgggaaaggccgtggaatggagtggggatcatctatcctgatgactctgatacagatacgacgtccgtcttacgagccgcgtcctaccttcncgacgccgacaacgtcatcacgcaccgcctactgcagtgagcagctgacgcncgacncgcgcatatatactgcgacgaaaccagtacgcagcctaccgacccgtaaggtcctttagaccttacggtacggg

SEQ ID NO: 126241 - DNA, 526 bp, Homo sapiens
  misc_feature: GYAE6OF02F3ZX4.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccggggaaaggcctggaatggatggggatcatctatcctgatgactctgataccagatacagtccgtccttcgaaggccgcgtcaccttctcagccgacaagtccatcagccacccgcctacctgcagtggagcacgcctagaacggcctacggacacgcgccatatattactgtagacgaaaaccagtacgcacgcctccgacccgtaaggactttagacctacgtccgggg

SEQ ID NO: 126242 - DNA, 642 bp, Homo sapiens
  misc_feature: GYAE6OF02G1W1Z.4.38.D05.1.454.CMB.1.raw
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
tcagagcactgtagcacgaccggtgctcgatttagtatctgatagttgggtttggggagagctgctcagttaggacccagagggaaccatggaaaccccagcgcagcttctcttcctcctgcctactctggctcccagataccaccggagaaattgtgttgacgcagtctccaggcaccctgtctttgtctccgaggggaaanagccaccctctcctgcagggccagtcagagtgtagcagcagctacttaacnggtaccagcagaacctggccaggctcccaggcctcctcatctatggtncatccagcacgggccacgtggcactcccagactaggttcaggtggactaggttgggtctagggactagtaccttcgacgttctacacctatccaagccgagtaccgtggactaccgtaggtaacgttagtttgacgttagttagttaacgttacgttgtacgtacgacgttaggttcgttacgggttaccgccgttaccggtaacccgggttacggttaccgggaacccgtaaacggggtacccgtaaacgggttacgggtaaaacgttaccgtaaaaccggtaacgttacggtacgggtacttacggaccctaaccgtacgttaccgtacgtttacccg

SEQ ID NO: 126243 - DNA, 562 bp, Homo sapiens
  misc_feature: GYAE6OF02GZJSW.4.38.D05.1.454.CMB.1.raw
  modified_base (276)..(276): a, c, t, g, unknown or other
  misc_feature (276)..(276): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctatggatcggntgggtgcgccaggtcgcccgggaaaggccgtaggaatgggatggggatcgatctatcctgatgactctgactaccgagatacagtccgttctacgaacggccgcgtcctaccttctcacgccgaacaacgtccatcagccaccgccctaccgtcgcaggtcggacgcgacgccgtagaacgggcctacggacacgccgaccagttaacttattacgtgtacgaacgaaaaccagtagacacgaccgtaccaacccggtaagtacctttacgacgtaccggtacggg

SEQ ID NO: 126244 - DNA, 597 bp, Homo sapiens
  misc_feature: GYAE6OF02H3ASW.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccgggagtctctgaagatctcctggtaaggttctggatacattctttaggacctactggatcggctgggtgcgccaggtgacccgggaaaggccgtaggaatggagtggggatcgatctagtcctgatgactctgataccagatacgacgttccgtaccgttcgaacggccgtcgtcctaccttcgtcgacgccgacaacgtccatcgacgccaccgcctaccgtgcgtaggtacggacgcacgaccgtaggaacggccgtaccggacgacggtaccgacctataacttaacgttacgtagtacggtaaccgaaaaccgtagaacgacacgacctaccgtaaccccggtaaggttacctttacggtaccgtacggtaaccgggg

SEQ ID NO: 126245 - DNA, 218 bp, Homo sapiens
  misc_feature: GYAE6OF02FW44Q.4.38.D05.1.454.CMB.1.raw
  modified_base (211)..(218): a, c, t, g, unknown or other
  misc_feature (211)..(218): n is a, c, g, or t
tcagagcactgtagcacgaccggtgctcgatttagtatctgatagttgggtttgggcggtgctcgatttagtatctgatagttgggtttggggggaagaggaagactgacggtccccccaggagttcaggtgctgggcacagcggccctgggctgcctggtcaaggactacttccctacagtgctctgagcgggctggcaaggcgcatagnnnnnnnn

SEQ ID NO: 126246 - DNA, 522 bp, Homo sapiens
  misc_feature: GYAE6OF02HH6J4.4.38.D05.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (424)..(424): a, c, t, g, unknown or other
  misc_feature (424)..(424): n is a, c, g, or t
  modified_base (495)..(495): a, c, t, g, unknown or other
  misc_feature (495)..(495): n is a, c, g, or t
tcagagcactgtagcacgaccggtgctcgatttagtatctgatagttggggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangcccaccctctcctgcagggccagtcagagtgttagcagcagctacttaactggtaccagcaagaacctggccaggcctccgaggctcctcatctatggtncatccagcgacggccacgtggcatcccagacaggttcagtgcagtggctggganagctnactctcaccatcancagactggacgctagaagtatttgactagttagtattacgtgtacagntagttgtggtagtctcgacgtacgttcggaaccgaggacctaaggtacggaaactacgtaaacgacgtggngtacgtcacgtaccattcgtacgttac

SEQ ID NO: 126247 - DNA, 550 bp, Homo sapiens
  misc_feature: GYAE6OF02IPMV7.4.38.D05.1.454.CMB.1.raw
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctgggaatggatggggatcatctatcctgatgactctgataccagatacagtccgtcttcgaaggccncgtcaccttctcngccgacaagtccatcagccaccgcctacctgcagtgagcacgcctaggaacggccctcggacacgccgacctatactattactgtacgaccgaaaacctaggtaacgccaacgccttacccgaaccccggttaaggtaccgttttacgaccgtacgtaccggggg

SEQ ID NO: 126248 - DNA, 251 bp, Homo sapiens; identical to SEQ ID NO: 126138
  misc_feature: GYAE6OF02IVFKO.4.38.D05.1.454.CMB.1.raw
  modified_base (249)..(251): a, c, t, g, unknown or other
  misc_feature (249)..(251): n is a, c, g, or t

SEQ ID NO: 126249 - DNA, 545 bp, Homo sapiens
  misc_feature: GYAE6OF02GMQNL.4.38.D05.1.454.CMB.1.raw
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
  modified_base (429)..(429): a, c, t, g, unknown or other
  misc_feature (429)..(429): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagcccaccctctcctgcagggccagtcagagtgttagcagcagctacttaacctggtaccagcagaacctggccaggctccaggctcctcatctatggtncactccagcgaggccacgtggcatcccagacaggtcaggtggcaggtgggtctagggactagaccttcactcncacatcagcagactggacgtccgtagaacgtgtttgactagtgttattctgtacngctaggtgtgtacgtcgtcgaccgtacgttccggaccgtaacgggaccgaagggtacggaaataccgtaaacggacgttacggtaggtactacggacctacgacttccgtgttacc

SEQ ID NO: 126250 - DNA, 793 bp, Homo sapiens
  misc_feature: GYAE6OF02IIRET.4.38.D05.1.454.CMB.1.raw
  modified_base (200)..(200): a, c, t, g, unknown or other
  misc_feature (200)..(200): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaattgtgttgacgcagtctccaggcaccctgtctttgtctccgaggggaanacgccacctctcctgacgaggccagtcagagtgttagcagcagctacttaacctggtaccagcagaacctggccaggcctccgaggctacctcacttctagtggcgactactccagcgaacgggccctaagtcggacctacgtaccccaggtaccgtaaggttccaaggtggtaccgaagggtttcggggttcctacgggggaaaccttagggtaaccgtttccgaacccttccgtaaccacccgtaattccgaacgacgtaacggtaacgtccggtaacggtacccgttaaggaaacgtttacttttcggacgttaacgggttactttaacgtttacgttaacggtcccgtaaagttaccgttaaggtttacgggttacgggtaacctacccggttaaccgtaaaccccgggtttacccggtttaaccggggaacccggttaaaccggggaaaccccggtttaaggggtaaaccggttaaaaacccgggttaacctaaaaaacccgggtaaccggtttagggtacccggggttaaccctacgggtaacccctaacccggtttaaaccgttccggtttaaccgttttaccccg

SEQ ID NO: 126251 - DNA, 628 bp, Homo sapiens
  misc_feature: GYAE6OF02G45WN.4.38.D05.1.454.CMB.1.raw
tcagagcactgtagcacgaccggtgctcgatttagtatctgatagttgggtttgggggaggtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagccggggagtctctgaagatctcctggtaaggttctggatacattacgtttaggacctactggatcggtcgtgggtcgcgccgagggtcggaccccggggaaaggcctggaatggaacgtgggatcgatccgttatccgtagatcggtactcgtgaactaccgagaatacgacgttccgtacttacgaacggccgtcgttcctaaccttctacgaccgaccggtaacgaacgtccaagtccacggtaccaacccgtcccttaaccgcgtacgtaggtaggaaccgcgtacggcctaacgggaacggtcccgtagaccgagccgaccgattaacgtagttacgtgtacgtaacgaaacctacgagtccaacgctaacccgtacccggtaagtaccgttacgtaccgtagtaccgggg

SEQ ID NO: 126252 - DNA, 525 bp, Homo sapiens
  misc_feature: GYAE6OF02HL8E9.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaagggaaagagccaccctctcctgcagggccagtcagagtgttagcagcagctacttaacctggtaccagcagaaacctggccaggcctcccaggctcctcatctatggtgcatccagcagggccacgtggcatcccagacaggttcagtggcagtgggtctgggacagacttcactctcacatcagcagactggagccgtagaagtattttgacgtagtgttattactgtacagctagtgtggtagcttcgaccgtacgttcgacgaacggaccgtaaggtaggaaactacgaaacgtaacgtagtaggtctacgaccactactctgttacc

SEQ ID NO: 126253 - DNA, 651 bp, Homo sapiens
  misc_feature: GYAE6OF02G4ULG.4.38.D05.1.454.CMB.1.raw
  modified_base (499)..(499): a, c, t, g, unknown or other
  misc_feature (499)..(499): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggatctctgaagatcctcctagtaagggttctggactacattcgttaaggacctacgtggactcggcgtgggtcgcgccgaggtcggacccgggaaaggcctggaatggagtgggatcatctatccgtagactcgactcgtagactacagtatacgacgttccgtactacgacggccgccgtcctaccttcacacggccaacgaacgtccaatccgacgccacccgcctaccgtggaccaggtgacaccgacgcgttacggaaccggtcccgtagggtaaccncggacccgtactaaacgtttacgtttaacttaccgttaggtaaccggtaaaccgtaaaaaccggtacggtaacgtaaccggacctaacccgtacccggtaaaccccgggttaagttacccggtttacggtaacccgtagggtaacccggggg

SEQ ID NO: 126254 - DNA, 547 bp, Homo sapiens
  misc_feature: GYAE6OF02IPHBI.4.38.D05.1.454.CMB.1.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
  modified_base (293)..(293): a, c, t, g, unknown or other
  misc_feature (293)..(293): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttagcagcagctacttaaccnggtaccagcagaaacctggaccaggcctcccaggctccncatctatggtgcatccagcaggccactgacatcccagacaggttcagtggcaggtggtctgggacagtacttcactctcacatcancagactgganccgtagaagttattttcgacgtagtacgttattactgtacagcgtaggttgtggtacgtctccgtaaccggtacggtttaccggaccgaagggaccgaagggtaggaaactaacgaaacgtaactaggtacggactacgaccacctactcgtgttacc

SEQ ID NO: 126255 - DNA, 594 bp, Homo sapiens
  misc_feature: GYAE6OF02II3SV.4.38.D05.1.454.CMB.1.raw
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
tcagagcactgtagcacgaccggtgctcgatttagtatctgatagttgggtttgggggtaggtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctggtgcgccaggtcggcccgggaaaggccgtggaatggatggggatacatctatccngatgactntgactacagatacagtccgtcttcggaacgccgccgtcaccttctcgagacccgacaaacggtccactcacgccgacccgcccttacctcgtcaggtggacgccgagtcccgtagaaccggtccgtaccggacgacgtaccgaccacttaacttactttactcgtacggtaccggaaaacccgtagtacgaccgtagacctacccgaacccgggttaccgtacgtttacgtaccgtacggtacccggggg

SEQ ID NO: 126256 - DNA, 634 bp, Homo sapiens
  misc_feature: GYAE6OF02GE1DK.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtatccaagggaagagccaccctctcctgcagggccagtcagagtgtagcagcagctacttaacctggtaccagcagaaacctggccaggcctcccgaggcctccgtacactctagtggtgcacgtccagacgacgggccacgtggacacgtcccagaccgtaggttcagtgacgtaggtcgggtcgtgggaactagtacttacgacctcacaccatacagcgaagtacgtggacgtccgtagaaacgtattttcgacgtaggttagttacttacgtacgtcgtagtcgtaggttcggtagggttacgtaccgttaccgtaaccggtaccggtttaccgggacccggtaaacggggtaacccgtaaggggtaacggtaaacgtaaccggaaaacggtaacggttagggtacggtacgtcggaaccgtacgtacgttcgtacgttaccg

SEQ ID NO: 126257 - DNA, 576 bp, Homo sapiens
  misc_feature: GYAE6OF02GJ4F6.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccgaggtcggaccccgggaaaggccgtggaagtggagtggggatcgatctatcctgatgactctgacaccagatacagtccgtccttcgaacggccgcgtccaccttctcacgccgacaagtcccatccacgaccaccctccctaccgtgcgacggtgacgtcagcccgtaggacggtccgtcggaccgtacgccggccaagttacttattacgtgtacgacgtaaaaccgagtaacgcgacgtccgtaccgaaccccgttaaggtccgtttacgaccgtcggtaccgggg

SEQ ID NO: 126258 - DNA, 509 bp, Homo sapiens
  misc_feature: GYAE6OF02F3DHN.4.38.D05.1.454.CMB.1.raw
  modified_base (283)..(283): a, c, t, g, unknown or other
  misc_feature (283)..(283): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtncgccaggtgcccgggaaaggcctggaatggatggggatcatctatcctgatgactctgataccagatacagtccgtcttcgaaggccgcgtcaccttctcagccgacaagtccatcagcaccgcctacctgcagtggagcagcctgaacggcctacggacagccgccatatattactgtcgacgaaacagtacgcacgctacacccgtaagacttgactagtcggg

SEQ ID NO: 126259 - DNA, 688 bp, Homo sapiens
  misc_feature: GYAE6OF02G6USF.4.38.D05.1.454.CMB.1.raw
tcagagcactgtagcacgaccggtgctcgatttagtatctgatagttgggtttggggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaggcccggggatctctgaagatctctagtaggttctggatacattcgttaggaccttagtggactcggcgtgggtcgcggcagggtcggacccggggaaggccgtagggaagtgggagtggggatcgatctatcctagactgtactcgtgaactaccgagtactacgacgttcccgtacgttaccggacggtaccgtcgtttacccacctttaccgtacgaccggtacccgtaacgtaacgtccgtacgtacgacgacctacccgtacccgtaccgtgacccgtaggtcggacgactacgccgtaagggaccgtccgacggtacgaccggtccgtaccgtaattacttacggtttaccgtcgggttaaccggaacccggttaaaccgacggttacggaccgtaacggtcccgtaaccccggttaacccgggttaagggttaccccttttacgggacccgttacgggtaccccggggg

SEQ ID NO: 126260 - DNA, 550 bp, Homo sapiens
  misc_feature: GYAE6OF02FR4EF.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtggacccgggaaaggccgtggaagtggagtggggatcatctatcctgatgactctgactaccagactacacgttcccgttcttacggaacggcccgcgtccacctttcctcgacgccgacaacgtccatcacgccacccgcctacctcgcaggtcggacgcacgccgtaggaacggtccgtccggacacgccgaccatatattacgtgacgacgaaacagtacgcacgctaccacccggtaagctttgactacgtacggg

SEQ ID NO: 126261 - DNA, 576 bp, Homo sapiens
  misc_feature: GYAE6OF02GWJRJ.4.38.D05.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
  modified_base (407)..(407): a, c, t, g, unknown or other
  misc_feature (407)..(407): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctcaggcaccctgtctttgtctccgagggggaaanacgcccaccctctcctgcagggccagtcagagtgtagcagcagctacttaacctggtaccagcagaaacctggccaggcctcccgaggctcctcatctatggtncatccagcgacgggccacgtggacactcccagactaggttcaggtgctaggtggtactcgggaacagtacttcgacttctacaccatcagcagactggacnctagatagtttgctagttgtacttacgtgtacagtctagtggtaggtacgtctaccgtaccgtacggttaccggaccgtaacgggacgtaagggtaacggtaaacgtaaccgaaaccggtaacgttcggtacggtcgtacggaccgtaacctagttccgttaggttacc

SEQ ID NO: 126262 - DNA, 609 bp, Homo sapiens
  misc_feature: GYAE6OF02IWRIX.4.38.D05.1.454.CMB.1.raw
tcagagcactgtagcacgaccggtgctcgatttagtatctgatagttgggtttgggggagtctccctcactgcccagctgggatctcagggctttcatttttctgtcctccaccatcatggggtcaaccgccatcctcgccctcctcctggctgttctccaaggagtctgtgccgaggtgcagctggtgcagtctggagcaggaggtagaaaaacggcccggggagtctctgaagatctctggtaagggttctggatacattctttaacggacctacgtggatcggctggggtgccgccgagggtcggacccggggaaaggccgtagggaagtgggagtgggggatcgtatctatcctgatcgactctagaactaccagatacgtacgtccgtccgttacgacggtccgcgtcctaccttcacgtacgaccgaacacgtccatccgagccacccgtaccctactgccagtcggacgcacgcgtaggacggtccgtacggacgacgccgactaattactattacgtgtacgaaccgaaaccgtagtacgacacggtaccgtaccggtaaccccgttaaggtacctttacggaccgttacggtaccggggg

SEQ ID NO: 126263 - DNA, 631 bp, Homo sapiens
  misc_feature: GYAE6OF02HEIYQ.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgtagcagcagctacttaacctgtaccagcagaaacctggccaggcctcccaggcctcctcatctagtggtcgcatccagcgaggccacgtggccatcccgagacgtaggttcaggtcggacgtagggtgggtacgtacgggactacgtaccttcgaccttctaccacctagtcgagcaaggtacgtggacgtccgtagaagttatttggacgttaggttagtaatttacgtcgtacgtagtcgtaagttggtacggtacgtccgttaccgaaccggttaccggttaccgggaacccggtaaacggggtaccgtaaaggggttacgaaaacgttaaccgaaaacggtacgttaggtacggtacgtacggtaccgtaacccgtagttacgttcgttacccg

SEQ ID NO: 126264 - DNA, 570 bp, Homo sapiens
  misc_feature: GYAE6OF02IZ8G9.4.38.D05.1.454.CMB.1.raw
  modified_base (525)..(525): a, c, t, g, unknown or other
  misc_feature (525)..(525): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctggtaagggttctggatacattctttaggacctactggatcggctgggtgcgcaggtgacccgggaaagcctggaatggagtggggatcgatctatcctagatgactgtagactacagatacacgtccgtcgtcgaaggccgcgtccgtaccttctacacgaccgaacaacgtccatcagaccaccgcctacctgacaggtacggagccaacggtcctaggaaccggccgtaccgggacacggtccgacctaattaacgtacttacgtgtacgaaccgaaacagtacganacgtactaccgtaacccgtaagtacttacgtacgtacgtacgggg

SEQ ID NO: 126265 - DNA, 500 bp, Homo sapiens
  misc_feature: GYAE6OF02I2KCD.4.38.D05.1.454.CMB.1.raw
  modified_base (237)..(237): a, c, t, g, unknown or other
  misc_feature (237)..(237): n is a, c, g, or t
  modified_base (434)..(434): a, c, t, g, unknown or other
  misc_feature (434)..(434): n is a, c, g, or t
  modified_base (476)..(500): a, c, t, g, unknown or other
  misc_feature (476)..(500): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccngtagcagcctcaccccgtaaggactttgactactgggccagggaccctggtcactgtctcctcagcctccaccaacgggcccatccggtccttccccctggccacccctcctccaacgacgccacccgtcgtcgggggccacgcgccggcccgtggggcctcggccgtggtaccaaggtacctacctttccctacgngtcgctcgtcgcggccgggtcgtggcgaacggcgcagtacgnnnnnnnnnnnnnnnnnnnnnnnnn

SEQ ID NO: 126266 - DNA, 590 bp, Homo sapiens
  misc_feature: GYAE6OF02IMQLK.4.38.D05.1.454.CMB.1.raw
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtgcagctggtgcagtctggagcagaggtagaaaaagcccggggagtctctgaagatctcctgtaagggttctggatacatctttaggacctactggatcggctgggtgcgccgagggtcggaccccggggaaaggcccgtagggaagtgggagtggggatcatctatcctgatgactctgataccagatacacgtccgtcttcgaacggccgcgtctaccttctcacgccgacaacgtccatcacgccaccgcctactgcaggtcgacgcgacgccgtaggaacggccgtacggacgacgccgacctaatacgttacttacgtacgtacggaaccgaaaacctaggtaacgacgtacgaccttacccgaaccccggttaaggtaccgtttacggaccgttaccggtacggggg

SEQ ID NO: 126267 - DNA, 501 bp, Homo sapiens
  misc_feature: GYAE6OF02HPJOY.4.38.D05.1.454.CMB.1.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (479)..(501): a, c, t, g, unknown or other
  misc_feature (479)..(501): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattacngtgacgaaaaaccngtagcagctcaccccgtaaggactttgactactggggccagggaaccctggtcactgtctcctcagcctccaccaacggcccatccggtccttcccccgtggccacccgtcctccgaacgtacgccacctcgtcgggggcacgaggccggcccgtggggctcggccgtcgggtacgaacgggaccttaccttccctaacgacgtcgtctctggacggcgggctcggacgaaggcgcatagnnnnnnnnnnnnnnnnnnnnnnn

SEQ ID NO: 126268 - DNA, 665 bp, Homo sapiens
  misc_feature: GYAE6OF02G8SBB.4.38.D05.1.454.CMB.1.raw
  modified_base (356)..(356): a, c, t, g, unknown or other
  misc_feature (356)..(356): n is a, c, g, or t
  modified_base (414)..(414): a, c, t, g, unknown or other
  misc_feature (414)..(414): n is a, c, g, or t
tcagagcactgtagcacgaccggtgctcgatttagtatctgatagttggggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaaggccggggagtctcgtgaagatctcctgtagggttctggatacattctttaggacctagtggatcggctgggtgcgccgaggtcggacccggggaaaggccgtagggaacgtgggagtggggatcatctactcgtgatgactntagactacagactacgtacgttccgttaccgttcggaacggccgtctacctaccttcncgacgaccgaactaacgcactcaacgccacccgtcctacgtcgacgtacggtacgacgtccacggtacccgtagggaacgggtcccgttacgggaaccgacgggaccgtaccgtaaactttaacgtaactttaccgtaggtaacggtaaaccggtaaaaccggtacgttaaacggacctaccggtaccttaaccccggaacccggtttaaaggttaccgtttacggtaccggttaccggtaacccgggggg

SEQ ID NO: 126269 - DNA, 594 bp, Homo sapiens
  misc_feature: GYAE6OF02F8V4K.4.38.D05.1.454.CMB.1.raw
  modified_base (424)..(424): a, c, t, g, unknown or other
  misc_feature (424)..(424): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagacgccaccctctcctgcagggccagtcagagtgttagcagcagctacttaacctggtaccagcagaaacctggccaggctcccaggctcctcatctatggtgcatccagcgacgggccacgtcggcactccccgagaccgtaggttcaaggtcggacgaggtcgggtctgggaactagtacttcactctacacatcagcagacgtggacgtcgtagaagttntttgctagttgtacttacgtgtcagtctaggttgtaggtacgtccgttacgtaccggtacgttaccggaccgtaacggggtaccgaagggtaacggaaacgttaaccggaaaaccgtacgttaggttacggtacgtacggacccgtaaccgtacgttaccgtgttacccg

SEQ ID NO: 126270 - DNA, 713 bp, Homo sapiens
  misc_feature: GYAE6OF02JKFSC.4.38.D05.1.454.CMB.1.raw
  modified_base (202)..(202): a, c, t, g, unknown or other
  misc_feature (202)..(202): n is a, c, g, or t
  modified_base (256)..(256): a, c, t, g, unknown or other
  misc_feature (256)..(256): n is a, c, g, or t
  modified_base (673)..(673): a, c, t, g, unknown or other
  misc_feature (673)..(673): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangcctaccctctcctgcgagggccagtcaggtatgtacgcagcagctacttaccnggtacagcaagaacctggaccaggcctaccgaggcctccgacatacctagtcgatcggactacgtccggaacgtacgggaccctaggttacggcctaacctaccccggagtacccggtaacggtttcgaacggggttcggaccggttaggggtttcggggtacgtacgggggaactacggtaccgtttaccgaccgtttcccaccgtaaccgtacgtaccctaaccgggtacgtaaccccggtaacggtaccggtaccgttaacgggttaacggttttacgttacggttaacgtttaaccggttttaactttaccggttcgtacgtacgtccgtaaggttacccgttaggaacctcggttccggacctttacgacgtccgttacggtacgttccgggacggtacggtacgagggtanacgtacgtacaacggtatcggacgtcgtacgcctagtacg

SEQ ID NO: 126271 - DNA, 615 bp, Homo sapiens
  misc_feature: GYAE6OF02FWBO6.4.38.D05.1.454.CMB.1.raw
  modified_base (403)..(403): a, c, t, g, unknown or other
  misc_feature (403)..(403): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctgaagatctcctgtaagggttctggatacatcttaggacctactggatcggctgggtgcgccaggtcgacccgggaagccgtggaatggagtggggatcgatctatctgatgactctagactaccagactacacgtccgtcgttacgacggccgcgtcctaccttctacacgaccganaacgtccatcgacgccgacccgtccctaccgtcgcgtacggtcggacgcgtacgaccgtacggacggtccgtacgggtacgacggtaccgacctaagttaactaacgtttacgtacggttaacgaaccggtaaaaccgcggttaacgacgtacgtacccgtaacccggacccggttaaggttacctttacggacgttaccggtaacccgggg

SEQ ID NO: 126272 - DNA, 749 bp, Homo sapiens
  misc_feature: GYAE6OF02IULFD.4.38.D05.1.454.CMB.1.raw
  modified_base (356)..(356): a, c, t, g, unknown or other
  misc_feature (356)..(356): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaacggcccggggagtctcgtgaagatctccgtgtaagggttctggatactatctttaggacctactggactcggcgtgggtgcgccgagggtcgacccgggaaggccgtgggagtgggagtggggactcatctatcctgagtgactntagaactaccgagactactacggttcccgtaccgttacgaacgggtccgtacccggttacctaccctttacgtaccgtaacccgtaaccccgggaacctaaaccggttacccctaacgttaccgacgtaccccgtaccccgtaccccttaacccgttacggacccgtaacgggtcgggaacggaccaccggtaccgtaacgggtaaaccggggccccgttaccgggaaaccgagggacccctaacgttaactaaacgtttaacgtttaaccgtacgtaacggtaacccgtaaaacccgttacggtaacgtacccgtaaccggtaccgttaaccccgtaacccgggttaccgggttaaaccctttaccggtaaccgtacccggtaacccggggg

SEQ ID NO: 126273 - DNA, 638 bp, Homo sapiens
  misc_feature: GYAE6OF02GPETX.4.38.D05.1.454.CMB.1.raw
  modified_base (249)..(249): a, c, t, g, unknown or other
  misc_feature (249)..(249): n is a, c, g, or t
  modified_base (353)..(353): a, c, t, g, unknown or other
  misc_feature (353)..(353): n is a, c, g, or t
  modified_base (413)..(413): a, c, t, g, unknown or other
  misc_feature (413)..(413): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctgaagatctcctggtaagggttcnggatacattctttaggacctactggatcggctgggtgcgccgaggtcggacccgggaaaggccgtaggaagtgggagtggggatcgatctatcctagatgactntagataccagactacacggttccgtccttacggaacggccgtccgttcctacccgtttcnctaacggccgaacaacgtcccatacacgccacccgcctaccgtcgactaggtcggacgcgacgtccgtacggaacggtcccgtacgggaccgacggaccgacctaattaacttacgttaccgtggtacggaacccgaaaaccgtacgtaacggacctaaccgtccgtaccccgtaacccgggttaacggttaccgtttacggtacccggttacggtacccggggg

SEQ ID NO: 126274 - DNA, 534 bp, Homo sapiens
  misc_feature: GYAE6OF02GQ1AC.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtcagagtgtagcagcagctacttaacctggtaccagcagaaacctggccaggctcccaggcctcctcatctagtggtgcatccagcagggccatggcacgtcccagacaggttcagtggcaggtggtctgggacagacttcactctcaccatcagcagactggacgcctagaagtatttgctagttgtattactgtacagcgtagtgtagtagcgtcgacggtacgttcgggacaacgggtaccgaagggtacggaaacgtacgaaacgtaacgtacgtacgcgtacgtaccaccgtactcgtagttaccg

SEQ ID NO: 126275 - DNA, 546 bp, Homo sapiens
  misc_feature: GYAE6OF02H16CQ.4.38.D05.1.454.CMB.1.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (514)..(514): a, c, t, g, unknown or other
  misc_feature (514)..(514): n is a, c, g, or t
  modified_base (519)..(526): a, c, t, g, unknown or other
  misc_feature (519)..(526): n is a, c, g, or t
  modified_base (528)..(546): a, c, t, g, unknown or other
  misc_feature (528)..(546): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattacngtgacgaaaaccngtagcagctcacccgtaaggactttgactacgtgggccgagggaaccctggtcactgtcctcctcacgcctccaccaacggcccacgtccgtccttccccgtcggccaccccgtcctaccaaacgacgccgtacctcggtacgggggccaacgacggcccggtcccgtcgggccgtcgccgtcggtacgaaacggtaccttacccgttacccgtaacgtacgtcgtactcgtcgggacggcggggtccgtcgggaccgtaacgggccgcgaactagngcgannnnnnnngnnnnnnnnnnnnnnnnnnn

SEQ ID NO: 126276 - DNA, 559 bp, Homo sapiens
  misc_feature: GYAE6OF02JE7KM.4.38.D05.1.454.CMB.1.raw
  modified_base (238)..(238): a, c, t, g, unknown or other
  misc_feature (238)..(238): n is a, c, g, or t
  modified_base (529)..(534): a, c, t, g, unknown or other
  misc_feature (529)..(534): n is a, c, g, or t
  modified_base (536)..(537): a, c, t, g, unknown or other
  misc_feature (536)..(537): n is a, c, g, or t
  modified_base (539)..(559): a, c, t, g, unknown or other
  misc_feature (539)..(559): n is a, c, g, or t
tcagagcactgtagcacgaccggtgctcgatttagtatctgatagttgggtttaggtgcccgggaaaggcctggaatggatggggatcatctatcctgatgactctgataccagatacagtccgttcttcgaaggccgcgtcaccttctcagccgacaagtccatcagcaccgcctacctgcagtggagcagcctgaaggcctcggacagcgccatatattactgtagacgaaaaccngtagcagcctacaccccgtaaggctttgactacgtcggggaccagggaaccctggcacgtcgtctcctcacgcctccaaccgaacggccctacgtccggtccttcccccgtggaccaccctccgtccaaagcgacctaccgtcgtacgggggccaacgacggtccccggccgttgggccctacggtcccgtagggtaccaaacggtaaccccgtttaacccgtttaccccctaacgtaacggtcgtctccgtaggtacggcgggtacttcggaccaacggcgacagtagannnnnncnncnnnnnnnnnnnnnnnnnnnnn

SEQ ID NO: 126277 - DNA, 696 bp, Homo sapiens
  misc_feature: GYAE6OF02JDPQQ.4.38.D05.1.454.CMB.1.raw
  modified_base (197)..(197): a, c, t, g, unknown or other
  misc_feature (197)..(197): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggancagaggtagaaaaagcccggggatctctgaagatctcctggtaaggttctggatacatctttaggacctactggatcggcgtgggtagcgccagggtcgaccccggggaaaggtccctgggaactgggagtggggatcgaatctaatcctgatagactctgatacagatacacgtcctacgtacgaaggccgcgtcctaccttctcgacgacccgaactaacgtcccatccgacgtaccgacccgacccgtaccgttacggaccgtaggttaccgggacgtaccacggtacccgtaggaaaccgggtcccgtaccggggtaacgaacggacccggtaccaaacgtttaacgttaaccgttttaaccgtacggttacggaaaacccggtaaaaaccctaaggggttaaccgacccgtaacggtaaccccgtaacccggtaacccccgggtttaaagggttaacccgttttaccgaaccggttaccgggtaaccccggggg

SEQ ID NO: 126278 - DNA, 649 bp, Homo sapiens
  misc_feature: GYAE6OF02IVNG5.4.38.D05.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctcgaggggaagngccaccctctcctgcagggccagtcagagtgttagcagcagctacttaaccnggtaccagcagaacctggccaggctcccaggctcctcatctagtggtncatccagcagggccacgtggctactcccagacctaggttcaggtgacgtaggtcgggtctagggactacggtacttacgactcctacaacctactcacgcacgacgtaggacgccgtagaagttagtttacgacgtagttagttaacgttacgttgtacgtacgtcgttacgggttggttacgggttacgaccgtttacccgaaccgggttaccggttaccgggaaccggtaacggggtaccggtaaagggttaaccgggtaaacgttaaccggtaaaacggtaacgttacgggtacggtaccgttacggtaccgtaacccgtacggtttaccgttacggtttaaccg

SEQ ID NO: 126279 - DNA, 213 bp, Homo sapiens
  misc_feature: GYAE6OF02HQ9LZ.4.38.D05.1.454.CMB.1.raw
  modified_base (208)..(213): a, c, t, g, unknown or other
  misc_feature (208)..(213): n is a, c, g, or t
tcagagcactgtagcacgaccggtgctcgatttagtatctgatagttgggtttgggcggtgctcgatttagtatctgatagttgggtttgggggaagaggaagactgacggtccccccaggagttcaggtgctgggcacagcggccctgggctgcctggtcaaggactactccctacagtgcctgagcgggctggcaaggcgcatagnnnnnn

SEQ ID NO: 126280 - DNA, 674 bp, Homo sapiens
  misc_feature: GYAE6OF02GVYZJ.4.38.D05.1.454.CMB.1.raw
  modified_base (202)..(202): a, c, t, g, unknown or other
  misc_feature (202)..(202): n is a, c, g, or t
  modified_base (321)..(321): a, c, t, g, unknown or other
  misc_feature (321)..(321): n is a, c, g, or t
  modified_base (447)..(447): a, c, t, g, unknown or other
  misc_feature (447)..(447): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcattctccaggccaccctgtctttgtctccgaggggaancgcccaccctctcctgcgagggccagtcagagtgtagcagcagctaacttaaccgtggtaccagcaagaacctggaccaggcctccccgaggtcctcccgtacacttcctagtgggtcncctatcccgagccgacgggcccacgtggacctactccccgaaggtaccgtacggtttccaaggttcggaccgtagggttcggggtcgtaggggaactaggtacgttccacgttccctacaaccgtntaccgagacccgtaacgtcccgtgacctagtccgtagtacgtgttacgttcgttgactttagttttacttacgttgtactacttacgtaattggtcggttaccgaccccgtaccgtaaccggttccggaaccgtaagggaacccgtaaggggtaacgtaaacttaaccggaaaccggtaacgttgggtacggtaccgttacgaacccgttacgttacgtcgttaccg

SEQ ID NO: 126281 - DNA, 682 bp, Homo sapiens
  misc_feature: GYAE6OF02JHAEP.4.38.D05.1.454.CMB.1.raw
tcagagcactgtagcacgaccggtgctcgatttagtatctgatagttgggtttggggtaggagctgctcagttaggacccagagggaaccatggaaacccagcgcagcttctcttcctcctgctactctggctccagataccaccggagaaattgtgttgacgcagtctccaggcaccctgtctttgtctccgaggggaaagacgccaccctctcctgcagggccagtcagagtgtagcagcagtctacttaccgtggtaccagacacgaaacctcggaccaggcctcccgaggcctcctctattctatggtgacctagtcccgagccgaggggcccacgtggaccacttaccccaaggtaccgacggtttacaggtcggccgtgggttaccgggttcgtcggggaactacgggtacctttccgacctcttacccgaacccgtacgtccgtaacgaccgtaacggtaccgtacggacgtaccgttaggtaacgtttacgtttgacgttacggtttagtttaaccttacgttttacgacgtacgttaggttaggttcgggtaacgtccgtaccgacccggtaacggttcggaaccggaacggtaccgtaacgggtaaggaacgtaaccgtaaggacgttacggtacggtagtcgaccgaccgtacgtacgttcgtaccgttac

SEQ ID NO: 126282 - DNA, 571 bp, Homo sapiens
  misc_feature: GYAE6OF02IOQBE.4.38.D05.1.454.CMB.1.raw
  modified_base (156)..(156): a, c, t, g, unknown or other
  misc_feature (156)..(156): n is a, c, g, or t
  modified_base (242)..(242): a, c, t, g, unknown or other
  misc_feature (242)..(242): n is a, c, g, or t
  modified_base (409)..(409): a, c, t, g, unknown or other
  misc_feature (409)..(409): n is a, c, g, or t
  modified_base (538)..(539): a, c, t, g, unknown or other
  misc_feature (538)..(539): n is a, c, g, or t
  modified_base (542)..(545): a, c, t, g, unknown or other
  misc_feature (542)..(545): n is a, c, g, or t
  modified_base (547)..(551): a, c, t, g, unknown or other
  misc_feature (547)..(551): n is a, c, g, or t
  modified_base (553)..(556): a, c, t, g, unknown or other
  misc_feature (553)..(556): n is a, c, g, or t
  modified_base (559)..(571): a, c, t, g, unknown or other
  misc_feature (559)..(571): n is a, c, g, or t
tcagagcactgtagcacgaccggtgctcgatttagtatctgatagttgggtttaggtgcccgggaaaggcctggaatggatgggggatcatctatcctgatgactctgataccagatacacgtccgtccttacggaacggccgcgttccaccttcncacgccgaacaagtccatcagccaccgcctacctgcagtggagcacgcctggaacggccgtacggacagccgaccattatattacngtacgaacaaaaccagtagcagccaccgtaacccgtaaggtacttcgaacgtaccgcggggccgaacggaccctggtacacgttcgtcctctccacgcctaccaaccgaaccggccctacgtccgtcccttaccccgtcggccctacccttccgtaaccacggaccnccgtaccgtcggtcggggctaacggcggccggccgtcggctccgcgtacggtacaaggtaccttacctccgacgtagtcgccgttcgagggcgtacgggcgtacggacggaacggcgtacgtacgacgnnacnnnncnnnnncnnnngcnnnnnnnnnnnnn

SEQ ID NO: 126283 - DNA, 551 bp, Homo sapiens
  misc_feature: GYAE6OF02FT1F5.4.38.D05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (433)..(433): a, c, t, g, unknown or other
  misc_feature (433)..(433): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctntcctgcagggccagtcagagtgttagcagcagctactaccngtacagcagaacctgcagctccaggctctcatctatggtncatccagcagggccactggcatcccagaccaggttcaggtggcaggtgggtctgggacagacttcacttcacaccatcagcagactggacgcctagaagtatttgcgtagttgtattactgtacagtcgtagtgttggtanccgttaccgtacccggtaccggttccggaccgaacgggaccgtaagggtacggaaagttaccgaaaacggtaacgttaggtacggacttaggacccgacctacgttcgtacgttaccg

SEQ ID NO: 126284 - DNA, 775 bp, Homo sapiens
  misc_feature: GYAE6OF02F1BIM.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctaccgaaggggaaagacgccaccctctcctgcagggccagtcagagtgttagcagcagcctaacttaaccgtggtaccagaccaagaaacctggacccaggcctacccgaggccttcctactatcgtagtggtcgctactcccaaggccgacgggccctaacgtggaccaacgtaccccgaaggtaaccgagggttaccaaggttcgggaccgtagggtttcggggtcgtacgggggaactaaggtacccttacgtaccgttacctacccgaacctacgtacgaacgacggtaacgtacggttacgacggtaccgttaacgggaaagttacttttacgggacttaaggtttacgttttaaacgttaccgttacgttacggtaacgtaccggttaaaggtttggtaacggggttacgtaccgttaaccgttaaccccggggtaggttaccccggggtaaaccggaaaacgggggttaacccgaaacggggtaacgggttaaaacctaaaccgtaaaacggtaacccgttaggggtaaccgttacggtacgtaacccgtaacccgtacgttaccggttacgttaaccc

SEQ ID NO: 126285 - DNA, 580 bp, Homo sapiens
  misc_feature: GYAE6OF02JOWZN.4.38.D05.1.454.CMB.1.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
  modified_base (550)..(550): a, c, t, g, unknown or other
  misc_feature (550)..(550): n is a, c, g, or t
  modified_base (554)..(556): a, c, t, g, unknown or other
  misc_feature (554)..(556): n is a, c, g, or t
  modified_base (558)..(580): a, c, t, g, unknown or other
  misc_feature (558)..(580): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcacgccgacaagtccatcagcaccgcctacctgcagtggancagcctgaaggcctacggacngcgccatatattactgtcgacgaaaaccngtagcagcctcacccgtagtacttgactacgtcgggccaacgggaccctggtcacgtcgtctcctcacgcctccaaccaacggccccagttcccggtcccttccccctcggccctaccccgtcctaccgaaacggtccgaccctacccgttcgggtacgggggcccaaaccggtccggcccgggtccccgtcggggtcccgttccggacccgttacgggtaccgaaacgggtacccctttaacccgtttccccttaacgacggtcctcgtccgtaggacggtccgggctacgggacgacggcgaactagngacnnncnnnnnnnnnnnnnnnnnnnnnnn

SEQ ID NO: 126286 - DNA, 621 bp, Homo sapiens
  misc_feature: GYAE6OF02FIWDO.4.38.D05.1.454.CMB.1.raw
  modified_base (385)..(385): a, c, t, g, unknown or other
  misc_feature (385)..(385): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggcctcctcatctatggtgcatccagcgagggccacgtggcactcccagactacggttcaggtggctagggtcgggtcgtggggacagtacttcaccttcnccaacctatacagcgagacgtaggacgtccgtagtaagtagttttgacgtaggttagttaatttacgtcgtacgtagtcgtaggttaggtaggttacgtccgttacgtacccggtaacggttccgggaaccgtaacggggtaccgtaacggggtacggtaaaacgttaaccgaaaaccggtaacgttaggtacggtaccgtacggaccgtaaccgtacgttaccgttacgttaccg

SEQ ID NO: 126287 - DNA, 603 bp, Homo sapiens
  misc_feature: GYAE6OF02GNGSG.4.38.D05.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (402)..(402): a, c, t, g, unknown or other
  misc_feature (402)..(402): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanacgccaccctctcctgcagggccagtcagagtgttagcagcagctacttaactggtaccagcagaacctggaccaggcctccaggctcctcatctatggtncatccagcagggccatggcatcccagacaggttcagtggcaggtggtctgggacagtacttcgactcacaccatcagcagacgtggacgcctagaacgtntttgacgtagttagttacttacgtgttacagtacctaggttcggtaggttacgtccgttaccgtaaccggtaccggtttaccgggaacccgtaaacggggaccgtaacgggtaacgggtaaaccgttaaccggaaaaccggtaaccggttacggtacgggtacgtacgggacctaacccgtagtttaccgtagtttacccg

SEQ ID NO: 126288 - DNA, 547 bp, Homo sapiens
  misc_feature: GYAE6OF02GJ5UH.4.38.D05.1.454.CMB.1.raw
  modified_base (418)..(418): a, c, t, g, unknown or other
  misc_feature (418)..(418): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctgaagatctcctgtaagggttctggatacatctttaggacctactggatcggctggggtgcgccaggtcgcccgggaaaggcctggaatggatggggatcgatctatcctgatgactctgataccagatacagtcccgtcttacgaacggccgcgtccaccttctcacgccacaacgtccatcacgccacccncctacctcgcgagtcggagcagcctggaacggccgtacggacacggccgccaattacttattactgtacgaccgaaaaccaggtacgcagcctaccgacccgtaaggtactttcgactacgtaccgggg

SEQ ID NO: 126289 - DNA, 509 bp, Homo sapiens
  misc_feature: GYAE6OF02IGYLD.4.38.D05.1.454.CMB.1.raw
  modified_base (236)..(236): a, c, t, g, unknown or other
  misc_feature (236)..(236): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (488)..(509): a, c, t, g, unknown or other
  misc_feature (488)..(509): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgcgaaaaccngtagcagctcaccccgtaaggctttgactactggggccagggaaccctggtcactgtctcctcacgcctccaccaacgggcccagtccggtccttcccccgtggccaccctcctccaagcgcacctcgtggggcacgacggccggccctgggcctcgccgtggtaccaacggtaccttaccttcccctaactacggtcgtctcgtcggacggcgggtcttcgggaccgaacgggccgacgagtacgntnagnnnnnnnnnnnnnnnnnnnnnn

SEQ ID NO: 126290 - DNA, 217 bp, Homo sapiens
  misc_feature: GYAE6OF02H0C28.4.38.D05.1.454.CMB.1.raw
  modified_base (210)..(217): a, c, t, g, unknown or other
  misc_feature (210)..(217): n is a, c, g, or t
tcagagcactgtagcacgaccggtgctcgatttagtatctgatagttgggtttgggcggtgctcgatttagtatctgatagttgggtttggggggaagaggaagactgacggtccccccaggagttcaggtgctgggcacagcgccctgggctgcctggtcaaggactacttccctacagtgctctgagcgggctggcaaggcgcatagnnnnnnnn

SEQ ID NO: 126291 - DNA, 933 bp, Homo sapiens
  misc_feature: GYAE6OF02FRJPP.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaaacggcccgggggagtctctagaagatcctccgtggtaagggttctaggtatactattcgttaggacctagtggagtcggcgtgggtgccgccgagggtccggacccggggaaaggccgtagggtaagtgggtaaggtcggggatacgtacgttaccttaacgtcccgtaggtaactacggtaccttacgttacggtaaacctaacccgtaaaggtaaacctttaacggtaaccggtttaccccggttaacccgttttaaccgggaaaccggggtcccggtaccccggttaccctaacccgtttaccgtttacccgaaccggtaacccggaaacccgtaaaaccggttcccgtaaaccgttaaccgtaaaccggtaccccgtaaaccccccggtacccccttaacccggttaccggaccgggtaacgggttacggggaaccggtaacgaacccgggtaaccggttaacggggaaacccgggtaccccgggtaaccgggaacccggaaccggtaaccccggtaacccgtaaagtttaaactttaaccggttttaaccggttaccgggtaaaccggtaaaccccgggtaaaaaacccggttcggttaaaccgggtaacccgtaacccggtacccccgttaaccccggtaaacccccggttttaaaccgggttaacccggtttttaacccggtaaacccgggttaaccccgggtaacccgggggg

SEQ ID NO: 126292 - DNA, 779 bp, Homo sapiens
  misc_feature: GYAE6OF02FPPRZ.4.38.D05.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaagngccaccctctcctgcagggccagtcagagtgttagcagcagctacttaaccnggtaccagcagaaacctggccaggcctcccaggctcctcactctagtggtgcatccagcacgggccaacgtggcactccagacaggttcaggtcggctagggttcgggtctacggggactacgtacctttcgaacgttcctaccgaaccacgtacctaacggaccgtaacggtaccgtacgggacgtacccggttaggaaaacggtttacgtttttacggaaccgttaagggtttacggtttaacgtttaacccgtttaggttacccgtaacgggttaccgttagggtttacgggtttacgggtttaaccgggtaccgttacccggttaacccgggtaccgggtttttaaccggggaacccgttaaaaccggggggtaacccggtaaaacgggggttaaccgggttaaaaaccgggttaaacccgtaaaaaacgggttaacccggtttacggggttaaccgggttaaccgttaccgggtaacccgtaaaccccgttacggttttacccgttacggttttaaccccg

SEQ ID NO: 126293 - DNA, 689 bp, Homo sapiens
  misc_feature: GYAE6OF02G02K1.4.38.D05.1.454.CMB.1.raw
  modified_base (351)..(351): a, c, t, g, unknown or other
  misc_feature (351)..(351): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaggcccggggagtctctgaagatctcctagtaagggttctggatacatctttaggacctactggatcggctgggtgcgcgaggtgacccggggaaaggccgtggaatgggagtggggatcgaatctatccgtgatgacttntagactaaccagtaactacgacggttcccgttccgttacggaacggtcccgtccgtacctaccctttctccgacggcccgtaaacgtaacgtcccgaactccgacgcccaaccccgtccctaaccgtcgaccgtacggtacgggacgcgacggtcccgtagggaaaccggtcccgtaccggaccgtacggaccgtacccgaattaactacgtttaaccgtacggttacggaaccgtaaaaacccgtaggtaaaccggccgtaaccgtacccgttaacccgtaacccccggttaaggttaacccgtttacggtaacccgttaccgggttaacccggggg

SEQ ID NO: 126294 - DNA, 668 bp, Homo sapiens
  misc_feature: GYAE6OF02J1K1J.4.38.D05.1.454.CMB.1.raw
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
tcagagcactgtagcacgaccggtgctcgatttagtatctgatagttgggtttggggagagctgctcagttaggacccagagggaaccataggaaaccccagcgcagcttctcttcctcctgctactctggctcccagactaccaccggagaaattgtgttgacgcagtctccaggcaccctgtctttgtctcgaggggaagacgccacctctcctgcagggccagtcagagtgtagcagtcagctacttacctggtaccagcaagaacctggaccaggcctcccgaggccttccgtanattcgacgttggtcncagtccagccgacggtccacgtggccactacccgaaggtacccgagggttcccaagggtgaccgacgggttgggtcgtacgggaccctaagaccccttttcgaacctttccgaccaccgacgtacgacgacgacggtaacgtcggacgccgttaacgtagtactttgacggtagtacgttagttacgtagtaccaggtctacggttggtacggtccgacgttaccgaccgggttacgttacccggaccgtaacgggtaccgtaagggtacggtaaacgtaccgaaaacggttaccgttacgggacggtacgttaccggtaaccgtaaccgtacgttaccggtaccggtttaccc

SEQ ID NO: 126295 - DNA, 270 bp, Homo sapiens
  misc_feature: GYAE6OF02HZTYQ.4.38.D05.1.454.CMB.1.raw
  modified_base (254)..(270): a, c, t, g, unknown or other
  misc_feature (254)..(270): n is a, c, g, or t
tcagagcactgtagcacgaccggtgctcgatttagtatctgatagtgggtctgggacagacttcactctcaccatcagcagactggagcctgaagattttgcagtgtatttactgtcagcagtgtggtagctcaccgacgttcggccaaagggaccaaaggtggaaaatcaaaacgaactgtggctgcacatctgtcttcatcttcccgcatctgactacagtgctctgagcgggctggacaaggcactatagnnnnnnnnnnnnnnnnn

SEQ ID NO: 126296 - DNA, 588 bp, Homo sapiens
  misc_feature: GYAE6OF02FKFFI.4.38.D05.1.454.CMB.1.raw
  modified_base (282)..(282): a, c, t, g, unknown or other
  misc_feature (282)..(282): n is a, c, g, or t
  modified_base (342)..(342): a, c, t, g, unknown or other
  misc_feature (342)..(342): n is a, c, g, or t
  modified_base (525)..(525): a, c, t, g, unknown or other
  misc_feature (525)..(525): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaaggttctggatacatctttaggacctactggatcggctgggtncgccgagtcgcccgggaagcctggaatggatggggatcgatctaactcctagatgacctntcgataccagatacagttccgtcctacgaaggcccgcgtccaccttctcagcccgacacgtaccatcagcctaccgcctaccgtgctaggtcggactgacgtcgttacggaacggtcccgtcgggaaccacggccacctattaacgttacttaccgtgttagaacccgtaaaacgcggtaacncctaacgtacctacccggtaacccgtaagggttacctttacggaccttacgggtaacccgggg

SEQ ID NO: 126297 - DNA, 687 bp, Homo sapiens
  misc_feature: GYAE6OF02I9337.4.38.D05.1.454.CMB.1.raw
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtgtagcagcagctactacctggtaccagcaagaacctggccaggctcccgagctcnatctatgngcanccagccgaggccagtggcacgtcccgaagtacgtcggttcaaggttcggactagggtgggtctaggggactaggtaccttcacgttcctacgaccgattaccgaacgcgaacgacgtagggacgtacctaagggtaaacgtttgttttcggacgttaacggtttcggtaactttaccgttagtacggtacgtcgtaagggttcgtacgggttacgtaccgtttaccgaacccgggttacgttacccgggaacccggttaacggggtaccccgtaaagggggttaacccggaaaacggttaaacccgggtaaaccggtaaacggttagggtaccgggtacgttaaccggtaccgaaacccgtttagtttacccgtacgttttaacccg

SEQ ID NO: 126298 - DNA, 746 bp, Homo sapiens
  misc_feature: GYAE6OF02JFIAS.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatgggtcaaccgccatcctcgccctcctcctggctgttctccaaggagtctgtgccgaggtgcagctggtgcagtctggagcagaggtagaaaaacgcccggggatctctgaagatctctagtaagggttctggatactattcgtttaacggaccttacgtggtatcggcgtggggtcgccggccgtagggttccggaaccccggggaaaggtcccgtagggtaaagtgggtaggtacgggggaacttcgtaagttccgttaacgtccgtagtaacgttcggtaccttcgtacgaactaccgagtaacttacgtaacggttcccgttaccgttacggaaaccggtcccgtaccgttacctacccgtttcgaccgtacggtacccgtaaaccgtaaccggtacctaacgttaccgaaccgtacccgtacccgtaccctaacccgtgaccgtaggtacggacgacgaccggtcgacggaccggtcccgtacggtaaccaccggaccgtaccgtaattaaccgtacgttaacgtcggtaaccgaaacccggtaaacgtacggtacgaccgtacgtacccgtacccgttaacccggtaacgttaccgttaacggaccggttaacggtacccgggg

SEQ ID NO: 126299 - DNA, 668 bp, Homo sapiens
  misc_feature: GYAE6OF02H54O4.4.38.D05.1.454.CMB.1.raw
  modified_base (507)..(507): a, c, t, g, unknown or other
  misc_feature (507)..(507): n is a, c, g, or t
  modified_base (597)..(597): a, c, t, g, unknown or other
  misc_feature (597)..(597): n is a, c, g, or t
tcagagcactgtagcacgaccggtgctcgatttagtatctgatagttgggtttggggagtctccctcactgcccagctgggatctcagggcttcattttctgtcctccaccatcatggggtcaaccgccatcctcgccctcctcctggctgttctccaaggagtctgtgccgaggtgcagcgtggtgcagtcgtggagcaggaggtaggaaaaacggccggggagtctcgtagaagatctcgtggtaagggttctaggatacattacgtttaggacctacgtggactcggcgtggtcgcgcgaggtcggaccggaagcgtaggaagtggagtgggatctagtcgtaactccgtagtacgtacgtactcgtagtaactacgaagtactacgtacgtaccgttaccgtacgaacggtccgacgtaccgtaccgttcgtacgacgaccgaaccgtaacgtccatccgaccgtaccgacccggtacctaaccgtcgtacgaggtacggacncgaccgcgttacggaaccggtccgtaaccggacgaccgcgaccctaattaacgttactacgtacgaaccgtaaccggaaacctacggtancccgtaacgtacccgttacccggtaacccggttaaggttacccgtttacggaccgtaccgggtacccgggg

SEQ ID NO: 126300 - DNA, 218 bp, Homo sapiens; identical to SEQ ID NO: 126245
  misc_feature: GYAE6OF02INCVJ.4.38.D05.1.454.CMB.1.raw
  modified_base (211)..(218): a, c, t, g, unknown or other
  misc_feature (211)..(218): n is a, c, g, or t

SEQ ID NO: 126301 - DNA, 634 bp, Homo sapiens
  misc_feature: GYAE6OF02F90R6.4.38.D05.1.454.CMB.1.raw
  modified_base (198)..(198): a, c, t, g, unknown or other
  misc_feature (198)..(198): n is a, c, g, or t
  modified_base (371)..(371): a, c, t, g, unknown or other
  misc_feature (371)..(371): n is a, c, g, or t
  modified_base (503)..(503): a, c, t, g, unknown or other
  misc_feature (503)..(503): n is a, c, g, or t
  modified_base (578)..(578): a, c, t, g, unknown or other
  misc_feature (578)..(578): n is a, c, g, or t
  modified_base (585)..(585): a, c, t, g, unknown or other
  misc_feature (585)..(585): n is a, c, g, or t
tcagagcactgtagcacgaccggtgctcgatttagtatctgatagttgggtttgggggagtctccctcactgcccagctgggatctcagggcttcattttctgtcctccaccatcagtggggtcaaccgccatcctcgccctcctcctggctgttctccaaggagtctgtgccgaggtgcagctggtgcagtctggancagaggtagaaaaacggcccggggagtctcgtagaagtactcctccgtaggtaagggttctaggatacattcgtttaacggaccttacgtggattcgggacgtggggtgcgaccgagggtccggacccggggaaacggccgtaggaagtgggagtggggatcattctacttcnggactgactcgtagaataccaggtactacgtacgtcccgtacgttacgacggccgtacgttcctacttcgtacgacgaccgtaacgacgtccactcacggaccacccgtaccgtacctagtacagggtcggnaccgtaggcctacgggaacgtccggtcgacgacgcgaacctagttactaagttccgtagtaccgaacggaaaacnggtaacncgacgttaccaaccgtaccggttaatacgttacgacgttaggacccggg

SEQ ID NO: 126302 - DNA, 591 bp, Homo sapiens
  misc_feature: GYAE6OF02IGEQA.4.38.D05.1.454.CMB.1.raw
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
  modified_base (450)..(450): a, c, t, g, unknown or other
  misc_feature (450)..(450): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaacgccgggagtctcgtgaaagatcctcctgtaagggttctggaatacatctttaggacctacgtggatcggctgggtnccgccgaggtcgcccggggaaagccgtaggaanggagtggggtatcgtatctagtcctgtatgactctagataccatatacngtccgtccgttagaacggccgtccgtactccttactcgacgaccgaacaacgtccatcacgacccaccgacctaccgtnacgagtggacgcacgcgtaggacgtcctcggaccagcgacccaatacttaacttactagtacgtacggaaaacctacggtagacctacgacccttaccggaaccccggtaaggttacctttaacgaccgtacgtaccgggg

SEQ ID NO: 126303 - DNA, 218 bp, Homo sapiens
  misc_feature: GYAE6OF02HFITR.4.38.D05.1.454.CMB.1.raw
  modified_base (211)..(218): a, c, t, g, unknown or other
  misc_feature (211)..(218): n is a, c, g, or t
tcagagcactgtagcacgaccggtgctcgatttagtatctgatagttgggtttgggcggtgctcgatttagtatctgatagttgggtttgggggaagaggaagactgaccggtcccccaggagttcaggtgctgggcacagcggcccgtgggctgcctggtcaaggactacttccctacagtgctctgagcgggctggcaaggcgcatagnnnnnnnn

SEQ ID NO: 126304 - DNA, 765 bp, Homo sapiens
  misc_feature: GYAE6OF02IAVDF.4.38.D05.1.454.CMB.1.raw
  modified_base (205)..(205): a, c, t, g, unknown or other
  misc_feature (205)..(205): n is a, c, g, or t
  modified_base (598)..(598): a, c, t, g, unknown or other
  misc_feature (598)..(598): n is a, c, g, or t
  modified_base (605)..(605): a, c, t, g, unknown or other
  misc_feature (605)..(605): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagactaccaccggagaaattgtgttgacgcagtctcaggccaccctgttctttgtctccgaaggggaaanacgccctacctctccgtgcgacgggccagtcagagttgtaagcgagcagtacttaccttaacgtggtaccagacaacgaaaccgtcggaccacggcctacccggaacggtcccttaccgtacctacgttaccttaagttcgggtaccgtacctacgttaccgaagaccggaaccgggtccgtaacgttcgggaccctaacctcccggaaaggtaccgttaacggttaccgaaggtcgggtacgtacggggtttacggtcggtacgggtacgtaacgttacccgttacctacccttaccgtccaaaccgtcgtccgaaacgaccgtaacgtacggtaggtaccgtacgtaaggttaagttacgtttcggaacttaaggttacgttactttacgnttaacgngtacgttgggtcgttaggtccgtacgtccgtaccgggtacgttaccgggaaccgtaaaccgggtacgtaacgggtaacggtaaacgttaaaccgaaacgggttacttacggtacggtacctacgggaaccctaaccgttcgtttacctccgtttaacccg

SEQ ID NO: 126305 - DNA, 717 bp, Homo sapiens
  misc_feature: GYAE6OF02HZJZI.4.38.D05.1.454.CMB.1.raw
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtgcagctggtgcagtctggagcagaggtagaaaaacggcccggggagtctctgaagatctcctggtaagggttctggatactattaccgtttaggaccttacgtggtactcggcgtgggtcgccgccgagggtcggacccgggaagccgtaggaagtggagtcgggatcgtatcgtacgtccgtagtacgtcgtactcgtagtacgtaaccgaagtacgttactacggttacccgttaccgttacgggaaccggtcccgtaccgttaccgttacccgtttcctaccggaccggtaacccgaacgttaacgtcccaagtaccgacgacccgtaccccggtaccttacccgtcggaacgtgggtacggacgccgaccgtaccgaacgggtacccgcccggtacggaccgacggccgtaccgtaatacgttaacgttcgtacggtaaccgaaccgtaaaacgcggtaacgaccgtaaccgtcccgttaacccgtaacccggttaacggttaccgttacggtaccggttaccgggtacccgggg

SEQ ID NO: 126306 - DNA, 751 bp, Homo sapiens
  misc_feature: GYAE6OF02F78B8.4.38.D05.1.454.CMB.1.raw
  modified_base (526)..(526): a, c, t, g, unknown or other
  misc_feature (526)..(526): n is a, c, g, or t
tcagagcactgtagcacgaccggtgctcgatttagtatctgatagttgggtttgggagagctgctcagttaggacccagagggaaccatcggaaaccccagcgcagcttctcttcctcctgctactctggctcccagactaccaccggagaaacttgtgttgaccgcagtctccaggccaccctgtctttgtcctccgaaggggtaaacgacgcccacccctctccctagccgagggtccccagttccaagacgttcgttagccaggccaggccttaaccttaacctggtacccagccacgaaccctggcccacggtcctccccgaggcctcccgtcaattcctagtgtacgcactccaagtccgagggtccaacgtcggcctacgtcccgaggtaccacggtttaccaggttcggaccgtacgggtcgggttaccgtacggggtaacctaaccggttaccttacccgtaccttcccgtaccctaacccgtaacttcccgaacgtccgaacgtaccgtcgggtacncccgttaagaacgttatttcggctagttcgttaaccttacgtcggtccaagtcctaaggttcgttcggtaaccgtccgtttaacccgaacccgtacgggttaaccggacccgtaaacggggaccctaaaggttaccggaaaaacctccaaaacccggggttaactcgggtaacccggtccgtacgacccgttaaccccgtagtttacccgttcgtttaaccccgg

SEQ ID NO: 126307 - DNA, 618 bp, Homo sapiens
  misc_feature: GYAE6OF02GKH96.4.38.D05.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (453)..(453): a, c, t, g, unknown or other
  misc_feature (453)..(453): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaancgccaccctctcctgcagggccagtcagngtgtagcagcagctacttaaccnggtaccagcagaacctggccaggcctcccgaggcctacctcatctagtggtcgccactccgagccgacgggccacgtcggcactcccaagaccgtaggttcgaggttgggtaggtgggtcgtagggacagtccttacacgtctaccgactatccgagtcaggacgtcgggacgctaggaagttagtttcggacttagttnttaacttcgtcgtacagtcgtaggtggttacggtacgtccttacgaaccgttacggtaccggaaccgtaacgggtaaccgtagggtaacgaaacgttaacggaaacggtaacgtgggttacggacgttacggaccttaacctacgttcttacgttacctttaccg

SEQ ID NO: 126308 - DNA, 580 bp, Homo sapiens
  misc_feature: GYAE6OF02F98FI.4.38.D05.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttaaccnggtaccagcagaactgccaggctcccaggcctcctcatctatggtncatccagcgacgggccacgtggacactcccagactacggttcaggtgactaggtggtctgggacagtacttcactcacaccatcacgcacgacgtaggacgcctagaagtatttcgactagttcgtattacgtgtacagtcgtaggtgtacggtagtccgtacgtaaccggtaccggttaccggaccgtaacgggtaccgtaagggttacggtaaacgtaccgaaaccggtaacgtacggtacggacgtacggaccgtacctacgttacgtacgttaccg

SEQ ID NO: 126309 - DNA, 796 bp, Homo sapiens
  misc_feature: GYAE6OF02JRJCI.4.38.D05.1.454.CMB.1.raw
  modified_base (199)..(199): a, c, t, g, unknown or other
  misc_feature (199)..(199): n is a, c, g, or t
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtcttgctccaggggaaangccacctctcctgcagggccagtcaggacgtgttagcagcagctaactaccnggtaccagccaagaacctggcctaggcctccgaggctcctanactctagtggtgactatccgngaccgacgggcctactcgggaccacttacccgaagtaccgtaggtttaccacggtttggacgtaaggtcgggtacgtagggaaccttacgggtaaccctttaccgaccgttaccggttaccaaacccgtacgttaaccgaaacgggttaccctaaaaacgggtccgttacgggaaccggtacccggtttaagggtaaaaacccggttttagtttcggaaccgttaagggttttacggtaacgttttaaacgtccggttacgtaacgggttccgtaaagggtttcgggttgggttaacctaccggggtttaaccccgtaaccgggttacgggttttacccggaaacccgggttaaaacgggttaccccgggaaagggtttaaccgggaaaacgtttaacccggtaaaaccggtaaccgttaacgggtttacggacctttacgggaaacccttaccgtacgtttaccggtaccgttttaacccg

SEQ ID NO: 126310 - DNA, 808 bp, Homo sapiens
  misc_feature: GYAE6OF02H8LZO.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtcgtggagcaggaggtaggaaaaacggcccggggagtctcgtagaagatctccgttggtaagggttctggtatactattcgtttaacggacctacgtggtacgtcggcgttggggtcgcgccgagggtcggacccggggaaaggccgtaggaagtgggagtaggggatcgtactcgtacttccgtgattcggacttacgtataactacgaagtactacgtacgttcccgttaccgttaccgaaccgggtcccggtaccggttacctaacccgtttccgtaccgtaaccgggaccccgtaaacgtaaaccgtacccctaacgtccgtaaccggtacccgaacccgtcccgtaacccggtcggtaccgtaagggtacgggacgtccgaacgggtcccgttaacgggaaccgggtcccgtaaccgggaacgaccgggtacccgaacccgtaaactttaacgtttaacctttacggtacggttaacccggtaaaaccgggtaaaaacccggtacggtaacggtaacccgtaaccggttaacccgttaaccccggtaaacccgggttaaaccgggtttaacccgttttaccgggaaacccggtttaccgggtaaccccggggg

SEQ ID NO: 126311 - DNA, 658 bp, Homo sapiens
  misc_feature: GYAE6OF02H68VC.4.38.D05.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
tcagagcactgtagcacgaccggtgctcgatttagtatctgatagttgggtttgggagagctgctcagttaggacccagagggaaccatcggaaaccccagcgcagcttctcttccctcctgctactctggctcccagataccaccggagaattgtgttgacgcagtctccaggcaccctgtctttgctcaggggaaancgccacctctctgcgaggccagtcagngtgtagcagcagctaacttaaccgtggtaccagacaagtaaccctggaccacggcctacccgaggtcctccgtcaagttcctaagtgggtacnccagtcccaaggccgagggcctacggtggacctacctcccgaggaactgggttacagggtcgaccgtagggtcgggtacgtgggtaaccagtacccgttacacgttccaacgtaactactcgacgacgtaggaccgtaggtacgtaccgttaagaacggttacttttcgacgttacgttcttacgtttaccgtgtaccgtaggtacgttaggtaggttcgtacgtccgtccgttaacccgggtaccgttaccgggaacgttaacgggaaccgtaggtaacgtaataaccgtaacgaagttcggtagccgtacgtaccgtacctagttccgttgttaccg

SEQ ID NO: 126312 - DNA, 588 bp, Homo sapiens
  misc_feature: GYAE6OF02HGRO5.4.38.D05.1.454.CMB.1.raw
  modified_base (202)..(202): a, c, t, g, unknown or other
  misc_feature (202)..(202): n is a, c, g, or t
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangcccaccctctcctgcagggccagtcagagtgttagcagcagctactaacngtaccagcagaacctggccaggcctccaggctcctnatctagtggtncatccagcaggccagtggcactcccagcagttcagtggacaggtcggtctgggacagtacttacacctctcaccatcagcacgactaggacaccgtagaaacgttagttttggacttagttagttacttacgtcgtacgagtcgtaacggttggtaggtacgtccgtaccgtaccggtaccggttccgggaaccgtaacgggtaccgtaagggtacggaaacgtaccggtaaaaccgtacgttacggtacggtacgtcgacccgtaacctacgttacgttcgttaccg

SEQ ID NO: 126313 - DNA, 669 bp, Homo sapiens
  misc_feature: GYAE6OF02JUJAK.4.38.D05.1.454.CMB.1.raw
  modified_base (430)..(430): a, c, t, g, unknown or other
  misc_feature (430)..(430): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaggcccggggagtctctagaagactctcctaggtaagggttctggatactattcgtttaacggacctagtggtacgtcggcgtggggtcgcggccgagggtcggacccggggaaaggccgtagggaagtgggaggtggggatcgatctacgtcgtgatcgactcagactacgagtactacgtacggtccgtacgtacgacggccgtacgtcctaccttcncgacgaccgacacgtccatcgacgccgacccgtaccgtaccgtcgcgaacgggtcgacgaccgacggtaccgtacgggaacccggtcccgtacgggaacctacgggacccgtactaacttaacgttacttaccgggtcgtaaaccggaaccgtaaaccgtacgtacggaccgtaacgtcccgtaacccggtaacccggtaacggttaccgtttaccggtacccgtaccgggtaccgggg

SEQ ID NO: 126314 - DNA, 616 bp, Homo sapiens
  misc_feature: GYAE6OF02IH8U1.4.38.D05.1.454.CMB.1.raw
  modified_base (554)..(554): a, c, t, g, unknown or other
  misc_feature (554)..(554): n is a, c, g, or t
  modified_base (582)..(582): a, c, t, g, unknown or other
  misc_feature (582)..(582): n is a, c, g, or t
  modified_base (585)..(589): a, c, t, g, unknown or other
  misc_feature (585)..(589): n is a, c, g, or t
  modified_base (593)..(595): a, c, t, g, unknown or other
  misc_feature (593)..(595): n is a, c, g, or t
  modified_base (597)..(616): a, c, t, g, unknown or other
  misc_feature (597)..(616): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcggaaggccgcgtcaccttctcagccgacaagtccatcagcaccgcctacctgcagtggagcacgcctgaacggcctacggacagcgccaattattattacgtgtacgaaccgtaaaaaccaggtagccagtcctaccgtaacccccggtaaaggtaccttttagaccgttaaccgtcgggggacccgaacggggtaaccccgttgggttaccaccgttcgttccttccctcgaccgtccctcccgaacccgaacgggcccctacgttccggttcccttcccccgtcggcccctacccgtaccctaccgaacgcgacctacccgtacggtcggggaccacggacggccggtcccgtcgggctcgccgtcggtaccgaacggtacccttacttccccgtagtacggtcggacgtacgggtccgggngtcggaccgtacggacgacgagtacgcncgnnnnncgcnnncnnnnnnnnnnnnnnnnnnnn

SEQ ID NO: 126315 - DNA, 756 bp, Homo sapiens
  misc_feature: GYAE6OF02GHD6H.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaacggcccggggagtctctagaagatctctaggtaagggttctggactacattcgtttacggacctacgtgagtcggcgtgggtgccggccgtagggtcggaccggggaaacggtccgtagggaacgtggaggtaggggactacatactacttccgtaggtatcgaccttcgtagaactaccgaagtaacgtacgtacgttccggttcctttacgggaaccgggtcccggtaccgtacctacccgtttcctaccgaccgtacccgtaactaaaccgtcctatccgaacgcccaacccgtccctaccggtcgacgtaacggtcggacgccgtacggtccgtacggaacccggtccggtaccggaaccgtacggtaccccgtaacccgtattaaaccgtttaacgttaccgtttacggaaccgtaaacccgggtaaaacccgtacgggtaaccgtaacccggtaacggtaaccccttacccgggtaacccccggttaaacggtttacccgtttacccgggttaaccgttacccggggtaacccgggggg

SEQ ID NO: 126316 - DNA, 685 bp, Homo sapiens
  misc_feature: GYAE6OF02FO05B.4.38.D05.1.454.CMB.1.raw
  modified_base (147)..(147): a, c, t, g, unknown or other
  misc_feature (147)..(147): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
tcagagcactgtagcacgaccggtgctcgatttagtatctgatagtgggtttgggagagctgctcagttaggacccagagggaaccatggaaaccccagcgcagcttcgcttcctcctgctactctggctcccagataccaccgganaaattgtgttgacgcagtctccaggcaccctgtctttgctccagggaangccacctntcctgcagggccagtcagagttgtagcagcagctactaaccgnggtaccngcaggaacctggccaggcctacccgaggtctccgtgagttccgtaagtcggtcacgactccgagcacgggcctagtcggctacgtccgagtacgtacggttcaacggtcggtacctagggtttacgggtactacggggtaacctaacggttaccgtttaccgaccgtttccgtacgaaacccgttacgtacggtaacgtccgtaacggtacgtacgggtaccggtaccgtaacggtaacgttcgtttacggacgttaggtttacgtaccgttacgtcgttacgacgttacgtaacggtcggttaggtccgtacgttacccgtacgtacggttaccggaaccgtaacggttaccgaggttaccggaacgtaccggtaacgtacgtacggtacgtacgttacgaccgttaccgtacgtttccgtagttcccgg

SEQ ID NO: 126317 - DNA, 872 bp, Homo sapiens
  misc_feature: GYAE6OF02G3PFF.4.38.D05.1.454.CMB.1.raw
  modified_base (197)..(197): a, c, t, g, unknown or other
  misc_feature (197)..(197): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctcaggcaccctgtcttgtctcgagggaangccacctctcctgcaggccagtcagagtgtagcagcagctacttaccgtggtaccagccaagaaacctggaccgacggccctaccccgaggtccctccctactacttaccgttagtcgggtcgtacctaccgttcccggagtaccggaacggggtccccaaccggttacgggaccctacccgtacccgaacgtaaccggtaacggtttccgaacgggtcggtacgtaggggtttcgggttaccgtacgggggtacctaacggttacccttaccggacctttacccgtacctaaccgtacgtacgtaaccggtaccgtaacggtaaccgggtccgggaaaccgttccggttaaaggtaacggttttaacggttttaccggtaacgtttaacgggtttaacgttttaaccgtttaaccggtaccgggtttaacgtaccggtacgggttaaccgggttttgggttaaccggttaagggtccccgtttaccggtaaaccccggggtttacccggtttaaccccggggaaaccggggtaaaccgggggttaaccccgggttaaagggtaaacccgggttaaaaccgtaaaccgggttaaaacccggtaacgtcggggtttaacccgacgggtaaccgtaacccgttaccggtaaacgttttcccgttaccggttaacccc

SEQ ID NO: 126318 - DNA, 736 bp, Homo sapiens
  misc_feature: GYAE6OF02GOW65.4.38.D05.1.454.CMB.1.raw
  modified_base (256)..(256): a, c, t, g, unknown or other
  misc_feature (256)..(256): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagacgccaccctctcctgcagggccagtcagtagtgttagcagcagctacttaaccnggtaccagcaagaaaccgtggaccaggcctaccgaggcctccgtcacttctagtcggtcgactacgtccgacgcggacgggcctacgtcggacctaccgtcccaaggaccgtaacggtttcgaacgggtcggtacggtacggggtttacggggtcgtacgggggaacctacggtaacctttaccgaccttaccgtaccacctagtacgacgacgacggtacgtcggtaactccgttagtaacgttatttcggacttaaggttcgtttaactttacgtacgtacgacggtcgttaacggttacggttacgggtacggtacccgtaccgggtaacccggtaccgggtttaccgggtaccgggaaaccggggtaaccgtaaacggggttaaccggtaaacggttaaccgtaaaaccgggtacggttacggtaccgggtaccgacgggtaaccgtacccgtaacgtttccgtaccggtttaccg

SEQ ID NO: 126319 - DNA, 589 bp, Homo sapiens
  misc_feature: GYAE6OF02ILLMK.4.38.D05.1.454.CMB.1.raw
  modified_base (561)..(564): a, c, t, g, unknown or other
  misc_feature (561)..(564): n is a, c, g, or t
  modified_base (566)..(589): a, c, t, g, unknown or other
  misc_feature (566)..(589): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaacggcctcggacagcgccatatattactgtcgacgaaaaccagtagcacgacctaccgaaccccggtaaggtacctttcgaccgttacggtcgggggacccgtaacggggaacccctggttaccacgttcgtccttccctccaccgtccctacccgacccgaaccggcccctacgttccggttcccctttcccccgtcggcccctaccccgttccctaccaacgaccgcctaccgtcggtcggggaccacgcggcccggccgtcgggtcgtcgccgtacggtacgtaacggtccctttacccgttcccgtacgtacgtcgtaccgtcgacggcgggtccggcgtcggacgacggcgtacagtgnnnngnnnnnnnnnnnnnnnnnnnnnnnn

SEQ ID NO: 126320 - DNA, 546 bp, Homo sapiens
  misc_feature: GYAE6OF02GJ5A8.4.38.D05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngcccaccctctcctgcagggccagtcagagtgtagcagcagctacttaacctggtaccagcagaacctggccaggctcccaggctcctcatctatggtncatccagcgagggccacgtggcatcccagacaggttcagtggcaggtcgggtctgggacaggtacttcactctacacatcagcagacgtggactccgtagaagtatttgactagttgttaattacgtgtacagtcgtaggttggtagtacgtctacgaccgtacgttccggaccgaagggacgaagggtaggaaactaccgaaacgtacgtaggtcggactcggaccactacgttcgtgttacc

SEQ ID NO: 126321 - DNA, 728 bp, Homo sapiens
  misc_feature: GYAE6OF02HE1MS.4.38.D05.1.454.CMB.1.raw
  modified_base (202)..(202): a, c, t, g, unknown or other
  misc_feature (202)..(202): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccaccctctcctgcagggccagtcagagtgtagcagcagctacttaaccgtggtaccagcaagaaacctggaccaggcctcccgaggtcctcctcatctatcggtcacactccgagccgagggcccagtggccactacccgaagacgtaggttcaggtggacgtagggttcgggtcgtaggggaacctaggtacccttcgaccttcctaccgacctacgtccgaagtccgaagacgtacgggacgtcccgttaaggtaacgtttacgttttacggacgttacggttacggtttaactttaccggttacggttactacggtacgttaagggtttcgggttacgggttaacgtcccggttaacccgtacccgggttaccggttacccgggaacccggttaaaccggggaaccgttaaggggttaacggtaaaaccgttaacccggtaaaacggttaacggttaccgggttacgggaacccgttacggaccctaaccggttacgtttacccggttacgtttaacccg

SEQ ID NO: 126322 - DNA, 823 bp, Homo sapiens
  misc_feature: GYAE6OF02IXTEY.4.38.D05.1.454.CMB.1.raw
  modified_base (178)..(178): a, c, t, g, unknown or other
  misc_feature (178)..(178): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtncagcgtggtgcagtctggagcaggaggtagaaaaacggcccgggagttctcgtagaagtatccgtccgtaggtaacggttctaggtatactattacgttacggaccttacgtggacgtcggcgtcgggtcgccgaccgaggtacgggaccccgggaaacggtccgtagggtaagtgggtacggtagggtaactcgtacgttacctaacgttcccgtagtacgttacgtaccgttacgtacgaaaccttaaaccgagtaaccttaccgtaccggtttacccgttaccgttaacgggacccggtcccggtaccgttaccttaacccgttcgtaccgaccgaaccgtaaccgtaaccggtacctacgaccgacgacccgtaacccgtacccgtacgtacgacggtacggtcgaccgtaccgtaccggtaccgtaacgggtaaccggtcccggttaaccgggaaccgaccggtaccccggtaactaaacgtttaacgttaaccgtttaccggtacgtaaccggtaaacccgtaaaaccgtaacgggttaaccggaccccttaacggtaccccggttaaacccggttaaccccggggttaaacgttacccgtttaaccgggttaacccggtaccgggtaaccccgggggg

SEQ ID NO: 126323 - DNA, 671 bp, Homo sapiens
  misc_feature: GYAE6OF02G2J3C.4.38.D05.1.454.CMB.1.raw
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (636)..(636): a, c, t, g, unknown or other
  misc_feature (636)..(636): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagactaccaccggagaaattgtgttgacgcagtctccaggcaccctgtctttgctccgaagggaaagcgccaccctctaccgtgcgacggccaagtccagagtcgttaagccaagcagacttaacttaaccgtggtaaccagcaaacgaacctggaccaggcctcccgaggcctcctactactcgtagtggtacncacgtaccngcgacggtcctaaccggtggacctacgtacccgaaggtacctaggttccaagggtcgaccgttagggttcggaccgtaggggaacctagtaccgttccaaccttcgtaccaaccactacgacgctaaggtacgtacggactaccgtagtaattagttgaccgttaagttacgtttaatacggttgtaaccagtacgttagggtagttacggtctacccgtcgtaacccggtacggttccggaaccgaacgggtaccgaagggtaaccgtaaacgaacggtaaactacgtgggtaacnccggttaacgacctaacgtcgttaccgtatttacc

SEQ ID NO: 126324 - DNA, 593 bp, Homo sapiens
  misc_feature: GYAE6OF02II0GZ.4.38.D05.1.454.CMB.1.raw
  modified_base (446)..(446): a, c, t, g, unknown or other
  misc_feature (446)..(446): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctgaagatctcctgtaagggttctggatacatctttaggcctactggatcggcgtgggtgcggccgagggtcggaccccggggaaaggccgtagggaatgggagtggggatcatcgtatcctgatgactctgataccagatacacgttcccgtcttacggaacggtccgcgtcctaccgttctcacgcccgaacaacgtccatcacgccacccgtcctaccngcaggtcggagcacgcgtagaacggcctacggacgacgaccgcctaattaacttattacgttagtacgaaccgaaacctacgtaacgctaacggcctacccgtaaccccggttaaggtaccgtttcggaaccgtacggtaccggggg

SEQ ID NO: 126325 - DNA, 659 bp, Homo sapiens
  misc_feature: GYAE6OF02JFFI1.4.38.D05.1.454.CMB.1.raw
  modified_base (197)..(197): a, c, t, g, unknown or other
  misc_feature (197)..(197): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
  modified_base (559)..(559): a, c, t, g, unknown or other
  misc_feature (559)..(559): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggancagaggtagaaaaagcccggggagtctcgtagaagatctcctaggtaagggttctggatactattacgttacggacctacgtggtatcggcgtgggtcgccgcgagggtcggacccgggaaggcctaggaacgtggtagtggggtatcgatgtactcgtagagtgactacgtgaactacgagtactaacgtcgttccgtaccgtacgaacggccgtaccgttaccaccttcgtacgacgacccgaacgtacgtcctactacgacgcctaacccgccgttaccgngacgtacggtggacncgaacgtccgtaaggtaccgacccgtaggaccgtacgccgacctaaagttactacgttaccgngttaacggaaacccgaaaacgtaggtacgaaccgtacgtaccccgttaacccgtaaccgggttaacgaaccggtttacggaccgtaagggtaccccgggg

SEQ ID NO: 126326 - DNA, 801 bp, Homo sapiens
  misc_feature: GYAE6OF02GV8BF.4.38.D05.1.454.CMB.1.raw
  modified_base (201)..(201): a, c, t, g, unknown or other
  misc_feature (201)..(201): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaanacgccaccctcctcctcgacgacgggaccgacgtacgaggagttacggttagtacgacgacgacggtccttaacctttaaccgttaccggtaccgtaacgacgtaacgaaaccgtacggccgaccggtaccgtaccccgacggccttcccgtactacttacttacggtaggtcgacctactaccgtacgcgaccgggaccgtacgtcggacacctacccgacgtaacgtacggttacgtacggtcggccgtaggttcgggtacgtacgggtacgaacgttacgttaccgtaacctcgtaccgtaacaccgtacgacctacggacgtccccgtagtaccgtacggttacgttacggtaagtttaacggtttttcggtaagttttttaactaaccgtccgttacgacgttaacgttaaacgttaacgttaaccgtttaaacgtccgtttccccgtaacttttacccgggttaaccggtttaaccgggggtacgggaaaccgggttacgtaggggttaaggaacctaacgggttaaacgaaaccggttcgggtttacggagggtaccccttggaaacccgttaccgtccgtttaacgttccgg

SEQ ID NO: 126327 - DNA, 618 bp, Homo sapiens
  misc_feature: GYAE6OF02G5ALV.4.38.D05.1.454.CMB.1.raw
  modified_base (357)..(357): a, c, t, g, unknown or other
  misc_feature (357)..(357): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaagggaaagagccaccctctcctgcagggccagtcagagtgtagcagcagctactaactgtacagcagaaacctggccaggcctcccaggctcctcatctatggtgcatccagcacgggccacgtgcactcccaggaccaggttcaggtggctaggtcgggtcgngggacagtactttcacgtctaccgacctatcgagcagacgtggaacgtccgtaggtaacgttagtttacgacgtaggtacgttatttacgtacgttcgagtcgtaagggttcgttagggtacgtaccgttccgaaccgggttaccggttaaccgggacccgtaaaggggaacccgtaagggtaacggtaaaacgtaaccgaaacggttaaggtacggtacgggtactaccggtaccaacccgtagttcccgtaacgtttcc

SEQ ID NO: 126328 - DNA, 792 bp, Homo sapiens
  misc_feature: GYAE6OF02JQ92X.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagactaccaccggagtaaattgtgttgacgcagtctccaggccaccctgtctttgtctaccgaaggggaagcgccacctctccgtgcgacggccagtcagtagtgtacgcagcagtaccttacgttaaccgtcggtaccagacaacgaaccgtcggaccacggtcctcccgaggtccctccgtacctatacgtagtcggtcgaccgtacgtccgaggtaccggacgggaccctacgtcggaccaccgtaccgaaggtacgtacggttcgaggtcggcgtagggtcggtcggtaggacacgtacttacactctacactatcgtacgacgtaacggtacgtacggacgtcgttaagtaacgtttacgtttcgaacgtttacggttacttaaccgttacgttacggtacgtaacgttacggttagggttacgggttaccggtaccgttaccgtaaccccgggttaaccgggttacccgggtaaccgggtaacccgggtaaaaccgggttaaccgggtaaaccgggggttaaaccggtaaaccggtaaaccgggtttaaaacccgggttaccgggtttaacgggttacccggtaaccgttaacccgggtaacccgttaacccggtttacccgggtttacccggtttaaccgtttcccccgg

SEQ ID NO: 126329 - DNA, 554 bp, Homo sapiens
  misc_feature: GYAE6OF02G24JW.4.38.D05.1.454.CMB.1.raw
  modified_base (226)..(226): a, c, t, g, unknown or other
  misc_feature (226)..(226): n is a, c, g, or t
  modified_base (498)..(498): a, c, t, g, unknown or other
  misc_feature (498)..(498): n is a, c, g, or t
  modified_base (524)..(524): a, c, t, g, unknown or other
  misc_feature (524)..(524): n is a, c, g, or t
  modified_base (531)..(554): a, c, t, g, unknown or other
  misc_feature (531)..(554): n is a, c, g, or t
tcagagcactgtagcacgaccggtgctcgatttagtatctgatagttgggtttaagtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggccctcggacagcgccattatattacngtgacgaaaaccagtagcagcctccaccccgtaaggactttgactactggggccacggggaaccctggtcactcgtcctcctcacgcctcccaaccaacgggccccatccggtcccttcccccgtggccaccccttccacccaagcgccctacctccgtgggggccacgacggccgggtcccctcgggggcctcggcccgtacgggtccgaaacggtaccttaccctttacccctacgtaacggtccgtctccggttgacgggtcccggggngttcggacgtacggccgagactacgnagcagcnnnnnnnnnnnnnnnnnnnnnnnn

SEQ ID NO: 126330 - DNA, 812 bp, Homo sapiens
  misc_feature: GYAE6OF02J3BND.4.38.D05.1.454.CMB.1.raw
tcagagcactgtagcacgaccggtgctcgatttagtatctgataggttgggtttgggggagtctccctcactgcccagctgggatctcagggcttcattttctgtcctccaccatcatggggtcaaccgccatcctcgccctcctcctggctgttctaccaaggagtctgtcgccggaggtgcagcgtggtgcagtcgtggagcgaggaaggtacggaaaacggcccggggattctcgtagaagtactcctccgtaggttaagggttcgaggtaactacgtacttacgttaacggtacctaacgtggtacgtcggtcggtcggggtcgccggaccggtaacgggttccgggaaccccggggtaaaggtcccggtaaggtaacggtaggtacggtacggggtactacgtacgttctacgtcgttagactaccgtacgtaccgtagtaactaacgtaacgtaactacggtaccggttacccggttaccggtaaccggtacgggtacccgttccggtacccttcccgttaccgtacccgacggtaaccccagtaaaccgtcctacgtaccgacggtaccccgtaccgacccgttccgagtaccggtagggaaccggcctaccggtaacgttacccgaacggggtaacccgtcccgggtacggtaacgaccgttcccgggtaaattaacgttaaccgtttaaccggttacgtaccggacgtaaaacccggtaaacctggtaaccgaccgtaaccgaccccgttaacggttaaccccggtacgtttaccggtaccgttacccgggaccgtacccggg

SEQ ID NO: 126331 - DNA, 589 bp, Homo sapiens
  misc_feature: GYAE6OF02IXM5U.4.38.D05.1.454.CMB.1.raw
  modified_base (199)..(199): a, c, t, g, unknown or other
  misc_feature (199)..(199): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctcaggggaangccaccctctcctgcagggccagtcagagtgttagcagcagctacttaacctggtaccagcaagaaacctggccaggcctcccgaggcctcctcatctagtggtcgctactccagccagggccacgtggcactcccagactaggttcaggtcggctaggtcgggtctagggacagtacttcacctctaccacctactcgagcgagtacgtggacgtccgtaggaacgtagtttcgactagttacgttacttacgtgtacgagtcgtaggttgtaggtacgtcgtaccgtaccggtacgttccggaccgtaacgggaccgtaagggtacggaaactaccgtaaacggtacgttacggtacggtactacggaccaccgtacttccgtgtccg

SEQ ID NO: 126332 - DNA, 596 bp, Homo sapiens
  misc_feature: GYAE6OF02F4R31.4.38.D05.1.454.CMB.1.raw
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (557)..(557): a, c, t, g, unknown or other
  misc_feature (557)..(557): n is a, c, g, or t
  modified_base (560)..(562): a, c, t, g, unknown or other
  misc_feature (560)..(562): n is a, c, g, or t
  modified_base (564)..(567): a, c, t, g, unknown or other
  misc_feature (564)..(567): n is a, c, g, or t
  modified_base (571)..(575): a, c, t, g, unknown or other
  misc_feature (571)..(575): n is a, c, g, or t
  modified_base (577)..(580): a, c, t, g, unknown or other
  misc_feature (577)..(580): n is a, c, g, or t
  modified_base (582)..(582): a, c, t, g, unknown or other
  misc_feature (582)..(582): n is a, c, g, or t
  modified_base (584)..(586): a, c, t, g, unknown or other
  misc_feature (584)..(586): n is a, c, g, or t
  modified_base (588)..(591): a, c, t, g, unknown or other
  misc_feature (588)..(591): n is a, c, g, or t
  modified_base (593)..(593): a, c, t, g, unknown or other
  misc_feature (593)..(593): n is a, c, g, or t
  modified_base (595)..(596): a, c, t, g, unknown or other
  misc_feature (595)..(596): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaacggcctcggacagccgccatatattacngtgacgaaaaccngtacgcagcctaccgaaccccgtaaggcttttagactacgtcggggccacgggaaccctgggtccacgtgtcctcctcacgcctccaccgaacgggcccagttccggtccctttcccccgtggaccctaccccttccctaccgaagacgtaccaacccgtcggtacggggccacgacggcccggtcccgttgggtcctcggtcccgtgggtaccgaaacgggtacccttacccgttaccccgtaagtacgggttcgtaccttcggtaggaccggggtccgggtacgttagggaccgaacgggtcctaccgtatacggngcnnncnnnncgcnnnnncnnnncncnnncnnnncncnn

SEQ ID NO: 126333 - DNA, 799 bp, Homo sapiens
  misc_feature: GYAE6OF02I6WOV.4.38.D05.1.454.CMB.1.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtcttgtctccgaggggaaancgcccaccctctcctgcacgggccagtcagtacgtgtacgcagcagctaacttaacgngtaccagtcagaaaccgtgaccaggctacccgaggtctccctacgaacttacgtacgtcgggtacacgtactacccgaacggccgaacgggtaccctaaccggttacgggtccaaacccgtccccggaaggtaacccgtaacgggttttaccgaaaccgggttttcggggaccttaacggggtttacggggtccgttacgggggaacctaacggtaccgttccgtacttaccgtaccgaccctacggtcaacggttacgaacggaccttacgggacgcccgttaagaaacggttttagtttcggacgttaacggtttagttaggtttaaccctaggtttcccaaagggtcccgtaggtttacgttacgggtaccgttaaccggtttaccgaccccgggtaacgtttacccgggaacccgggaaacgggacccggtaaacgggtttaacgggaaaacttaacccggttaaaaccggaacgttttaaccggcggttaacccgtcgggtaaccctacccgtaacgttccggtaactttcccgg

SEQ ID NO: 126334 - DNA, 546 bp, Homo sapiens
  misc_feature: GYAE6OF02GDN6Y.4.38.D05.1.454.CMB.1.raw
  modified_base (437)..(437): a, c, t, g, unknown or other
  misc_feature (437)..(437): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccgggggagtctctgaagatctcctgtaagggttctggatacatcttaggacctactggatcggctgggtgcgccaggtgcccgggaagggcctggaagtggagtggggatcgatctatcctgatgactctgataccagatacagtccgtcttcgaacggccgcgtcaccttctcagccgacaacgtcatcagaccaccgccctactgcgagtcggagcaaccgngaacggccgacggacagccgccaatactacttacgtgtacgacgaaaccgagtaagcacgtacctccgaacccggtaaggtacctttgaccgtacggtgggtaacccgg

SEQ ID NO: 126335 - DNA, 681 bp, Homo sapiens
  misc_feature: GYAE6OF02GAG0P.4.38.D05.1.454.CMB.1.raw
  modified_base (241)..(241): a, c, t, g, unknown or other
  misc_feature (241)..(241): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctaccgaagggaaagagcccacccgtctccgtgaccgagggccagtcagagtntagcagcagtacctacttaaccgtggtaccagcaacgaacctcggccacggcctacccgaggtcctaccctcgtactcgtacgtggtcgaccactccgagcgaccgggcacgtggaccactccaagtacgtagttacgaggtcgaccggtaggttcgggtacgtcgggaacgtacgtacttcaccgtctaccgacctacgtaccgacgtaccgacgtacggtacggaacgtcgttaaggaagttacgtttgacgtaggttactttaacgttacgttactacggtacgtacgtaacggttggttacggtacgtaccgttacccgtaccggttaaccggttaccggaacccggaacgggtaccgtaagggtaacgaaacggttaaccgaaacggttagtacggtggacgttcgaaccgtaccgtacgttcgttagttacccg

SEQ ID NO: 126336 - DNA, 853 bp, Homo sapiens
  misc_feature: GYAE6OF02F8POX.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctagaagatctcctgtaagggttctggatacatctttaggacctactggatcggctgggtgcgccgaggtcgacccggggaaaggccgtaggaagtgggagtgggggatcgattcttacgtccgtagtatgtaccttctagtaactaccgtaagtaactaacgtacggttcccggttaccgtttacggaaacgggtcccggtaccgttacccgtaaccccttttccgtaccgtaaccgggacccggtaaaccgtaaaccgggttaccctaagttacccgaaacggtaccccggaaacccccgttacccccgttaaacccgttacgggaacccgttaacgggtaccgggggtaaccggtacccgtaaccgggtacccgttaaacggggtaaccggggtcccccggttaacccgggggtaacccggaaccgggtacccggaaccccgttaacgtttaaaaccgttaacgttttaacccgttacgggttaaccgggaaaccccggttaaaaaaccgtacgggttaaaccggtaccgtaaaccggtcccgttaaccccggtaacccccgggtttaaacgggtttaacccgtttttaacggtaaccccggtttaccggggttaaccccgggggg

SEQ ID NO: 126337 - DNA, 611 bp, Homo sapiens
  misc_feature: GYAE6OF02IN2FY.4.38.D05.1.454.CMB.1.raw
  modified_base (390)..(390): a, c, t, g, unknown or other
  misc_feature (390)..(390): n is a, c, g, or t
tcagagcactgtagcacgaccggtgctcgatttagtatctgatagttgggtttgggggagtctccctcactgcccagctgggatctcagggcttcatttttctgtcctccaccatcatggggtcaaccgccatcctcgccctcctcctggctgttctccaaggagtctgtgccgaggtgcagctggtgcagtctggagcagaggtagaaaaagccgggatctctgaagatctcctaggtaagggttctggatacattctttaggaccttacgtggagtcggtcgtgggtcgcgccgagggtccggacccggggaaaggtccgtagggaagtgggtagtagggggatacgtatacgttactcctagtatcgactcgtagactacagatacncgttcctcgtacgaacgtccgcgtcaccttcacacgaccgactacgtacactacgacgacccgtaccgtactaccgtgacgagtcggagcgacgcgtacgacggaccgtacggacacggcctactaagttactagttacgtaggtacgaaccgtaacgaacggtacgtacgacgaccgttaccgaacccggttacgtacgtttaccgacgtacggtacggg

SEQ ID NO: 126338 - DNA, 685 bp, Homo sapiens
  misc_feature: GYAE6OF02GGDRP.4.38.D05.1.454.CMB.1.raw
  modified_base (283)..(283): a, c, t, g, unknown or other
  misc_feature (283)..(283): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggagtctctagaagatcgtcctggtaagggttctggatacattcgttaggacctacgtggatcggngtgggtcgcgccgaggtcggacccgggaaaggccgtaggaagtggagtggggtatcgtatctattccgtgatcgactcgtagactaacagtactacgtacgtacccgttccgtacggtaacggcccgtacgtcctacccttcgtaccgtaccggaccgtaacgtaaactacccgtactaccgaacgacccgtacccgtacccctaccgtacgtacgacggttacggacgcctaacggcccgttacgggaaccgggtccccgtacgggaaccgacgaccgaacccgtaattaacgttaacttacgttacggtaaccggaaccgaaaccgtaaggtaccgacgtacgtaccgtacccgaaccccgggttaagtaccgtttacggtacgttaccgggtaccgggg

SEQ ID NO: 126339 - DNA, 595 bp, Homo sapiens
  misc_feature: GYAE6OF02GO0JF.4.38.D05.1.454.CMB.1.raw
  modified_base (190)..(190): a, c, t, g, unknown or other
  misc_feature (190)..(190): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (573)..(579): a, c, t, g, unknown or other
  misc_feature (573)..(579): n is a, c, g, or t
  modified_base (582)..(588): a, c, t, g, unknown or other
  misc_feature (582)..(588): n is a, c, g, or t
  modified_base (590)..(595): a, c, t, g, unknown or other
  misc_feature (590)..(595): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcggaaggccgcgtcaccttctcagccgacaagtccatcagcaccgcctacctgcagtggancagcctgaaggcctcggacagcgccatatattactgtgacgaaaaccagtagcagctccacccgtaagactttgactacgtgggccacgggaccctggtcacgtcgtctcctcacgccctccaccgaacgggcccagttccggtccttcccccgtcggccctaccctcctaccgaacgcgacctacccgtcggtacgggggccacgacggcccgggtcccggtcgggtaccgtcggtcccgtacgggtaccgtaaacgggtacccttacccgtttaccccgtacgtaggttaccgtccgttcgtacgggaccgggtccggggtccgttacggggacccggaacgggtacccggtacgtacgtaacggtcagtgctcgncgncnnnnnnncgnnnnnnncnnnnnn

SEQ ID NO: 126340 - DNA, 701 bp, Homo sapiens
  misc_feature: GYAE6OF02H3755.4.38.D05.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccgaccggataaattggtgttgacgcagttctccaggccaccctgtctttgctccgaaggggaancgcctacccctntcctgcgagggccagtcagagtgtagcagcagcttaacttactggtaccagcaagaacctggccaggctcccaggctccntatctatggtgacnctccagccgtagggccctacgtggctactacccgaagacgtcggttaccgnggtcgtacggnggtttgggacgttgggacgtaacgaccgttttacaccttacccgtgaaccctaacgtaccgtacgacgtaacgacgtacggaggtccgtaaggaagttaagtttttgacgtaacgtttacgttaacgtttacgttgtaccgtaggtacgtacgggttagttacgggttacgtaccgttaccggaacccggttacgggttaacccgggtacggtaaccgggtaaccgtaaacgggtacgggtaaaacgtaccggtaaaacggtaaaccgttacggtaacgggtaccgttacggacccgttaaccgtacctttaccgttacgtttacccg

SEQ ID NO: 126341 - DNA, 645 bp, Homo sapiens
  misc_feature: GYAE6OF02FWCFQ.4.38.D05.1.454.CMB.1.raw
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (440)..(440): a, c, t, g, unknown or other
  misc_feature (440)..(440): n is a, c, g, or t
tcagagcactgtagcacgaccggtgctcgatttagtatctgatagttgggtttggggggagtctccctcactgcccagctgggatctcagggcttctattttctgtcctccaccatcatggggtcaaccgccatcctcgccctcctcctggctgttctccaaggagtctgtgccgaggtgcagctggtgcagtctggagcaggaggtagaaaaaggcccggggagtctcgtagaagtatccttccgtaggttaagggttctggatacattcttttaggacctactggatcggntgggtncgccagggtcgacccgggaaggctggaagtggagtggggatcagtctaactccgtgatcgtactcgtgactaccaagatacgacgttccgtactacggaggcccggtactccctacttctcgacgcccgactaacgacacncacgtccacccggtccctaccgtgacgaggtcggaagccgacgtccgtaggaccggccgtaccgggacgtacggacctacctaagttaattaccgttacgtcggttacgaaacccggaaactaaccggtagaccgacgttacccgaacccggtaccccggttaaaccggttcctttaacggtaccgttaccgggtaacccggggg

SEQ ID NO: 126342 - DNA, 784 bp, Homo sapiens
  misc_feature: GYAE6OF02G7AAX.4.38.D05.1.454.CMB.1.raw
  modified_base (256)..(256): a, c, t, g, unknown or other
  misc_feature (256)..(256): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaagcgccaccctctcctgcgacgggccagtcagagtgtagcagcagtctacgttaccnggtaccagcagaacctggaccaggcctcccgaggcctcctcatctagtggtcacactccgagccgacgggcctacgtcggacctacgtacccgaagtaccgtacggtttacgacggttcgggacgtaggggttcggggttaccgtacgggggaacctacgggtaccctttaccgaacccttccgtaacccgaacctacgtaccgacggaccgtaacggtaaccggtgggaacgtacccgttaaggtaaacggtttacgttttacggacgtttaacggtttagtttaacgtttacgttacgtaacggtacggtaccgttaagggttcgggtttaagggttaccggtacccgtttaaccgggtaacccgggttaaccgggttaaccccggggaacccgggtaaagggggtacccggtaaaggggttaaccggtaaaacgttaaacccgggtaaacggttaacggttaccgggtaccgggttacccgtaacggtacccgtaaccgttacgtttacccggttacgttacccg

SEQ ID NO: 126343 - DNA, 771 bp, Homo sapiens
  misc_feature: GYAE6OF02G3PRB.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaaggcccggggagtctctagaagatctcctggtaagggttctggatacattcgtttacggacctacgtggatcggcgtgggtcgcgccgagggtcggacccggggaaaggccgtagggaagtgggagtggggatacgtattctatccgtagtatcgtactcgtagactaccgagtaactaccgtacgttcccgttaccgttacggaaccggtcccggtacccgttacctacccgtttaccgtaccgtacggtacccgtaacgtaaaccgttacccctaacgttaccgaacgtaccccgtaaccccggtaccccttaaccgttcgacggtacgggtacgggaccgtccgaaccggtaccgtacgggtaacccgggtcccggtaccgggaaccgtaccgggaccgtacccgtaaattaacgtttacgttaaccgttacggttaaccggaaacccggtaaaaccgttacggttaacgtaacccgaacggttaccccgtacccggttaaacccggttaacggttacccggttttacggtaaccgggttacccgggtaacccggggg

SEQ ID NO: 126344 - DNA, 815 bp, Homo sapiens
  misc_feature: GYAE6OF02JSRZ3.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaacggcccggggatctcgtgaagatctccgtgtaagggttctggatacattcgtttacggacctacgtggatcggcgttgggtgccggaccgagggtacggaccccggggaaaaggtccgtagggaacgtgggaaggtgggggtactacgtaactccgttaactccgttaggaacgttcgtaccgttacgtagggtaaacgttaacccaaggttaaccttaaccgtacgggttcccggtttaccgttaaccggtaaacgggtccccggtaaccggttaccccttaacccgtttcccggtaccgtaaccccgggtaacccgtaaacccgtaaaccggtaccccgtaaacttacccgaacgggtacccgtaacccccggtacccttaaccgaccggtacgtaacgggtaccgggtagacccgtacggtaccccgtaaggaacccggtcccggtaacgaaccggaccggaccgtaacccttaagttaacttaacgtttaccgtacggtacgtaaaacccggtaaaccgtaaggtaccggtaaccgacgtaccccgttacccgaaccccggttaggtaaccgttttacggaccgtaccgggtaaccgggg

SEQ ID NO: 126345 - DNA, 727 bp, Homo sapiens
  misc_feature: GYAE6OF02I5EQ9.4.38.D05.1.454.CMB.1.raw
  modified_base (165)..(165): a, c, t, g, unknown or other
  misc_feature (165)..(165): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
tcagagcactgtagcacgaccggtgctcgatttagtatctgatagttgggtttgggggagtcgtccctcactgcccagctgggatctcagggcttcattttctgtcctccaccatcagtgggtcaaccgccatcctcgccctcctcctggctgttctccgaaggngtctgtgccgaggtgcagcgtggtgcagtcgtggagcaggaggtagaaaaacggcccggggtagtctcgtaggaagtactccgtaccgtaggttaacgggttcgtaggtacttaacgtattacgtttaacggacccttagtacggtacgtcggtcgtgggtccgcggtaccgtagggtccggaacccgggaaggtccgtaggtaaagtcggagtcggggtacncgtattcgtacgtcgtaggtntacgtactacgtagtaacctacgacggtaactacgtacgtccgtacgttacggaccgccgtcgtaccgtaccttcgtccgaacggacccgtaacgtaccgtacctacgtccgtaaccgtcctaacccgtccgtaccgcgtacgtaggtaccgacgtcgaaccggtcgacgtaccggtacccgacggtaacgtccggaaccgtacgtaacgttaacgtacgttacgtaccgacggtaaaccgtaacggtaacggtacaccggtactacccgtaccgttaccggtaaggttaccgttacgtacccggttaggacccgggg

SEQ ID NO: 126346 - DNA, 602 bp, Homo sapiens
  misc_feature: GYAE6OF02G6J1E.4.38.D05.1.454.CMB.1.raw
  modified_base (238)..(238): a, c, t, g, unknown or other
  misc_feature (238)..(238): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (582)..(585): a, c, t, g, unknown or other
  misc_feature (582)..(585): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
  modified_base (592)..(597): a, c, t, g, unknown or other
  misc_feature (592)..(597): n is a, c, g, or t
  modified_base (600)..(602): a, c, t, g, unknown or other
  misc_feature (600)..(602): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggccgtcggacagcgccatatattactgtgacgaaaaccngtagcacgctccaccccggtaaggactttgactacgtggggccacgggaccctggtcacgtgtctcctcagcctccaccacgggcccactcggttccttcccccgtggccaccctcctccaacgacgccacctcggtcgggggccacgaggccggcccgtcggggtccttcgggccgttcgggtacgtaaacgggtaaccctttacccgtttacccctaaccgtaccgggttacgcccgtttcctacggggtaccgggcccgggggtccgtttaccgggggacccgtaaacgggggcccgtaacccgtaagtaaccgggtagccgngcgcgngngngncgngannnngnncngnnnnnngcnnn

SEQ ID NO: 126347 - DNA, 687 bp, Homo sapiens
  misc_feature: GYAE6OF02IGCTH.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgcatcctcgccctcctcctggctgttctccaaggagtctgtgccgaggtgcagctggtgcagtctggagcagaggtagaaaaaacggcccggggatctctgaagatcctccgtaggttaagggttctggtatactattctttaggaacctacgtggagtcggcgtgggtgcgcgaggtgacccgggaaaggccgtggaagtggagtgggatcattcgtatcctgatagtactctagactacgaagtactaacgacgttcccgttccgtacgaacgggcccgtaccgtccgtaccctttctaccgacgtacccgaacgtaacggtccctaactcgacgtcccaaccggtacccttactcggacacgggttacgggacgtcgaacggtccgtacggtaacgggccctacggggtaacaccgggtccgtaaccctaagttaaccgttactttaacgttcggtaacgtaaccggttaaaacccgaggttaacgaccgtaaccgtacccgtaccgaaccccggtttaacggtacctttacggtacccggtaggtaccccgggggg

SEQ ID NO: 126348 - DNA, 601 bp, Homo sapiens
  misc_feature: GYAE6OF02GND88.4.38.D05.1.454.CMB.1.raw
  modified_base (392)..(392): a, c, t, g, unknown or other
  misc_feature (392)..(392): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccgaggtgcccgggggaaggcctggaatggagtggggatcatctatcctgatgactctgataccagatacagtccgtccttcggaacggccgtccgtctacctttcncgacgccgaacaacgtccaatcacgccacccgccctacctgctagtcggagccgagcccgttaggacggtcccgtcggaaccgcggaccgtacctaattacgttaactttcgtacggttagaacccggaaaaccgtaggtaaccgacgacggtcctacccgaacccgggttaaacggtaccgttttacggaccgtacggtacccggggg

SEQ ID NO: 126349 - DNA, 701 bp, Homo sapiens
  misc_feature: GYAE6OF02H4DIZ.4.38.D05.1.454.CMB.1.raw
  modified_base (216)..(216): a, c, t, g, unknown or other
  misc_feature (216)..(216): n is a, c, g, or t
  modified_base (296)..(296): a, c, t, g, unknown or other
  misc_feature (296)..(296): n is a, c, g, or t
tcagagcactgtagcacgaccggtgctcgatttagtatctgatagttgggtttgggagagctgctcagttaggacccagagggaaccatggaaaccccagcgcagcttctcttcctcctgctactctggctcccagatacccaccggagaaattgtgttgacgcagtctccaggccaccctgtctttgtctccaaagggtaaagcgacccaccctntccctgccgaggccagtcagagtgttagcagcagctactaactggtaccagcagaacctggccaggcctccagctacctnatctatgtgctatccagcgacgggccaacgtggactacgcccaggtaccgaggtttcccgaaggttcggctagggttacgggttccgtaggggaccagtaaccctttccgaaccgttctcccgaaaccctagttacccgaacgtacctaacggtaaccgtacgggtaacgccgttaagaacgttacgttttagaccggtttaagttacgttaacgttttaacgtggtaccgtaacgtaccgttaaggttcgggtagttacgtccgttaaccggtacccggtacggttacccgggtaccgtaaacgggtaccggaagggttacgggaaacgttaaccggtaaacgtaaccggttaaggtccggtaccggttacgacccgtaaccgtacttaccgttacgttacccg

SEQ ID NO: 126350 - DNA, 928 bp, Homo sapiens
  misc_feature: GYAE6OF02HX62X.4.38.D05.1.454.CMB.1.raw
  modified_base (180)..(180): a, c, t, g, unknown or other
  misc_feature (180)..(180): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcngctggtgcagtcgtggagcaggaaggtagaaaaacggcccggggagtcctcgtagaagtactccgtccgtaggttaacgggttctaggatacgatttacgttttaacggaacccttaccgtgggtatccgggtcgttaggggttcgccggcccgtaagggtaccgggaaccccggggaaacgggtcccgttaggggaaacgtggggaagttcggggggacttaccgtaagttcccttaacgttcccgttaggacgttacggtaccttacgtacgtaacttaacccgaaggtaactaacgtaaccggtttcccgttaccggtttaacccgggaaacggggtccccggttaccgttacccgtacccttttaccgtacgaacccggacccgtaaaccgtaaacggtacccctaacttaccgaaaccggccccgaaacccccggttccccgttaaacccgtacggtaccggtaaggttaccggggaacgacccgtaaccggtcccgttaaacgggaacccgggtaccccggttaacccgggaacggtaaccgggtacccgtaacccgttaaaattaaccgttttaaccgttaaccggttacgggtaaacccggtaaacccggtaaaaacccggtacggttaaaccggtaccgtaaaccgggtcccctttaacccccggaaaccccgggttttaaaccgggtaacccgttttttacgggtaacccgttaacccggggttaaaccccggggggg

SEQ ID NO: 126351 - DNA, 517 bp, Homo sapiens
  misc_feature: GYAE6OF02GTE6K.4.38.D05.1.454.CMB.1.raw
  modified_base (314)..(314): a, c, t, g, unknown or other
  misc_feature (314)..(314): n is a, c, g, or t
  modified_base (445)..(445): a, c, t, g, unknown or other
  misc_feature (445)..(445): n is a, c, g, or t
  modified_base (487)..(487): a, c, t, g, unknown or other
  misc_feature (487)..(487): n is a, c, g, or t
  modified_base (489)..(493): a, c, t, g, unknown or other
  misc_feature (489)..(493): n is a, c, g, or t
  modified_base (495)..(517): a, c, t, g, unknown or other
  misc_feature (495)..(517): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaacggcctcggacagcgccatatattactgtgacgaaaaaccagtagcagcctccaccccggtaaggtactttgactacgtggggcccagggaaccctggtcactgcctctcacgccnccaccaacgggcccagtccggtcccttcccctgccaccctcctaccaagcgccaccgtcgtcggggcacgacgccggcccgtggctcgccgtaggtcgaacggtaccttaccgttccctacgtacggttcncgtcgtcgacggccgggcgtcggacaacgggcgactagtcgngnnnnncnnnnnnnnnnnnnnnnnnnnnnn

SEQ ID NO: 126352 - DNA, 618 bp, Homo sapiens
  misc_feature: GYAE6OF02HLKJU.4.38.D05.1.454.CMB.1.raw
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
  modified_base (326)..(326): a, c, t, g, unknown or other
  misc_feature (326)..(326): n is a, c, g, or t
  modified_base (459)..(459): a, c, t, g, unknown or other
  misc_feature (459)..(459): n is a, c, g, or t
tcagagcactgtagcacgaccggtgctcgatttagtatctgatagttgggtttggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggatctcgtgaagatcncctggtaaggttctggatacattctttaggacctactggatcggntgggtcgcgccgaggtcgcccggggaaggcctggaatggagtggggatnaagtctagtcctgatgactctagactacgagtaatacacgtccgtcgttcgaaggtccgacgtccctacttccgtccagacccgaacaacggtcccaagtcaacgtcccaccgccctacgacgtcgagtcggngaccgcggtcgtacggaaccggccgtaccgggtacgacggcgaaccgagtaacttacgttacgtgtacggaccgtaaaacccgaggttacggacctaccggtaccgtacccgtaaccccgttagggttaccgtttaaccgtaccgttacggtaccgggg

SEQ ID NO: 126353 - DNA, 269 bp, Homo sapiens
  misc_feature: GYAE6OF02JO2UO.4.38.D05.1.454.CMB.1.raw
  modified_base (96)..(96): a, c, t, g, unknown or other
  misc_feature (96)..(96): n is a, c, g, or t
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (248)..(269): a, c, t, g, unknown or other
  misc_feature (248)..(269): n is a, c, g, or t
tcagagcactgtagcacgaccggtgctcgatttagtatctgatagtgggtctgggacagacttcactctcaccatcagcagactggagcctgaagnttttgcagtgtattactgtcagcagtgtggtagctcacgacgttcggccaaggaccaaggtgaaatcaagaactgtgntgcacatcgtntacttcatccttcccgctatctgactangtcgcttgcgaggtcgctggnaacggnctatgnannnnnnnnnnnnnnnnnnnnnn

SEQ ID NO: 126354 - DNA, 683 bp, Homo sapiens
  misc_feature: GYAE6OF02IC8IP.4.38.D05.1.454.CMB.1.raw
  modified_base (272)..(272): a, c, t, g, unknown or other
  misc_feature (272)..(272): n is a, c, g, or t
  modified_base (411)..(411): a, c, t, g, unknown or other
  misc_feature (411)..(411): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctcggctcccagactaccaaccggagtaaattgtcgttgaccgctagtctccaggcctaccctgttctttgtcctaccgaaagggaaacgcgcccaccctctcctggacacgggccagtcagagttgtagcagcagtctacttacngtacagcagaacctggcacgcgtccacggtctctcactctagtgtcgcactcagctacggcctacgcgacactccgacacgtacggtcacggtgacgtcgggtcgggtcgacgggactacggttaccttcgtacctacncctacctactccgacgacgaacgtcgtacgggtacgtccgtaggtaagttcgtttcggacgttattacggttaacgttacgtgtaccgttagtaccgtaggttcggtacggtaactccggttacccgtacgggttaaccggttcccggtaaaccgggtaaccgggaaccggttaaggggtaaacgtaaaccggtaaaccgtaaacggttaacccggttacgggtacgtaccgttacggaccttaacccgtaagttcccttaggtttaccccg

SEQ ID NO: 126355 - DNA, 697 bp, Homo sapiens
  misc_feature: GYAE6OF02II16F.4.38.D05.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
tcagagcactgtagcacgaccggtgctcgatttagtatctgatagttgggtttgggagagctgctcagttaggacccagagggaaccatggaaaccccagcgcagcttctcttcctcctgctactctggctcccagataccaccggagaaattgtgttgacgcagtctccaggcaccctgtctttgtctcgaggggaaagcgccaccctctcctgcgagggccagtcagngtgttagcagcagctacttacngacagcagaaccngcagctccngctctcatctagtggtgcactccagcgacggccacgtgacactccgagacgtaggttcaggtcggctagggttcgggtacgtggggaccacggtaccttacgtaccttcgtaccgtaaccgtacgtacgaacgtaccgtaacggtaaccggtacgggtaccgtaccgttaagggtaaacggttagtttttacggaaccgtttaaggtttacgttttaacgtttacgtcggtacgtacggttaccggtagggtttacgggttacgggttaacgtccggttaacccgtaacccgggttaaccggtttacccggggaaacggtaaccggggaaccggttaagggtaacggaaacgttaaccggtaaacgtaacggtaggtaccggtaccgtacggtaaccgtaccgtagttccgttacgttacccg

SEQ ID NO: 126356 - DNA, 805 bp, Homo sapiens
  misc_feature: GYAE6OF02GYLUL.4.38.D05.1.454.CMB.1.raw
  modified_base (202)..(202): a, c, t, g, unknown or other
  misc_feature (202)..(202): n is a, c, g, or t
tcagagcactgtagcacgaccggtgctcgatttagtatctgataggttggggtttggggagagctgctcagttaggacccagagggaaccatggaaaccccagcgcagcttctcttcctcctgctactctggctcccagactaccaccggagaaattgtgttgacgcagtctccaggcaccctgtctttgctcgaggggaangccacctctcctgcagggccagtcagagtgtagcagcagtctaacttaaccgtggtaccaggacaacgaaacctggaccaggccctacccgaggcctacctcacttacgtagtcggtacgcactccgaaggccgagggcccacgtgggacctacgtcccgagtacgtacggttaccgaggtcggacgtagggttcgggtacgtaggggaacacggttacgttaccaccgttccgtaccgaccgtacgtaccgaacgacgtaacgtaccggtacggaccgtacccgttaagggtaaacgttacgtttttacggaacgtttaacggtttacgtttaacgtttaaccgttagggtacctaacggtaccgttagggttacggggtttacgggttaaccgtcccgttacccggtaaacccgggtttaccggttaacccgggaaccgggtaaacccgggtaaccgggttaaacggggttaaaccggtaaaacggttaaacccggtaaaccgggttaaaccggttacggggtttaaccgggtaaccgtttaaccggtaaaccccgttaaaccccgtttaacgggtttaccgttttaccggtttaaccccg

SEQ ID NO: 126357 - DNA, 758 bp, Homo sapiens
  misc_feature: GYAE6OF02IWSAP.4.38.D05.1.454.CMB.1.raw
  modified_base (177)..(177): a, c, t, g, unknown or other
  misc_feature (177)..(177): n is a, c, g, or t
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagatacccaccggagaaattgtgttgacgcagtctccaggcnccctgtctttgtctcgagggaaanacgcccacccttctccgtgcacgggccacgtcagagttgttagcagcacgcttaacttaccgngtaccagacacgaaaccgtcggccaggcctacccgnggtcctctctagtctagtggtgcnctccgagcgacggccacgtcggactaccgaccccgaagtaccgtacggttacgacgggttacggcggtaaccgggtttgggggtccgtacgggggtaaacctacggttaacccgtttaccgttacccgttaccctaccgtaaacccgttaacgttaccaaccggtacgaaacgttacccggtaaggacggtacccgttaaggttaaaccgtttagtttcggtaacttaaggttactttaccgtttaacgttcggtacgtacggtaccgttagggttcggtaaggttacgtaccgtaccggtaaccggtaccggttaaccgggaaccggtaacgggacgtaaacgggttaaccggtaaagtaaacccggtaaaacgtaacgttaccggtacggtaccgtaaccggtaaccgtaacctaccggttactacgtttcc

SEQ ID NO: 126358 - DNA, 212 bp, Homo sapiens
  misc_feature: GYAE6OF02IMESG.4.38.D05.1.454.CMB.1.raw
  modified_base (210)..(212): a, c, t, g, unknown or other
  misc_feature (210)..(212): n is a, c, g, or t
tcagagcactgtagcacgaccggtgctcgatttagtatctgatagttgggtttgggcggtgctcgatttagtatctgatagttgggtttggggggaagaggaagactgacggtcccccaggagttcaggtgctgggcacagcggccctgggctgcctggtcaaggactacttccctacagtgctctgagcgggctggcaaggcgcatagnnn

SEQ ID NO: 126359 - DNA, 211 bp, Homo sapiens; identical to SEQ ID NO: 125880
  misc_feature: GYAE6OF02JEHH0.4.38.D05.1.454.CMB.1.raw
  modified_base (209)..(211): a, c, t, g, unknown or other
  misc_feature (209)..(211): n is a, c, g, or t

SEQ ID NO: 126360 - DNA, 825 bp, Homo sapiens
  misc_feature: GYAE6OF02HK57T.4.38.D05.1.454.CMB.1.raw
  modified_base (688)..(688): a, c, t, g, unknown or other
  misc_feature (688)..(688): n is a, c, g, or t
  modified_base (693)..(693): a, c, t, g, unknown or other
  misc_feature (693)..(693): n is a, c, g, or t
tcagagcactgtagcacgaccggtgctcgatttagtatctgatagttggggtttgggggagtctccctcactgcccagctgggatctcagggcttcattttctgtcctccaccatcatggggtcaaccgccatcctcgcccctcctcctggctgttctccgaaggagtctgtgccgaggtgcagctggtgcagtctggagcaggaggtagaaaacggcccggggatctcgtagaagactcctccgtaggttaacgggttctaggaattactaatttccgtttaacggaccttacgtagggtacgtccgggtggtcgggggttcgaccggtaccggtaaggggttaccgggaaccccgggggggtaaaacgggtacccggtaagggggaaacgtttagggggtagggttacggggggtaacttccggtaaactttacccgttaacgtttaccggttaggtaacgttcggtaaccctttacgttacgggtaaccttaaccggtaaacggtaaactttaacccggttaccggttaccccggtttacccgttaacggggaaacccgggttccccggacccgtttaccctttacccgtttccgtaccggaacccgtaccccggaaacgtaaccggttaacctacgttacccacggtacccaaccccggtaccctaacccgtgacggttacggnggacnccggtaacgcctacgggaaccgggacctacggacgacgtcgacctagtactagtacctgtaacgaaccgtaaacgagtacactcgaccttacccggaacggttaacgtcgttaacgccggtacgtaccgggg

SEQ ID NO: 126361 - DNA, 606 bp, Homo sapiens
  misc_feature: GYAE6OF02GW0I0.4.38.D05.1.454.CMB.1.raw
  modified_base (446)..(446): a, c, t, g, unknown or other
  misc_feature (446)..(446): n is a, c, g, or t
  modified_base (462)..(462): a, c, t, g, unknown or other
  misc_feature (462)..(462): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtgttagcagcagctactacgtggtaccagcagaacctggccaggcctcccgaggctcctcatctagtggtcgcactccgagcgacgggccacgtggccaactcccgagacgtaggttccgaggtcggacgtaggtcgggtcgtagggactacgtaccttcgaccttcaccacactcagacgagaccgtggacgtccgtaggtaactgtttacgngtagttgtaacttcgngtacacggtctaggtcgtaggtacgtcctccgaaccggttacggtaccgggaccgaacgggtacgaagggttaaccgaaacgtaaccgtaaacgtacggtcggtacgtacggacgtacccgacgttacgttcgtacgttacccg

SEQ ID NO: 126362 - DNA, 233 bp, Homo sapiens
  misc_feature: GYAE6OF02G2WIZ.4.38.D05.1.454.CMB.1.raw
  modified_base (207)..(233): a, c, t, g, unknown or other
  misc_feature (207)..(233): n is a, c, g, or t
tcagagcactgtagcacgaccggtgctcgatttagtatctgatagttgggtttgggcggtgctcgatttagtatctgatagttgggtttgggggaagaggaagactgacggtccccccaggagttcaggtgctgggcacagcgcctgggctgcctggtcaaggactacttccctacagtgctctgagcgggctggcaggcacatagnnnnnnnnnnnnnnnnnnnnnnnnnnn

SEQ ID NO: 126363 - DNA, 917 bp, Homo sapiens
  misc_feature: GYAE6OF02GT91N.4.38.D05.1.454.CMB.1.raw
  modified_base (197)..(197): a, c, t, g, unknown or other
  misc_feature (197)..(197): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggancagaggtagaaaaacggcccggggagtctactagaagatctccgtaggtaagggttctaggaatactaacttcgtttaacgggacccttaacgtagggaacttccgggacgttaggggttacggaccggtcccgaaggggttccggaaccccggggggtaaaaagggtcccgttaggggtaaagttggggaacggttaggggggtaacttcgtaacttaccgtttaaacgttcccgttaggaacgttacggtaaccttaccgttagggtaaaccgttaaaccccgaaggttaaacgttaacccgttaacgggttaccccggtttacccgtttaacgggaaaaccggggtccccggtacccgttaaccgtaaaccccgtttccgttaccggtaacggaaccccggtaaacgtaaacccgggttacctaaaccgttaccgaaacggtacccggtaacccccgtacccggtttaaaccgttcgggaaccgttaacggggtacgggtaaacgcccggtaaaccggtacccggttaacgggtaaacccgggtccccgttaacggggacccgaacggtacccgacccgtaaactttaacgtaacgtttacgtacggtaaccggtaaacccgtaaaaacccgtaggtaaccgccgtaaacgtccccgttaaccgaaaccccggttaaagggttaccctttaggtaccgttaaccgggtacccggggg

SEQ ID NO: 126364 - DNA, 530 bp, Homo sapiens
  misc_feature: GYAE6OF02F4QVC.4.38.D05.1.454.CMB.1.raw
  modified_base (192)..(192): a, c, t, g, unknown or other
  misc_feature (192)..(192): n is a, c, g, or t
  modified_base (458)..(458): a, c, t, g, unknown or other
  misc_feature (458)..(458): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (504)..(530): a, c, t, g, unknown or other
  misc_feature (504)..(530): n is a, c, g, or t
tcagagcactgtagcacgaccggtgctcgatttagtatctgatagttgggtttaggtgcccgggaaaggcctggaatggatggggatcatctatcctgatgactctgataccagatacagtcccgtccttcgaaggccgcgtcaccttctcagccgacaagtccatcagccacccgcctacctgcagtggancagcctagaacggccgtcggacagcgaccataattattactgtacgacgaaaaccgagtagcacgcctaccgaaccccggtaaggtactttgaacgtacggtcggggaccgacgggacccttggtctactcgtactcctcaccgtccctaccaccgacggcctacgtccgtccctcccgcgcccaccctccacacgcgactccgtcggcgggacacgacggccggcccgtggctcgtccgtacggacgacgtaccttcctccgtancgtctcgtcgtaggcggcggtgcggacgaacggcacgtagngcngnnnnnnnnnnnnnnnnnnnnnnnnnnn

SEQ ID NO: 126365 - DNA, 231 bp, Homo sapiens
  misc_feature: GYAE6OF02IL8X7.4.38.D05.1.454.CMB.1.raw
  modified_base (178)..(178): a, c, t, g, unknown or other
  misc_feature (178)..(178): n is a, c, g, or t
  modified_base (210)..(231): a, c, t, g, unknown or other
  misc_feature (210)..(231): n is a, c, g, or t
tcagagcactgtagcacgaccggtgctcgatttagtatctgatagttgggtttggcggtgctcgatttagtatctgatagttgggtttgggggaagaggaagactgaccggtcccccaggagttcaggtgctgggcacagcggccctgggctgcctggtcaaggactacttccctacngtgctctgagcggctggacaaggcgcagtagnnnnnnnnnnnnnnnnnnnnnn

SEQ ID NO: 126366 - DNA, 710 bp, Homo sapiens
  misc_feature: GYAE6OF02GP6VI.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcgaagaggtacgaaaaaaggcccggggagtctctagaagatctcctggttaagggttctggatacattctttaggaccttacgtggatcggctgggtgcgccaggtcggacccggggaaaggcccgtaggaagtggaggtaggggacttcagttctacttccgtgatgactctgaagtaccagtactaacgacgtcccggttaccttcggaacggtccggacgtccaccctttcctcgacggacccgaacctaaacgttccaacttcgaaccgtcccgtaaccccggtcccttaaccgtcgacctaagggtggaacgccgtaacggcccgtaggaaccggcccgttccgggaaacgacggtcccgacctaagttaaccgttaacgttttaccgtacggttaccgaaaccggtaaaacccgttaagggaaccgtccgtaacgccctttaaccggaacccccggtttaaacgggtacccgttttaacggtaccccgttacggtaaccccgggggg

SEQ ID NO: 126367 - DNA, 258 bp, Homo sapiens
  misc_feature: GYAE6OF02IB8QP.4.38.D05.1.454.CMB.1.raw
  modified_base (220)..(258): a, c, t, g, unknown or other
  misc_feature (220)..(258): n is a, c, g, or t
tcagagcactgtagcacgaccggtgctcgatttagtatctgatagttgggtttgggcggtgctcgatttagtatctgatagttggggtttggggggaagaggaagactgaccggtccccccaggagttcaggtgctgggcacaggccggcccgtgggctgccgtggtcaaggacttaccttccctacagtgctctgagcgggctggcaaggccgcagtgnnnnnnnnnnnnnnnnnnnnnnnnnnnnnnnnnnnnnnn

SEQ ID NO: 126368 - DNA, 821 bp, Homo sapiens
  misc_feature: GYAE6OF02HU6PP.4.38.D05.1.454.CMB.1.raw
tcagagcactgtagcacgaccggtgctcgatttagtatctgataggttgggtttgggggagtctccctcactgcccagctgggatctcagggcttcattttctgtcctccaccatcagtggggtcaaccgccatcctcgccctcctccgtggctgttcctaccaaggagtctggtgccgaggtgcagctggtcgcagtctggagcgaagaaggtaggaaaaaacggtccgggggagttcctacgtaggaaacggacttccgttaccgtagggttaacggggtttactagggtaattaactacgtttacgtttaacgggtaacccttagtacgggtaacgttccggtcgttcggggtcgacggtacccgagggttaccgggtacccgggggaaaacggccgttacgggaaaggttgggaagttcgggggaacttcgtaacttacgttacgtccgtagtaacgacgttcgtactacgtaactaaccgaggtaacttacggtacgtacccgtttaccgtacggtaaacgggtcccggaccggttaccctaccctttaccgtacgtacccgacccgtaacgtaaaccctccgaacgtaccgaaccgacccgtaacccggtacccgtaaccgttcggtaccgacggtacggaagccgtacggacgacggtaaccgccgtaacggaacctacggacctacgtaaatacgttattaccggtagtacggaaccggtaaaacgtacggtaaccgacggttaacctccggttaacccgaaccgggttaacgttacccggtttaacggtaacggtccggggttaacccgggg

SEQ ID NO: 126369 - DNA, 666 bp, Homo sapiens
  misc_feature: GYAE6OF02JCNNK.4.38.D05.1.454.CMB.1.raw
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaggcccggggagtctcgtgaagatctcctaggtaagggttcnggatacattcgtttacggacctacgtggatcggtcgtgggtgcgccgnggtcggacccggggaagccgtaggaagtgggagtggggatcgattctactcctgatcgactctagactacagtactactcgtccgtcgtcggacggccgtctctaccctcgacgcgaccgaactaccgtctactcgaccgccctacccgtccctaccgtagtccgacgggtcggacgtccggacgacccgtagggtacccggcccgtaccgggaacgcggtacccgacctaagttacgttaaccgtttacggtactaaccgggaacccgtaaaacgtacggtacgccgtaaccgttacccgacccggttaaccccgggttaaaccggttacgtttaacgggtaacccgttacgggttaacccggggg

SEQ ID NO: 126370 - DNA, 656 bp, Homo sapiens
  misc_feature: GYAE6OF02HU6KF.4.38.D05.1.454.CMB.1.raw
  modified_base (386)..(386): a, c, t, g, unknown or other
  misc_feature (386)..(386): n is a, c, g, or t
  modified_base (446)..(446): a, c, t, g, unknown or other
  misc_feature (446)..(446): n is a, c, g, or t
tcagagcactgtagcacgaccggtgctcgatttagtatctgatagttgggtttgggggagtctccctcactgcccagctgggatctcagggcttcatttttctgtcctccaccatcagtgggtcaaccgccatcctcgccctcctcctggctgttctccaggatctgtgccgaggtgcagctggtgcagtcgtggagcaggaggtaaggaaaacggccggggagtctcgtaggaagtactcctaccggtaggttaagggttctaggtatactagttacgtttaggaccttagtggacgtcgggcgttggtcgcgaccgagggtcggaacccgggaaggtcgtagggaagtcgggaagtgggtactcgtactacgtatcgtagagtnactagtcgaatacctagtactactcgtccgtcgttagaccgtcgtccgtactacccgttnacgtaccgaccgaacgacgtaccataccgaccgacctacccgacctaccgtagaccgttaggcgacgaccgacgtcgacgacccggtcgaccgataccggacctactaagttacgttacgttacgtacgaacgaaaccgtaacttacgacgtacgtaccgtacctaacccgtaacgtagttacccgtttacggaccgtacggtacccggg

SEQ ID NO: 126371 - DNA, 673 bp, Homo sapiens
  misc_feature: GYAE6OF02IR6EI.4.38.D05.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaagngccaccctctcctgcaggccagtcagagtgttagcagcagctacttaacctggtaccagcagaaacctggaccaggcctccaggcctccncatctagtggtgcactccagcgacggccacgtggccactcccacgtacacggttacaaggtcgacgtaggttcgggtcgtacgggtaacgagtaccttaccgtacgttccgtaccctaaccgtagttccgaacgtaccgtaacgggaaccgtgggaacgtccggttagtaacggtttagtttcgacgttagttacgttaacgtttacgtgtacgtagacgttaggtggttacggtactaccgtccggtaaccggtacgggttccgaacccgggtaacgggtaccgggtaaggttaacgggtaaaactccgggtaaaaacgtaaccggttaggtaccggtaaccggtaggtaaccccaacgttacgttaccgtctttacccg

SEQ ID NO: 126372 - DNA, 706 bp, Homo sapiens
  misc_feature: GYAE6OF02IKDMM.4.38.D05.1.454.CMB.1.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaaccgccatcctcgcccctcctcctggctgttctccaaaggagtctgtgccgaggtgccagctggtgcagtctggagcagaggtagaaaaacgccgggatctactgaagatctaccgtgtaagggttcnggatanattcgttaggacctacgtggtatcggngtgggtacgcgaccgagggtcgacccgggaaagccgtggtaagnggagagggntacatactagtccgagngtacactntagtactaccaagtactagacgttccgtaccgttacggaaccggccgtaccgttacctaccccgtttctacccggtacggaccccgtaaactaaacgtcccaaacttcgaaccgacccgaacccgttacccctaccgttagaccgttaacgggtggaccgcgaaccggccgtacggaacgggtacccctacggggaacctacgccgtaacctaacttaacgtagtttaccgacggttaaggaaaccctaaaacggtaccgttacgaaccgttaacgcccgttaacccggaaccccggtttaaaggttaccctttaacggtaccccgttaaggtaacccgggg

SEQ ID NO: 126373 - DNA, 658 bp, Homo sapiens
  misc_feature: GYAE6OF02G0HGA.4.38.D05.1.454.CMB.1.raw
  modified_base (163)..(163): a, c, t, g, unknown or other
  misc_feature (163)..(163): n is a, c, g, or t
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
tcagagcactgtagcacgaccggtgctcgatttagtatctgatagttgggtttgggggagtctccctcactgcccagctgggatctcagggcttcgattttctgtcctccaccatcatggggtcaaccgccatcctgccctcctcctggctgttctccaaggngtctgtgccgaggtgcagcgtggtncagtctggngcaggaggtagaaaacggccggggatctctgaagactcctccgtaggtaagggttcctaggtactacctacgttcgtttaacggacccttactacgggacgttcggtcgttggggtcgccggccgagggtcggaccccgggggaaaggcccgtagggaagtcgggtaagtggggactacgatacctaactcccgtggacgtcgaccttcgtagtactacgagtactacgtaacgtcccggttacttacgacggtccggccgtcctacccttcgcacgacccgaactacgtcctactcacggcccacccgccctacctcgcacggtgacgcacggtccacggacgccgacgacgtacgccgtaccaattatattcgttacgacgtaaccgtaaacccgtagtacaacgtacgtaccgtacccgaacccggttaagtacgtttcgaacgtacggtacccgggg

SEQ ID NO: 126374 - DNA, 831 bp, Homo sapiens
  misc_feature: GYAE6OF02IZCB5.4.38.D05.1.454.CMB.1.raw
  modified_base (191)..(191): a, c, t, g, unknown or other
  misc_feature (191)..(191): n is a, c, g, or t
tcagagcactgtagcacgaccggtgctcgatttagtatctgatagttgggtttgggggagtctccctcactgcccagctgggatctcagggcttcatttttctgtcctccacatcatggggtcaaccgccatcctcgccctcctcctggctcgttctaccaaggatctgtgccggaggtgcagtcgtggtnctagtctggagcgaggagtaggaaaaacggcccggggtatctcgtagaagacttccgtccgttaggtaagggtttcaggtaacttactacgttcgtttaacggaccttacgtggaacgtcggtcgttgggtcgtaccggccgaggggtccggaacccgggggtaaagtcccggtaaggtaactgggacggtacggggtaactcgtaagttctaagttacccgttgacgttacgtacttacgtacggtaccgtaacagtaacgtaaccgtaccggtttacccgttcgttaaccggacggtacccgttacccgttacccgttaccgttacgttaccgaacccggtaccgtaaaccgtaacggttccctaacgaccgtaaccggtcccgtaaccccgtacccttaacggtcgaccggtacggttaccgggcgaaccgtccggtaaccgtacggtaaccgtacccggttacggaccgtacggacccgttaaccttaagttaaccgtttaagttaacccggtgggtaaaaccctaacggtaaaaccgggtaacgtaacggtacccgaccgtttacccggttaacccccgtaaccggggttaaacgtttacccgtaacggtttaccggaaccgggtttaccccggg

SEQ ID NO: 126375 - DNA, 636 bp, Homo sapiens
  misc_feature: GYAE6OF02GXTN0.4.38.D05.1.454.CMB.1.raw
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (596)..(596): a, c, t, g, unknown or other
  misc_feature (596)..(596): n is a, c, g, or t
  modified_base (600)..(601): a, c, t, g, unknown or other
  misc_feature (600)..(601): n is a, c, g, or t
  modified_base (605)..(606): a, c, t, g, unknown or other
  misc_feature (605)..(606): n is a, c, g, or t
  modified_base (611)..(612): a, c, t, g, unknown or other
  misc_feature (611)..(612): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (620)..(621): a, c, t, g, unknown or other
  misc_feature (620)..(621): n is a, c, g, or t
  modified_base (625)..(625): a, c, t, g, unknown or other
  misc_feature (625)..(625): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(636): a, c, t, g, unknown or other
  misc_feature (635)..(636): n is a, c, g, or t
tcagagcactgtagcacgaccggtgctcgatttagtatctgatagttgggtttaggtgcccgggaaaggcctggaatggatggggatcatctatcctgatgactctgataccagatacagtccgtccttcgaaggccgcgtcaccttctcagccgacaagtccatcagccaccgcctacctgcagtggagcagccgtgaacggcctcggacagccgacatatattactgtgacgaaaaccngtancagctccaacccggtaagtacttgactacgcgggccacgggacctggtcactcgtctctcacgcctaccaccgacggccctacgtccgtcccttccccgtggaccctaccccgtacctaccgaacgaccgacccgtaccgttcggggtacgggggacctaaccgggacgggtccccgggccccggttcggggtccgtaccgggtcccgtttacggggtaaccgaaaccgggttaccctttacccctttaccccgtaaacgtacgggttccgtccgttacgtcggggaccgggtcccgggggtacgttcggggaaccggtaaccggtccgggaaccgtaacggttacgcgangagnncgcnngcagnntcncgncnngcgncgcngncngnn

SEQ ID NO: 126376 - DNA, 876 bp, Homo sapiens
  misc_feature: GYAE6OF02JBHQ7.4.38.D05.1.454.CMB.1.raw
  modified_base (149)..(149): a, c, t, g, unknown or other
  misc_feature (149)..(149): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccgganaaattgtgttgacgcagtctccgaggcaccctgtctttgtctccaagggaanagccaccctctccngcgacgggccagtcaggtagtgttagcagcagctacttaacctgtaccagcagaacctggacnggcctaccgaggtcctctacactctaagnggtcgctacgtccgagtccgacggccctacgtcggacctacctaccccgaggtaccgtacggttaccgaacgggtcgggaccgtacggggtttacggggttccgtacgggggaacttaaccgggttaacccgtttacccgaaccggttcccttaacccgtaacccgttacgttaccgaaccggtaccccgtaaacgggttaccggtaccggggtaccggttaacccgttaaacggggttaaacgtttaccggtttttaccgggaaccggtttacggttttaaacggtttaaacgtttacccgtttacgggtaaccgtaaccgggtttaccgtaaccggggtttggtttaacgggttacccgtaccgtttaccccggtaaccgggttacccggttaacccggtaaccggggtaaaccggggttaacccggtaacggggttaaacccgggtaaaacttaaaccccggtaaaaccgggttaaccgggttacgggtttaaccccgggaaccgtttaaccgggaccccgttaacccgggttaacgtttaccccggtttaacgttttaaccccgg

SEQ ID NO: 126377 - DNA, 790 bp, Homo sapiens
  misc_feature: GYAE6OF02GLFCT.4.38.D05.1.454.CMB.1.raw
  modified_base (655)..(655): a, c, t, g, unknown or other
  misc_feature (655)..(655): n is a, c, g, or t
  modified_base (729)..(729): a, c, t, g, unknown or other
  misc_feature (729)..(729): n is a, c, g, or t
tcagagcactgtagcacgaccggtgctcgatttagtatctgatagttgggtttggggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaacggcccggggtatctctagaagtatctcgttaggttaaggttctggactactattaccgttacggaccgtagtggacgttcgggtcgtcgggggtcgaccggccgtacggggtaccggaacccgggggtaaacgggtccggtagggtaaaggtcggggtaagggtagggggtacttacgtaacttacgttacctaccgtaggtacgttacggtaaccttccgttaacgaaccgttaaccgtaacgtaaaccgttaccggtacccggtttcccggtttacccgttaccggggtaaaccggtccccgggttacccgttacccgttaacctttccgaaccggacccggtacccgtaaccggttaaccgtaccctacgtacctaccggacccctaaccccggtccttaccgtcgaccgtaagggtcggactacgtaccgtaccggngggtaaacccggtcccgaacgggacgacgtccgaactagttaaatcgttacggtacaaccggaacgtaaaccgnggtaaccgctacgtccctaaccggtacggttacttaccgtacgtacggacgggtacccggg

SEQ ID NO: 126378 - DNA, 733 bp, Homo sapiens
  misc_feature: GYAE6OF02G6LI2.4.38.D05.1.454.CMB.1.raw
tcagagcactgtagcacgaccggtgctcgatttagtatctgatagttggggtttggggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtaggaaaaacggcccggggatctactagaagatccgtcgtaggttaagggttctaggatacattcgtttaacggacctacgtggtactcgggcgtggggtcgcggccgagggtcggacccggggaaacggtccgtagggaagtgggaggtggggatcgtactcgtacgtcctagacttgacttctagaactaaccagtaactacgtaccgttcccggttaccgttaccgggaacggtcccgtcgttacccgtacccttccgtaccgaaccggacccgtaaacgtaaccgtacccgtaactaccgaaccgtacccgaccccgtaccctacccggtcgaccgtagggtcggacgtacgaaccggtcccgtagggaaccggccgtacgggacaccggtccgaacctacttaagttacgttacgtacggtaaccgtaaaccggtaaaccgacgttacggaccaaccggtaccctaacccggtaacccggttaaggttacctttacgggttaccgtaccgggtaacccgggg

SEQ ID NO: 126379 - DNA, 742 bp, Homo sapiens
  misc_feature: GYAE6OF02JLLQF.4.38.D05.1.454.CMB.1.raw
  modified_base (203)..(203): a, c, t, g, unknown or other
  misc_feature (203)..(203): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggccaccctgtctttgtctccgagggaaagngcccaccctctcctgcgagggccagtcaggagttgtacgcagcagtactacgttaccgtgtaccagcaagaaccgtcggccaggtcctcccgaggtccctccgttacacgttccgttagtcggttacgacctacgtacccgaagtccgggaccggggtaccctacggtcggaccctaacgaccccgtaggaaccgttacggttaccaacggggttcggtacgtaggggtttcgggtaccgtacgggggaacctacggtaccgttccaaccgttccgtaaccaccgtatacgaaggtacacggtacgtcgggtagtacccgtaagttaaacggttcgtttacggcgttaacggttattacgttaccgttacgtacgtaggtacgtacggtttagggtacgttacggcccgttaccggaaccggttaccggtaccgggtaaccggtaaccgggttacgaacgggtacgtaaaccgtaaacgtaaccggtacggttacggtaagtccgtacgtacccgtaacctcgttacgtactttaacgg

SEQ ID NO: 126380 - DNA, 716 bp, Homo sapiens
  misc_feature: GYAE6OF02HRYLP.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttcgacgcagtctccaggccaccctgttctttgtcctccgaagggggaaacacgcccacccctctccgtagcagggccagtcagtagtgttagcagcagccttacgtaaccgtggtaccagccaacgtaaaccgtcggaccaggccctcccgaggccttcctaccattactagtcggtacgctactcccgagccggacggggtacctacgtcggacctacgtacccgaagtacggtacggttcgagttcgggacgtacggtttcggggtacgttacggggaactacggttaccttacgacccttctaccgtaacctacgtacgacgtacgaacggtacggtagggaacctaccggttaggtaacttacggtttacgtacggaagtttcgtttaacttacgtggtctaggtaccgttagggttgtacgttacgaccgttaccggtaacccggtacgggtaccgtaaccggtaaggggaaccgtaaggtaccggaaattaaacccggaagtaaccgtcgggtacgagtaccgtaaccacgttaccgttgttacgtttaccc

SEQ ID NO: 126381 - DNA, 702 bp, Homo sapiens
  misc_feature: GYAE6OF02GJGSU.4.38.D05.1.454.CMB.1.raw
  modified_base (315)..(315): a, c, t, g, unknown or other
  misc_feature (315)..(315): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgtctaccaagggaagagccaccctctcctgcagggccagtcagagtgtagcagcagtctacttaacctggtaccagcaagaaacctggaccaggcctacccgaggcctacctacacttcgtagtaggtnacactcccgaagccggtacgggccccaacggttcggaccctaaccgttaccccaaggtaaccgtacggtttaccgaaggttcgggaccgtaagggttcggggtacgtacgggggtaacacggttaacccttcgtaacccttacgtacccgaacctacgtacaccggtcgaacgtaccggtaggaaccgtaccgtaaggtaacgttagttttacgacgttacgttagttactttacgtacgtcgaacgtcgtaggtaggttacggtacgtccgtaccgtaccggtaccggttcggaacccgtaagggtaccgtaaggtaacggaaactaaccggaaacgtacgtacggtacggtacgtacgaccgtaaccgtcgttccgtacgttacc

SEQ ID NO: 126382 - DNA, 824 bp, Homo sapiens
  misc_feature: GYAE6OF02HUZ5K.4.38.D05.1.454.CMB.1.raw
  modified_base (238)..(238): a, c, t, g, unknown or other
  misc_feature (238)..(238): n is a, c, g, or t
tcagagcactgtagcacgaccggtgctcgatttagtatctgatagttgggtttggggggagtctccctcactgcccagctgggatctcagggcttcattttatgtcctccaccatcatggggtcaaccgccatcctcgccctcctcctggctgttctccaaggagtctgtgccgaggtgcagctggtgactagtctaggagcaggaggtagaaaaacggccggggatctcgtagaagnttcctaccgttaggttaagggttctaggtaatactagttacgtttaacggaccttacgtaggtacgttcgggtcggttggggtacgccggaccggtaggggttaccgggaccccgggggtaaaacggggtcccggttaggggtaaacgttagggggtagtacggggggtaacttacgtaacgttaccgttaacttcccggttaagacttacgtaccgttcgttacggtaaactaacccgtaagtaacttaacgtaaccggttacccgttaccgtttaccggaaaccgggtcccggtaccgtcccgttaccctttaccgtaccggaccggtaacccgtaaaccgttaacccggtcctaacgtacgaaccggacccgtacccgtaccctacccgttcggacgtacgggtacggacgacgaccggtaccgtacggtaaccggccggtacggaacgaccgcgtaacctaaagttaacttacgttaacgtacggtaaccgtaaacggtaaacgtaacggacgtcgaaccgtacccgtacccggtaaccggtaacggttaaccgtttaccgacggttaccggtaacccgggg

SEQ ID NO: 126383 - DNA, 149 bp, Homo sapiens
  misc_feature: GYAE6OF02I3AXK.4.38.D05.1.454.CMB.1.raw
  modified_base (132)..(149): a, c, t, g, unknown or other
  misc_feature (132)..(149): n is a, c, g, or t
tcagagcactgtagcacgaccggtgctcgatttagtatctgataggttgggtttggggagagctgctcagttaggacccagagggaaccatggaaaaccccagcgcagcttctcttcctcctgctacctcgnnnnnnnnnnnnnnnnnn

SEQ ID NO: 126384 - DNA, 871 bp, Homo sapiens
  misc_feature: GYAE6OF02FG80Q.4.38.D05.1.454.CMB.1.raw
  modified_base (197)..(197): a, c, t, g, unknown or other
  misc_feature (197)..(197): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggancaggaggtagaaaacgcccgggggatctctgaagactctccgttaggttaacgggtttctggtaacttacgtacttacgtttaacggaccttacgtggacgttccgggacgttggggtacgccggaccgtagggtccgggacccggggtaaacggtcccgttaagggaagttagggacggtagggggtaacttacgtaacgttaccgttaacgttaccgttacggtaacgttacggtaccttaccggttagtaacccgttaacctaacgtaaactacccgtacggtttccccggttacccgttaaccggggtaaacccgggtcccggtacccgttacccgtacccgtttacccgtaaccgtaccggaacccgtaaccgtaaaccgtacccgtaacgtacccgtaacgtaccccgtaaccccgtaccccgttaacccgtccgtaccggtaacgggttaccggaacggtccgaacccggttacccggtaaaccgggtaacccgggtacccgtaaccgggaccgtaaccggtcccgaaccttaaacgttacttaaccgttaccgttaggaaccggtaacccggtaaaaacgcggtaaaccgaccgtacgtaccccgtaacccggtaacccggttaaaccgggttaccttaacggttaccgtaccgggtaacccgggg

SEQ ID NO: 126385 - DNA, 734 bp, Homo sapiens
  misc_feature: GYAE6OF02GAGPC.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctccagataccaccggagaaattgtgttgacgcagtctccgaggccacccgtgttctttgtctaccgaaggggaaagacgcccaccctctcctgcacgggccagtcaggtagtgttagcgagcagtaccttaacttaaccgtcgtaaccagaccaacgaaaccgtggaccgaacggccctccccgaggtccctccgtactacttacgtagtcgggttcaccgtaccgtaccaacggcgtaaccgggccctaacgtcggacctacgtaccccgaaggtaccgtaggttaccgaggtacggacgttagggtcgggtcgaacggggaactaccgttaactcctcctacctaccaactacgaacgtacgaccgtaacgtacggtacgggtaacgtccgttaagggtaaacgtttcgtttaggaacgtttaagtttacgtttacgttactcggtacagggtactaggtcggttagaccgtccgtaccgtaccggtacggtaccgggtaacgtaacgggtaacgtagggtaaaacgtacgtaaaaccggaaacggtaccgttaggtaccgtacgtaaccgtaaccgacgtttaactacggttcttaaccg

SEQ ID NO: 126386 - DNA, 225 bp, Homo sapiens
  misc_feature: GYAE6OF02GQ6UI.4.38.D05.1.454.CMB.1.raw
  modified_base (180)..(180): a, c, t, g, unknown or other
  misc_feature (180)..(180): n is a, c, g, or t
  modified_base (214)..(225): a, c, t, g, unknown or other
  misc_feature (214)..(225): n is a, c, g, or t
tcagagcactgtagcacgaccggtgctcgatttagtatctgatagttgggtttgggcggtgctcgatttagtatctgatagttgggtttggggggaagaggaagactgacggtccccccaggagttcaggtgctgggcacagcggccctgggctgcctggtcaaaggactacttccctanacgtgctctgagcgggctgggcaaggcgcatagnnnnnnnnnnnn

SEQ ID NO: 126387 - DNA, 555 bp, Homo sapiens
  misc_feature: GYAE6OF02IC03D.4.38.D05.1.454.CMB.1.raw
  modified_base (240)..(240): a, c, t, g, unknown or other
  misc_feature (240)..(240): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
  modified_base (506)..(506): a, c, t, g, unknown or other
  misc_feature (506)..(506): n is a, c, g, or t
tcagagcactgtagcacgaccggtgctcgatttagtatctgatagttgggtttgggggagtctccctcactgcccagctgggatctcagggcttcattttctgtcctcaccatcatgggtcaaccgcatcctgccctctcctggctgttctccaaggagtctgtgccgaggtgcagctggtgcagtctggagcagaggtgaaaaagcccgggagtctctgaagatctcctgtaaggttcnggatacattctttaggaccttacgtggatcggcgttgggtcgccgccgaggtgaccccggggaaagcccgtaggaatggagtggggatcattctatccgtgatgacttngatcanatacacgtccgtcttacgagccncgtacctacttctacacgcactaagtccatcagccacccgcttaacctgcaggttgacgacncgaccgttagaaccggtccctacggactacggcgacctataactagttacctgtacgacgaaacgngtagcgacgtccacgtaacccggtagtacttacgtacgtagtaccgggg

SEQ ID NO: 126388 - DNA, 653 bp, Homo sapiens
  misc_feature: GYAE6OF02G1IJO.4.38.D05.1.454.CMB.1.raw
  modified_base (200)..(200): a, c, t, g, unknown or other
  misc_feature (200)..(200): n is a, c, g, or t
  modified_base (252)..(252): a, c, t, g, unknown or other
  misc_feature (252)..(252): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagataccaccggagaaattgtgttgacgcagtctccaggcaccctgtctttgctcgaggggaaancgccacctctcctgccagggccagtcagagtgtagcagcagctacttaacgnggtaccagcaagaacctggccaggctcccaggcctcctcatctagtcggtgcactccgagcgacgggccacgtggccacgtcccgagtaccgtaggttcaggtggcgtagggttcgggtacgtcggggactaggtaccttcgaacgttcctacgaccgtactaccgacgacgtaacgtaccggtaggtaaccgtccgtaaggtaacgttagttttcggacgttaaggtttacgttaacgttacgttcgtacgacgtacgtaggttggttacgggtacgtaccgtaccgtaccggtacggttccggaaccgtaacgggtaccgtaagggtaacgtaaacgtacgtaaaccggtacgtacggtacgtacgtacggtacctaacggtacctcgttacgttaccg

SEQ ID NO: 126389 - DNA, 699 bp, Homo sapiens
  misc_feature: GYAE6OF02IJBS0.4.38.D05.1.454.CMB.1.raw
  modified_base (161)..(161): a, c, t, g, unknown or other
  misc_feature (161)..(161): n is a, c, g, or t
  modified_base (229)..(229): a, c, t, g, unknown or other
  misc_feature (229)..(229): n is a, c, g, or t
  modified_base (415)..(415): a, c, t, g, unknown or other
  misc_feature (415)..(415): n is a, c, g, or t
  modified_base (473)..(473): a, c, t, g, unknown or other
  misc_feature (473)..(473): n is a, c, g, or t
  modified_base (494)..(494): a, c, t, g, unknown or other
  misc_feature (494)..(494): n is a, c, g, or t
tcagagcactgtagcacgaccggtgctcgatttagtatctgataggttgggtttggggagtctccctcactgcccagctgggatctcagggcttcattttctgtcctccaccatcatgggtcaaccgccatcctcgcctcctcctggctgttctccaaggngtctgtcgcgagtgcagctggtagcagtctggagcagaggtagaaaacggccgggatcgtactagaanacgttcctaccgtaggttaacggttctacggattaacgtattacgtttacggaacctaacgtggacgttcggcgtcgggtagaccgacgacgggttaccgacccgggtaaacggtccgttagggtaaaggtcggaaggtacgggtagtctaacgtacctacgtttccaggtacttcggaccttcgngtaactacgagtactaacgtccgttaccgtacgttacggaacgtcccggacgttaccncctttacgacgtcgaccgaanacgtccgtactacacgccacccgtacctacgtcgactagttacgacgcgacgtaccgtacggacggtccgtacgggacacggtacctaccgtaaacttacgttacttacgtaccgttgaaaaccgtaaaccgtacgtaacgtaccggaactcccggttaacctaaccccggtaagttaccgttacgaccggttacggtaaccggg

SEQ ID NO: 126390 - DNA, 607 bp, Homo sapiens
  misc_feature: GYAE6OF02F5EVY.4.38.D05.1.454.CMB.1.raw
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (449)..(449): a, c, t, g, unknown or other
  misc_feature (449)..(449): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaacgcccggggatctctgaagatctctgtaagggttctggatacatctttaggacctacgtgacgtcggctgggtgcgccgaggtcggacccgggaaaggcgtggaatggagtggggatcatctatcgtgatgactcgtagactaaccagtaactacgacgttcccgtacgttacggacggcccgtcgtccctaccttcacgacgaccgaanaacgtctancacgccacccgcctaccgngacaggtggaacgcgacgaccgaggaccggccgtacgacgacgccgacctaaagtacttaagtttactacggtacgaacggtaaaacccgaggtacgaccgaccgtaccgtacccgaacccggttaaggtaacctttacgacgtaccgggtaccgggg

SEQ ID NO: 126391 - DNA, 692 bp, Homo sapiens
  misc_feature: GYAE6OF02GTEYU.4.38.D05.1.454.CMB.1.raw
  modified_base (200)..(200): a, c, t, g, unknown or other
  misc_feature (200)..(200): n is a, c, g, or t
  modified_base (388)..(388): a, c, t, g, unknown or other
  misc_feature (388)..(388): n is a, c, g, or t
  modified_base (481)..(481): a, c, t, g, unknown or other
  misc_feature (481)..(481): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagactaccaccggagtaaattgtgttgacgcagtctcaggccacctgtctttgctcgagggaagngccacctctcctgcgcggccagtcagtagtgttagcagcacgtcttaacttaaccgtggtaaccagacaacgaaaccgtcggacctacggccgtacccgacggtcctcctactattctagtcggtacgacctacgtccgacggcgtacggggcctacggtcggacctactacccgaggtactacggtnacggtggacgtagggtcggtacgtacgggactacgtaccttcactcctacgacacgtcgagacgacgtacgtggactcgtaaggtaacgtttnttacggacgttaagttcgtttacgttacgtacgtacgtaacggtccgttagggttacggtaccggttagacccgttaccgggtaaacccgttcccggttaaaccgggaacccgtaaggggtaaccgtaacgggttaacggtaaaaccaaacccggtaaagtacggttcggccgggtactaccgaaccgtacgtacgttccgtagtttaccc

SEQ ID NO: 126392 - DNA, 836 bp, Homo sapiens
  misc_feature: GYAE6OF02IX9C9.4.38.D05.1.454.CMB.1.raw
  modified_base (166)..(166): a, c, t, g, unknown or other
  misc_feature (166)..(166): n is a, c, g, or t
  modified_base (234)..(234): a, c, t, g, unknown or other
  misc_feature (234)..(234): n is a, c, g, or t
tcagagcactgtagcacgaccggtgctcgatttagtatctgatagttggggtttggggggagtctccctcactgcccagctgggatctcagggcttcattttctgtcctccaccatcatggggtcaaccgccatccctcgccctcctcctggctgttctccaaggngtctgtcgccgaggtgcagctggtgcagtcgtggagcagaggtacgaaaacggccggggatcctacgngaacgtactcctccggttaggttaacgggttcgtaggtacttaactacgttaccgtttaacggtaccttacgtagggtacgtcggtacggtggggtcgccggaccggagggtccggggaacccgggggtaaacgggtccggtacgggtaaaggtggggtacgggtagggggaactctacgtcgtaacgttcctagtacgtacgtacctcgtacgtaactaaccgtagaacttaccgtaccgttccggtaccgttacgggtaccggtcccggtacccgttaccgttcccgtacgtacccggacgtaccccgaacgtaacgtcccactaccggaccggtaccctaaccccggtaacccgttccgtaacggtcgtacgggtaacgacccggtaccgaccggaccgtaaccgggtaccgggtacccggtaccggaacggtccggccgtaaccttacgttaaccgttaccttaacggtcggtaaacccgtaaaccgggtaaaccgttaaggacccgtaccgttaacggtccccgttaaaccccggttacccggtttaaacggttaaccccgtttaacggtaacccgggttacccggtaaccgggggg

SEQ ID NO: 126393 - DNA, 795 bp, Homo sapiens
  misc_feature: GYAE6OF02I33YU.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcagtggggtcaaccgccatcctcgccctcctcctggctgttctccaaggagtctgtgccgaggtgcagctggtgcagtcgtggagcaaggaggtagaaaaacggccggggtatctcgagaagtctcctcgtaggttaaggttcgtaggtatacgtattacgtttacggacctacgtaggtacgtccggtcggtgggtcgccggtaccggtacggggttcccgggaaccccgggggtaaacggtcccggtaggggtaaacggtggggtacgggttacgggggacttaccgtaacgttaccgttaccgttacgtaggttacgtcggtaccgttcggtacgtaaccgtaaccgtaacgtaacttaccgtaccggttcccgttaccggttaacggtaacgggtccccgtacggtacccttcccttacgaccgaaccggtaccgtaaaccgaccgttacccgagtaccgacggtacccgtaccccgtccgtaaccggcgtacgtacggcggtaacgaccgtacgggtaccgttagggaacccgtaccgggtaccgacggaaccgtcccgtaaactacgtttaaacttacgttacgttacggaacggtaaacccggaacgtaacgtacgacctaccggtcctaacccggtaaccgtaacgttacgttacgtacgtccgggtaccggg

SEQ ID NO: 126394 - DNA, 674 bp, Homo sapiens
  misc_feature: GYAE6OF02H9V5D.4.38.D05.1.454.CMB.1.raw
  modified_base (235)..(235): a, c, t, g, unknown or other
  misc_feature (235)..(235): n is a, c, g, or t
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
tcagagcactgtagcacgaccggtgctcgatttagtatctgatagttgggtttggggagtctccctcactgcccagctgggatctcagggcttcattttctgtcctccaccatcagtggggtcaaccgccatcctcgccctcctcctggctgttctccaaggagtctgtgccgaggtgcagcgtggtgctagtctggagcaggaggtaggaaaacgccgggagtctcgtagaagntctccgtaggttaacggttcaggtatacacgttcgtttacggacctagtaggtacgtcggtcgtggtcgcgcgaggtcgaccggaagcgtaganggagtcggatacgtntactntctgatcgactgagactacganacgtacgtacgtccgtactacggaacggtcctcgtacctacgttctacgacgtacgaacgtacgctaactcgacgaaccctccggtacctacgtcgtaccgagtaccggacgcaccgcttaacgggaaccgtccgtaacggacgtacgtacccgaaacgttacgttaaaccgttacggtttaccgaggtaacgtaaccgtaaaacccggtaccgttacgacggttaacccgtaacctttacccgggttaacccttaaacggggttcctttaaaccgggtccgttaacccggttaacccggggg

SEQ ID NO: 126395 - DNA, 990 bp, Homo sapiens
  misc_feature: GYAE6OF02IDAFQ.4.38.D05.1.454.CMB.1.raw
  modified_base (168)..(168): a, c, t, g, unknown or other
  misc_feature (168)..(168): n is a, c, g, or t
  modified_base (209)..(209): a, c, t, g, unknown or other
  misc_feature (209)..(209): n is a, c, g, or t
tcagagcactgtagcacgaccggtgctcgatttagtatctgatagttggggtttgggggagtctccctcactgcccagctgggatctcagggctttctatttttctgtcctccaccatcagtggggtcaaccgccatcctcgccctcctcctggctgttctccaaggngtctgtcgccggaggtgcagcgttggtgcagttcgtggagngaggtaagggtaaggaaaaaacgggcccggggagttccgtacgtagaagtactcttaccgttaggttaacgggttctacggtaatacgtacttacgtttaacggtaccttagtacgggtacgtccggggtcggttggggtcgccggtccggaacgggttccgggaaccccggggtaaacggtaccggttaagggaacggtaggtagggtacggggtactaacgtacttaccgtagttaccgtaggtacgttccgtaaccgttacgtacgtactaacgtaacgtacttaaccggttacggtttacccggttaacccgttaccgggaacgggtccccggtttacccgtacccgtttaaccccgtttccgtaaccgtaacccggggtaacccgttaaacccgtaaacggtttaccccctaaggtaaccctaacccggacccccgtaaacccccgttacccgtaacccggttagggtaccgggaaaggttacccggacccgggtaacccgtaaacccggggttacccgtaaaacgggggtaccccggtacccgtaacccgggaaacccgaaccgggttcccccggtaaaacttaatttaaaccggttttaacgggttaaaccgttaccgggtaacccgggtttaaaaaccgtaaaacccgggtaacggtttaaacccaacggttaacccgtttacccccgaacccgggttttaaaaaccccgggtttaacggtttacccgttttaacccggggaaaaccggtttacccccggggtaacccggggg

SEQ ID NO: 126396 - DNA, 681 bp, Homo sapiens
  misc_feature: GYAE6OF02FXH29.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaacggcccggggatctctagaagatcctctggttaacgggttctaggtataactattacgttacggaccttacgtggacgtcggcgtgggtcgccggccggtaggtaccgggaacccgggaaaggtccgtaaggtagtggaggtgggatcattctactcgtagtatcgtactgtagtataacgagtacgtacgtacggttcccgtacgttaacggacggtccgtaccgttacctaacccgttcaaccgaccgacccgaacaaccgtctacgtccacgcccaacccgtcctacgtacgccgtaggtcgacgacctcggaccggtacggaaccgtccggtacgaccggaccaaccggtactaaatttaactacgtttactacggaacaacccggtaaacgaggtaccgacctacgtacccgtaaccccggtaacggtaaccgttcggttaccgaccggttccgggaacccgggg

SEQ ID NO: 126397 - DNA, 756 bp, Homo sapiens
  misc_feature: GYAE6OF02GO1G1.4.38.D05.1.454.CMB.1.raw
  modified_base (395)..(395): a, c, t, g, unknown or other
  misc_feature (395)..(395): n is a, c, g, or t
tcagagcactgtagcacgaccggtgctcgatttagtatctgatagttgggtttgggggagtctccctcactgcccagctgggatctcagggcttcattttctgtcctccaccatcagtggggtcaaccgccatcctcgccctcctcctggctgttcctaccaaggacgtctgtcgccggaggtgcagcgtggtgctagtcgtggagcgaaggaggtaaggaaaaacgggccggggagttcgtcgtagaacgacttccgtccgtagggttaacgggttcgtaggaactactacgtttacgtttacggtaccttacggtaggtacgtcgggtcggtgggtcgccggaccgtagggtccggaacccgggggaacggtcggtacgggaagtgggtaggnggggtaactcgtacttcgttacgtccgtaggtactcgtacctacgtacgtaactaaccggaagtactaaccgtcggttcccgttacggtaacggaccggtcccgtcgtacccttacgttccgacgaccggaccgtaaaccgacgtacgtacgtacgtaccgacccgtaacccgtaccgttaccgtcggaacggttcgggaacgtacgaccgtacggtacccggtacggaccgggtaccgacggacgacgtacgtacctattacgttacgtacgtaggaacgaaccggtaaacgtacggtacacggtaccgtaccgtaccgttaaccgttaacgttacgtacggtacgacggtaacccgggg

SEQ ID NO: 126398 - DNA, 733 bp, Homo sapiens
  misc_feature: GYAE6OF02GU2M0.4.38.D05.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagagcactgtagcacgaccggtgctcgatttagtatctgatagttgggtttggggagagctgctcagttaggacccagagggaaccatggaaaccccagcgcagcttctcttcctcctgctactctggctcccagactaccaccggagtaaattgtgttgacgcagtctcaggccaccctgtctttgtctccgaagggaancgccaccctctcctgcgagggccagtcagagtgtagcagcagtctacttacgtgtaccagacaacgtaaccgtcggccacggcctacccgaggtcctccnctactctagtcggtcacctacgtccgacggaccgacggggcctaacggtcggacctaccgtaccccgagtaaccggtacggttacgtaagggtccgggagtagggttcgggtcggacgggtactacgttaccttccgacgtccctacgaacctatacccgacgaccgtacgtaccggtacggtacgacgttaggtaacgttaggtttaccgaagtttagttacgtttaacgttcgttacggtacgtaaccggtgttaaggggttcgttacggggttaccgtacggttaccccgtaccgggttaccggttacccgggaaccgggtaacggaccgggttaaaggtaaccgggtaactaaaccgggtaaaccgtaacggttacggttacggacggtaccgtaccgtaaccggttagtcccgttacgttacccg

SEQ ID NO: 126399 - DNA, 723 bp, Homo sapiens
  misc_feature: GYAE6OF02I96O1.4.38.D05.1.454.CMB.1.raw
  modified_base (164)..(164): a, c, t, g, unknown or other
  misc_feature (164)..(164): n is a, c, g, or t
tcagagcactgtagcacgaccggtgctcgatttagtatctgatagttgggtttgggggagtctccctcactgcccagctgggatctcagggcttcattttctgtcctccaccatcagtggggtcaaccgccatcctcgccctcctcctggctgttctccaaggngtctgtgccgaggtgcagctggtgcagtctggagcaggaggtagaaaacggcccggggatctctagaagactctcgtggttaagggttctggactactattcgttacggtacctacgtaggactcgggtcgtgggtcgccggccgaggtcggacccggggaaaggccgtaggagtgggaggtggggtatcattacgtactccgttgagtcgtacctgtacgactacgagtactacgtacggttcccgttccgttacgaccggtcccgtccgtacccgtaccttccgtacgaccggtacccgaaccgtaccgttaccctaacgtaccgaccgacccgtaaccccggtcccttaaccgttcgacgtacggttacggacgtaccgccggtaccgtacgggacccggtccgtaccgggacgacggccgtacctaaattacgttaacgtttacgtacggtaccggaaaccggtaaaccgtacggacggtacccgacgtaccccgttacccggtaacccggttaacggtttaccgtttaaggtacccgttacgggtacccggggg

SEQ ID NO: 126400 - DNA, 809 bp, Homo sapiens
  misc_feature: GYAE6OF02JRRD8.4.38.D05.1.454.CMB.1.raw
  modified_base (100)..(100): a, c, t, g, unknown or other
  misc_feature (100)..(100): n is a, c, g, or t
  modified_base (174)..(174): a, c, t, g, unknown or other
  misc_feature (174)..(174): n is a, c, g, or t
  modified_base (380)..(380): a, c, t, g, unknown or other
  misc_feature (380)..(380): n is a, c, g, or t
tcagagcactgtagcacgaccggtgctcgatttagtatctgatagttgggtttggggagagctgctcagttaggacccagagggaaccatggaaaccccngcgcagcttctcttcctcctgctactctggcctcccagactaccgaccggtaagtaaattgtgttgaccgtacnggtcctcgacggccacccgttgtctttgccttaccggaggggaaagcgccccaccgttcctcgtagccggtgggaccacgtcgagtagtcgtagccgtagcagtaccttaaccgttacctacggtaccacggtacaacgtaacccgttccggacgtaaccggttcccgacccgcggtacccctccgtactaccttagtcgttcggngaccctagaccgagttacgggaccggttccacggttaccgccgtaccaacgtcgaaccggtaggtttccggaacggttcggagttcggggttacgggtaggtccggagtaacgttacctacgttaccgtacctcaccgttacgacaacggaccgtacgtacggtacgtacgtaaccggtgttaaacggttcgttacacggttaacgttgttaacgtttacgtacgtaccgtaggttaccggtaggtttacgtacggtaccttaacccgggttaccgtaaccccggggttactaacccggggtaaggttaccccggtaacgggggtttaacgtaccggtaaacggtaaccgtaaccggtaacggttaaccgggtccgttaacgggccctaccggttaaaccggttaccgttaccggtaaccttttcccgg

SEQ ID NO: 126401 - DNA, 742 bp, Homo sapiens
  misc_feature: GYAE6OF02H1BFG.4.38.D05.1.454.CMB.1.raw
  modified_base (199)..(199): a, c, t, g, unknown or other
  misc_feature (199)..(199): n is a, c, g, or t
tcagagcactgtagcacgaccggtgctcgatttagtatctgatagttgggtttgggagagctgctcagttaggacccagaggaaccatggaaaccccagcgcagcttctcttcctcctgctactctggctcccagtataccaaccggagaaacttgtgttgacgtcagtctcaggcacctgtcttgtctccaagggaanacgcccacctctccgtagcgtagggcctagtcaaggtagtagttaacgcaagtctacgtacttaaccgttaacgtcggtaaccacgtacgaaacgaaaccgttcggacctacggtacctacccggtaggtcctaccttacattccgtagtcggtcgactacgtaccgagtacgacgggtacccacggtggtacctaccgtacccgaaggtacgttaacggttcgtacggttcggacgttggttacgggtacgttacgggaactaccgttacgttacctacgttaccaaccgtaacctagtaccgacgtacgtaacgtacgtacggtacgtaccgttaagtaaccgttaggtttagaccgttaggttactttaccgtttaacgtcgttaacgaccgtagtacggttgtaccggtaagtcccgtaaacgtcccggtaagttccgggaacccgtaacgggtaccgtaaaggtacgtaaaacgtccggaaaacgttcggttaggccgttacgtacggtacctaaccgttacttccgtacgtttaacc

SEQ ID NO: 126402 - DNA, 752 bp, Homo sapiens
  misc_feature: GYAE6OF02GZMAH.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagcgtggttcgcagtctggagcgagaggtaggaaaaacggcccggggagtctctcgaagtatctccgtaggtaagggttctaggtactactacgttacgtttacggaccttacgtaggaacgttccggcggttggggttacggccggaccgtacgggtaccggaccccggggaaacgggtccgttacggaaaggttgggacggttacgggggattacgagttaccttacgttaccgtgtagtcgtactcgtagactaccgagtactacgtacggtccgttaccgtacggacgtccgacgtcctacgttcctacgacgtaccgtacacgtaccactacgtccgtaccaccgtcccgtaaccgttccggacggttacggaccggacgaccgtacggtccgtacggaaccggtccgtccgggaaccgtcggaccgtaccgtaacgttaattaactttacggtaccgtacgtaacccggtaaaaccgtaacgtacgtaacccgtaacggtaccccgttaacccgtaaccccggttaacggtttaacgtttccggtaaccgttacccgggtaccgggg

SEQ ID NO: 126403 - DNA, 733 bp, Homo sapiens
  misc_feature: GYAE6OF02HBPXY.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcccggggatctcgtagaagatctcctaggtaagggttctggatacattactttacggacctacgtggatcggcgttgggtgcgccgagggtcggacccggggaaaggccgtaggaacgtgggagtggggatcgtatctacgtcctagactcgactctagaactacagtaactacgtacggtccgttaccgttacggaaaccgggtcccgaccgttaccgtacccgtttcgtaccgtaccgacccggtaaacctaaccggttaccaactaccgtaaccgacccaaccccgttcccgtaacccgttggaccgtaacgggttacggaacgtaccgaccgtaccggtaacggtaacccgggccgttaccgggaaccgaccgtaccggacccttaaagttaaccgtttacgttacgtaccgggtaggtaaacccggtaaacgtacggttaaccggaccgtaccgtaaccctacccggtaacccggttaacgtttaccgttaacggtaccggtacggtaacccgggg

SEQ ID NO: 126404 - DNA, 839 bp, Homo sapiens
  misc_feature: GYAE6OF02GKWIU.4.38.D05.1.454.CMB.1.raw
  modified_base (153)..(153): a, c, t, g, unknown or other
  misc_feature (153)..(153): n is a, c, g, or t
tcagagcactgtagcacgaccggtgctcgatttagtatctgatagttgggtttgggggagtctccctcactgcccagctgggatctcgagggcttcattttctgtcctccaccatcagtgggtcaaccgcatcctcgccctctctggctgtcncaggagtctgtgccgaggtgcagcgtggtcgcgtaggtcgtggtagcgaaggtaggtaacggaaaacggtcccgggggtagttccgtcgtagaagtaccttacgtaccggttaggttacgggttcgtaggtaaccttacgtacgtttacgtttaacggacctacgtaggtactcggtcgtgggtcgccggaccggtacgggtaccggaccgggggtaaacggtccggtagggtaaacggtcgggtaagggtagggtacctacggtaaccgttcgtaccttacggtagtacgttacgtaaccgtcgtaacgttaaccgaacgtaacgtacgttaaccgtaccggtttccccgtaacgttaaccggggaacccggttacccgtaccgttaccccgttaacccgtttacgtaacccgtacgggtaaaccccgtaaacttaaccgggttaacccacggttaaccgtacccgtacccccgggttaaccctaccccggttaccggttaggaaccggtttgggaaccgaccgtacggttaccggaccgtttagggaacccgtccggtaacgaacgtccgtacgtaacttaacggtttactacgttacgtacgtaccgaaaccgaagtttaccggcaccgtacgtaccctacggttaacggttaccgtactttccggaacgttcccggtaacgg

SEQ ID NO: 126405 - DNA, 723 bp, Homo sapiens
  misc_feature: GYAE6OF02INCPT.4.38.D05.1.454.CMB.1.raw
tcagagcactgtagcacgaccggtgctcgatttagtatctgatagttgggtttggggagagctgctcagttaggacccagagggaaccatggaaaccccagcgcagcttctcttcctcctgctactctggctccagactaccaccggagtaaattgtgttgacgcagtctccaggcctaccctgttctttgtctccgaaggggaaagcgcccacccgtctccgtgcgacgggccaggtcaggtagttcgttacgcaacggcagtacttaccttaacgtcggaacctacggacaacggtaaaccgtcggacctttacggccttacccgacggtcccgtacccttacgtaacttccgtaggttacgggtacgtactacctccgtaggacgtacgggcctaacgcggtacacgtacccgaggtacgtcgttacgaggtcgggactacgggttggtacgtaggactacgtttacctacgtacccgtactttacccgactacgtcgacgtacgtacgactcggacgtacgtacggtaacgttcttaggaacgttagttcgttaacgttcgtacgacgtagtgtaggtggtaccgtcgttaccgacggttaccggttaccggttccggaaccggttacgggtaccggtaaggttaacggaaccgtaccggtaaacggtaccgtaggtagtacccggtagaaccttaccgtagttcccgttaggttaccc

SEQ ID NO: 126406 - DNA, 813 bp, Homo sapiens
  misc_feature: GYAE6OF02JFE4S.4.38.D05.1.454.CMB.1.raw
  modified_base (143)..(143): a, c, t, g, unknown or other
  misc_feature (143)..(143): n is a, c, g, or t
  modified_base (781)..(781): a, c, t, g, unknown or other
  misc_feature (781)..(781): n is a, c, g, or t
tcagagcactgtagcacgaccggtgctcgatttagtatctgataggttggggtttggggagagctgctcagttacggacccaggagggaaccatcggaaaccccagcgcagtcttctcttcctcctgcttactctggctccanactaccaccggagaattgtgttagacgcagtctccgaggccaccttgtcttttacgcctaaccgaaagggaaacgcacccctacccttcgttccgtggaaccgcgggtacccgagttacaggtagttgtaggaccaggcctaagtaccttaaaccgttaaccgttacggtaccaacggtaccaaaccgtaaaccggtcggaccgaaccgggtccttaccccgaccggtaccctacccttacctacgttaaaccgttacggttggtaccgaccgtaacgttcccgaaacggttccggaaccgggccgttaaccggccgggtacccaaccgttaacccgaaccggttaacgtacggttaccgtaacgggttcggccggttacggggtcgggtaccggtaacgggggtaacctaccgttaaaccgtttccgaacgttcccggttaacctaccggttaaccgccgaacgttacgaaaccggtcgttacggacgtaacggtacgttaagtacggtttaacgcgtttaaggtattaccgttgtaacctcggacgtcgtaggtagtcggttaacgtccgtaccgtacggtccttaacgggaaccgtacgacgtacgtaaccggaactacgaaacggtcgttacgnggaccgttacgcgtacctacgtcgttcgtacg

SEQ ID NO: 126407 - DNA, 815 bp, Homo sapiens
  misc_feature: GYAE6OF02HFUB0.4.38.D05.1.454.CMB.1.raw
  modified_base (163)..(163): a, c, t, g, unknown or other
  misc_feature (163)..(163): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctcgccctcctcctggctgttctccaaggngtctgtgccgaggtgcagcgtggtgcagtctggagcagaggtagaaaacggccgggatctcgtagaagatcctaccgtaggtaacgggttctaggtatacgtacgttcgtttaacggaccttagtggtacgtcggtcgtgggtcgcgcgtacggtcggacccggggaaggccgtaggacgtgggacgtaggggactcgtacgtacttacgtcgtacgtactcgacttacgtacgtaactaaccgtaagtacgtacgtaccggttacccgttaccgttaccgggaaccggtcccgttccgtaccctttacccgttaccgtaccgaaccggtaacccgtaaaccgtaaccgtacccgaacgttaccgaacccgtacccgaaccccggttccctaccggttacggaccggtacgggtacggaccggtaccgtaccggtaccgtaacggggaacccggttcccggtacgggaacccgtacggtaccctaacgttaaacgttaacgtttacccgtttacggtacgttaaccggaaacccggttaaaccggtacggtaacccgtacggtaacccggttaaccccgtttaaccccggtaacccgggtttaaaggtttaccccggtttacggttaacccggtaccgggttaacccggggg

SEQ ID NO: 126408 - DNA, 786 bp, Homo sapiens
  misc_feature: GYAE6OF02J1DOL.4.38.D05.1.454.CMB.1.raw
  modified_base (145)..(145): a, c, t, g, unknown or other
  misc_feature (145)..(145): n is a, c, g, or t
  modified_base (160)..(160): a, c, t, g, unknown or other
  misc_feature (160)..(160): n is a, c, g, or t
tcagagcactgtagcacgaccggtgctcgatttagtatctgatagttgggtttgggggagtctccctcactgcccagctgggatctcagggcttcattttctgtcctccaccatcatggggtcaaccgccatcctgccctctccnggctgttctccaggngtctgtcgccgagtgcagcgtggtgcagtctggagcagaggtagaaaagcccggggatctctagaacgtactctccgttaggtaacgggtttctagggtacttactagtttaccttttaacgggaccttaaccggttggaacgttccgggtacgttcgggggtgaccggccgtagggtccgggaacccccggggtaaagggcccgttaggggaacgttggacgggttaggggtacttacgtacgttacgtacgtcccgttaagggtacttcggtacctcgttacgaacgtttaccaaggtacgtttaccgtaccggttaccccgttaccgttaaccggacggttacccggtacgtacctttcccgttcctacgacgtaccccgtacgttaccgtaccgttacaaccgcgtcccacccgtccgtaccttacgacgtacgggtacgtacgtaccacggttccgacgggtaccgtccggtaaggtacccgtcaccgtacccttaaacggactttacgtaccgttagtaacccggaaccgttaaaacggcggtacgtaaccgaccggttacccgtaacccgttaaccggtaaaggtttccctacggtttacccggtcgggttaccccggg

SEQ ID NO: 126409 - DNA, 283 bp, Homo sapiens
  misc_feature: GYAE6OF02FQBS2.4.38.D05.1.454.CMB.1.raw
  modified_base (128)..(128): a, c, t, g, unknown or other
  misc_feature (128)..(128): n is a, c, g, or t
  modified_base (231)..(231): a, c, t, g, unknown or other
  misc_feature (231)..(231): n is a, c, g, or t
  modified_base (236)..(283): a, c, t, g, unknown or other
  misc_feature (236)..(283): n is a, c, g, or t
tcagagcactgtagcacgaccggtgctcgatttagtatctgatagttgggtttgggcggtgctcgatttagtatctgatagttgggtttggggggaggaggaagactgaccggtcccccaggagttcnggtgctgggcacaggccggccctggggctcgcctgggtacaaaggacctaccttcccctacaggtgtcctcgtggaggccgggggtctcgggacgaaggccgnatagnnnnnnnnnnnnnnnnnnnnnnnnnnnnnnnnnnnnnnnnnnnnnnnn

SEQ ID NO: 126410 - DNA, 890 bp, Homo sapiens
  misc_feature: GYAE6OF02GH9DK.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatgggtcaacgccatcctcgccctcctcctggctgttctccaaggagtctgtagccgaggtgcagcgtggtcgcagtctgggagcgagaggtacgaaaaacggcccggggtagtactcgtagaacgtatcgtacctaggttaagggttcgaggtatactagttacgtttaacggtaacctacgtacgggtaacgtcggacggtgggttacggccggtaccgaggggttacggaacccgggggtaaacgggtcccgtagggtaacgttaggggaacggtagggggtaacttccgaagttactaacgttaccgtaggtacttacgtaccgttacggtaactaccgtaacgtacgtaacgttaaccgacggtttacccgtaccgtttaacggaaaccgggtaccggtaaccggttacccgtaacctttcccgtaaccggaacggtaccccggtaaacttaaaccggtaccctacgtaaaccggaactacccgggtaaacccctcccttaacccgtagtaacccggaggttaccgggaacgtacccggtaacggtaaccccggtaagggtaaacccgggtaccggtaacccggtaaacggtacccgtaaccgtaacccggtaaacggtttaacttaaccgttaccgttaggtaaacccggaaacccgggtaaaacgaacgttaaccggggtaaaccctaaccgggttaccctaaacccgggttaacgggttaaaccgttacccgtttaacgacccgggttaacccggtaaccccggggg

SEQ ID NO: 126411 - DNA, 710 bp, Homo sapiens
  misc_feature: GYAE6OF02I51LQ.4.38.D05.1.454.CMB.1.raw
  modified_base (334)..(334): a, c, t, g, unknown or other
  misc_feature (334)..(334): n is a, c, g, or t
tcagagcactgtagcacgaccggtgctcgatttagtatctgatagttgggtttgggggagtctccctcactgcccagctgggatctcagggcttcattttctgtcctccaccatcagtgggtcaaccgccatcctcgccctcctcctggctgttctccgaaggagtctgtgccgaggtgcagctggtgcagtcgtggagcgagaaggtagaaaaacggcccggggagtcctcgtagaagtcgtcctaccgtaggttaacgggttcgtaggtactaactacttccgtttaacggtaccttacgtcggacgtcggtcgtggggtccgtccgaccgngggtaccggaccggggaacggtccggtagggaacgtgggaggtagggtatactacgttcgtacttccgtaggattacgacgttactagaccgttaactacgtaactacgtacgtcccgttaccgtacggaccggccgtccgtcctaccttacgacaccgtacgacgtaacgtcacgtccacggtcctcccgaccttcgcgacgtaggtgactaccacgcgtaccggaggcccctaggaaccgtcgacctacgtaactttaactcggttaacgtcggtaacgaaacccgaaagttacggacgtacgtacccgtacccgttaacccggttaccggttaaaccggtacgtttccgaaccgttaccccgggttaccgggg

SEQ ID NO: 126412 - DNA, 745 bp, Homo sapiens
  misc_feature: GYAE6OF02F6VG5.4.38.D05.1.454.CMB.1.raw
tcagagcactgtagcacgaccggtgctcgatttagtatctgatagttgggtttgggggagtctccctcactgcccagctgggatctcagggcttcattttctgtcctccaccatcatgggtcaaccgccatcctcgccctcctcctggctgttctccgaaggagtctgtcgccgaggtgcagctggtgcagtctggagcaagaggtagaaaaacggcccggggagtctctagaagactcctccgtaggttaacgggttcgtaggtatactattcgtttaacggaccttagtggtatcggcgttgggtcgcgaccgagggtccggacccggggaaacgtccgtaggaacgtggacggtgggactcgtatacgtacgttccgtagacgtcgacttcgtagtaactaccgaagtaactacgacgtttaccgtaccgttacggaaccgtccggtccgtacccttaccttccgaccgtaccggacccgaacgttaaccgcctacgtaccgtaccgaccccgtaacccgtcccgttacccgtacgtacgtacgggttaccggacgtaccgtacggtcccgtaaggaacccgggtcccgtaacgggacctaccggtaccgacctaaatttaacgttaacgttccgtacgggttaaccgaaacccggtaaacgtacggtaccacggtaaccgtacccgtaacccggtaaccggttaaccggttacttacgggtacccgttacggtacccgggg

SEQ ID NO: 126413 - DNA, 827 bp, Homo sapiens
  misc_feature: GYAE6OF02HME8E.4.38.D05.1.454.CMB.1.raw
  modified_base (165)..(165): a, c, t, g, unknown or other
  misc_feature (165)..(165): n is a, c, g, or t
  modified_base (773)..(773): a, c, t, g, unknown or other
  misc_feature (773)..(773): n is a, c, g, or t
tcagagcactgtagcacgaccggtgctcgatttagtatctgatagttgggtttggggggagtctccctcactgcccagctgggatctcagggcttcagttttcctgtcctccacatcagtcggggtcaaccgccatcctcgccctcctcctgctgttctcaaggngtctggtgccgaggtcgcagtctggtgctaggtctgggacgcgaggaacgggttaacggaaaaacgggtccccggggtaattccgtcgtacggtaaacgtcgtcccgttaccggttacgggttaacgggttctaggtacttacgtacgttaccgtttacggacccttaggtcggtacgttaccggtcggtaggggtcgccggtcggaacgggttaccggaacccgggtaacggtcgttagggaagtaggggtacggtcggggtaactacgtacgttacgttacgtaccgttaggtacgtacgttacgtacggtacgaaacgtttaccggaagttaccttaaccggttaccggttacccggttaaccgttaaccgggaacccggttcccggttaccccgtaacggttttaccccgttcccgaccggtaacccggtacccgtaaaaccgttaacccggtaccctaccggttaaccggaacccgtaccccgtaaaccccgttccttaaccggttacgacgggtacgttacgaccggacaccgtccgaacggtacgtccgaccgtagaccgaccgttctaacgtactagacgtacaaccgtaacggtaacgngttacaaccgtcgtaccctaacggtacttaacgtctacggcgtagggtacccgg

SEQ ID NO: 126414 - DNA, 776 bp, Homo sapiens
  misc_feature: GYAE6OF02IBZH6.4.38.D05.1.454.CMB.1.raw
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
tcagagcactgtagcacgaccggtgctcgatttagtatctgatagttgggtttggggagagctgctcagttaggacccagagggaccatcggaaaccccagcgcagcttctcttcctcctgctacctctcggctcccagataccacggagtaaattgtgttagacgnagtctccagcaccctgtcttgtctcgaagggaanacgcctaccctgtccgtgcgacggccagtcacgtagtagtacgaccaggtaccaataccttaacgttaacccgttagtaccgtacgacgaaaccgtaaaccgtcggacccgacggacctacccgtaacggtccttcccgtacctataccgttacgtaccggtgtaccgtaactccgaacggtccgaacggtaccgtacgttagggaccctaacgtaccccgtaagaaccgttaggttaccgtagggtccggacgttacgttacgggtacggtacgggactacgtaccgttcncgtactcaaccgtntacgactacgaacgtacgtaacggactacgtaacgtagttacgttagtacgttaaggtcgttacttaacggtcgtacgttacgtaccgttaagggttcgtacggttacgtaccgttaaccgtaaccggttaccgggttaccgaaccggtaaacgggaaccggttaacgggaacggttaaaacgggtaaacccttaaaccggtaaacggttcgggtaaccggtactaccggttaacccgaacgtttaaccgtttacgtaggttttaaccc

SEQ ID NO: 126415 - DNA, 570 bp, Homo sapiens
  misc_feature: GYAE6OF02GPXMD.4.38.D05.1.454.CMB.1.raw
  modified_base (119)..(119): a, c, t, g, unknown or other
  misc_feature (119)..(119): n is a, c, g, or t
  modified_base (180)..(180): a, c, t, g, unknown or other
  misc_feature (180)..(180): n is a, c, g, or t
  modified_base (424)..(424): a, c, t, g, unknown or other
  misc_feature (424)..(424): n is a, c, g, or t
  modified_base (538)..(542): a, c, t, g, unknown or other
  misc_feature (538)..(542): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(570): a, c, t, g, unknown or other
  misc_feature (549)..(570): n is a, c, g, or t
tcagagcactgtagcacgaccggtgctcgatttagtatctgatagttgggtttaggtgcccgggaaagtcctggaatggatgggggatcatctatctgatgactctgataccagatacngtccgtccttgaaggccgcgtcaccttctcagccgacaacgtccatcagcaccgcctaccngcagtggagcagccgtggaacggccctacggacagccgacctaattatagtttcgtgtacgaaccgaaaacctaggtagcagcctaccaaccccggttaaggtactttacgacgttacggtcggggaccgaacggggaaccctggtctacgtcgttacctccgtcgaccgcccgtacccaaccgaacgggcccctacgtcccgggttcccttccccgtacggccctaccccgtcctaccgaacncgcctaccgtcggcggggacacgcggccgtccgtcggcgtcgcgtgacgacggtaccttaccgtcctagtacgtcgtcgcggacgggtcgcgtggacgacggtcgacgtagcgnnnnngcngncnnnnnnnnnnnnnnnnnnnnnn

SEQ ID NO: 126416 - DNA, 870 bp, Homo sapiens
  misc_feature: GYAE6OF02GTLW3.4.38.D05.1.454.CMB.1.raw
  modified_base (770)..(770): a, c, t, g, unknown or other
  misc_feature (770)..(770): n is a, c, g, or t
tcagagcactgtagcacgaccggtgctcgatttagtatctgatagttggggtttgggggagtctccctcactgcccagctgggatctcagggcttctatttttctgtcctccaccatcagtggggtcaaccgccatcctcgccctcctccgtggctgttctaccgaaggagtctgtcgccgaggtgcgagcgtggtgacagtcgtaggacgcgaaggtaagggtaaggaaaaaaccgggccccgggggtaagttccgttacgtaggaaacggtacttcccttaccggttaggttaaaggttagtaggaattacagtttaccgtttacggaaccttacggtaggtacgtcggtacgttgggtacgccggtaccgagggtaccgggaaccccggggaaggtccggtaaggtaacggtagggtaaggttacggggaacttacgtactttacccgttacgtaccgtaggtaacttacgtaccgttacgtaagtaacttaacgagtaacgtaacgtacgttcccgttaccgtaacgggaccgtcccggacttacctaaccgttccacgtaaccgaccgtaaacctaacgtacctaacaccggaaccgtacccctaaaccccggtaccttacggtaccgtaccgggtaaggccgggtaaccaccgtacgggtcccgtaaagggtaacccgtcggtaaaccgggacccgagtacccgtaacttaaagttaacctttacggtacgtaccggtaacggtaaaacccggtaaaaccgttnaacccggtaacccgttaacccgccgtttaaaacccccgggacccggttttaaacggttaaccgtaaccgggttaccccgggttaacggggtaaacccggg

SEQ ID NO: 126417 - DNA, 764 bp, Homo sapiens
  misc_feature: GYAE6OF02GE3HX.4.38.D05.1.454.CMB.1.raw
  modified_base (589)..(589): a, c, t, g, unknown or other
  misc_feature (589)..(589): n is a, c, g, or t
tcagagcactgtagcacgaccggtgctcgatttagtatctgatagttggggtttgggggagagctgctcagttaggacccagagggaaccatggaaaccccagcgcagcttctcttcctcctgctactctggctcccagataccaccggagaaattgtagttgacgcagtctccaggcacccgtgttctttgtctaccgaaggggaaagacgcccaccctcctcctgcgagggcctagtacaagtagtagttacgcagcagtacctaacttaaccgtacggtaaccagacctaacgaaaccgtcggaccgacggtcctacccgaacgccgtcctactactacttagtcggtgaccatccgacgacgacgggacctacgtcggactaaccgtacccgaagtaccgtacgtcgaggtacggacgtagggttcgggtcggacggtacgtaacggtaccttaccgtaacctccgtaacacccgtaacgtaccgaagtacgaaaggtacccgtacgggaacctaccgttaaaggtaaacgtttagttttaccggaagtacggtttacgttactttacggtttacacgggttaanaccggtttaggtaggttaccggttactacgtacccggtaaccgttacgggttaccgaaaccgggtaaccggaggttaaaccgggtaaagaaacccgtaaaccggtaaaccggtagttgggtaacccggttcgtaacccggtaccgttaacctacggtttacgttaccttacccgg

SEQ ID NO: 126418 - DNA, 253 bp, Homo sapiens
  misc_feature: GYAE6OF01CXH9R.12.73.G07.1.454.CMB.1.raw
  modified_base (252)..(253): a, c, t, g, unknown or other
  misc_feature (252)..(253): n is a, c, g, or t
tcagatacgacgtacacgaccggtgctcgatttagctctacgctcagggaacatggccaccctgaccatccgcagggtcgaggccgggatgaggccgactattattgtcaggtgtgggataatggcagtgatcatgtcttattcggcggagggaccacgctgaccgtcctaagtcagcccaaggctgcccctcggtcactctgttcccacctcctctacgtcgtatctgagcgggctggcaaggcgcatagnn

SEQ ID NO: 126419 - DNA, 259 bp, Homo sapiens
  misc_feature: GYAE6OF01B0MHS.12.73.G07.1.454.CMB.1.raw
  modified_base (254)..(259): a, c, t, g, unknown or other
  misc_feature (254)..(259): n is a, c, g, or t
tcagatacgacgtacacgaccggtgctcgatttagctctacgctcagggaacatggccaccctgaccatccgcagggtcgaggccgggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcgggctggcaaggcgcatagnnnnnn

SEQ ID NO: 126420 - DNA, 257 bp, Homo sapiens
  misc_feature: GYAE6OF01EDEQK.12.73.G07.1.454.CMB.1.raw
  modified_base (255)..(257): a, c, t, g, unknown or other
  misc_feature (255)..(257): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcgggctggcaaggcgcatagnnn

SEQ ID NO: 126421 - DNA, 258 bp, Homo sapiens
  misc_feature: GYAE6OF01DHWT0.12.73.G07.1.454.CMB.1.raw
  modified_base (256)..(258): a, c, t, g, unknown or other
  misc_feature (256)..(258): n is a, c, g, or t
tcagatacgacgtacacgaccggtgctcgatttagctctacgctcagggaacatggccaccctgaccatccgcagggtcgaggccgggatgaggccgactattattgtcaggtgtgggataatggcagtgatcatgtcttattcggcggagggaccacgctgaccgtcctaagtcagcccaaggctcgccccctcggtcattctcgttcccgccctcctctacgtcgtatctgagcgggctggcaaggcgcatagnnn

SEQ ID NO: 126422 - DNA, 314 bp, Homo sapiens
  misc_feature: GYAE6OF01DWGN8.12.73.G07.1.454.CMB.1.raw
  modified_base (270)..(271): a, c, t, g, unknown or other
  misc_feature (270)..(271): n is a, c, g, or t
  modified_base (273)..(314): a, c, t, g, unknown or other
  misc_feature (273)..(314): n is a, c, g, or t
tcagatacgacgtacacgaccggtgctcgatttagctctacgctcagggaacatggccaccctgaccatccgcacgggtcgaggccggggattgaggccgactattattggtcaggtgtgggataatgggcagtgatcatgtcttattcggcggagggacccagctgaccgtcctaagtcagcccaaggcctgccccctggtcactctgttccccaccctcctctacgtcgttatcctgacgcgggactgggccaaggtacgcaataggnnannnnnnnnnnnnnnnnnnnnnnnnnnnnnnnnnnnnnnnnnn

SEQ ID NO: 126423 - DNA, 257 bp, Homo sapiens; identical to SEQ ID NO: 126420
  misc_feature: GYAE6OF01CMCWT.12.73.G07.1.454.CMB.1.raw
  modified_base (255)..(257): a, c, t, g, unknown or other
  misc_feature (255)..(257): n is a, c, g, or t

SEQ ID NO: 126424 - DNA, 262 bp, Homo sapiens
  misc_feature: GYAE6OF01B6YCZ.12.73.G07.1.454.CMB.1.raw
  modified_base (254)..(262): a, c, t, g, unknown or other
  misc_feature (254)..(262): n is a, c, g, or t
tcagatacgacgtacacgaccggtgctcgatttagctctacgctcagggaacatggccacccgtgaccatccgcagggtcgaggccgggatgaggccgactattattgtcaggtgtgggataatggcagtgatcatgtcttattcggcggagggaccacgctgaccgtcctaagtcagcccaaggctgccccctggtcactctgttccccgcctcctctacgtcgtatctgagcgggctggcaaggcgcatagnnnnnnnnn

SEQ ID NO: 126425 - DNA, 253 bp, Homo sapiens
  misc_feature: GYAE6OF01A3CBW.12.73.G07.1.454.CMB.1.raw
tcagatacgacgtacacgaccggtgctcgatttagctctacgctcagggaacatggccaccctgaccatccgcagggtcgaggccgggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcgggctggcaaggcgcatag

SEQ ID NO: 126426 - DNA, 258 bp, Homo sapiens
  misc_feature: GYAE6OF01ELHAN.12.73.G07.1.454.CMB.1.raw
  modified_base (255)..(258): a, c, t, g, unknown or other
  misc_feature (255)..(258): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctcgttcccgccctcctctacgtcgtatctgagcgggctggcaaggcgcatagnnnn

SEQ ID NO: 126427 - DNA, 257 bp, Homo sapiens
  misc_feature: GYAE6OF01BSWCC.12.73.G07.1.454.CMB.1.raw
  modified_base (255)..(257): a, c, t, g, unknown or other
  misc_feature (255)..(257): n is a, c, g, or t
tcagatacgacgtacacgaccggtgctcgatttagctctacgctcagggaacatggccaccctgaccatccgcagggtcgatgccggggatgaggccgactattattgtcaggtgtgggataatggcagtgatcatgtcttattcggcggagggaccacgctgaccgtcctaagtcagcccaaggctgccccctcggtcactctcgttcccgcctcctctacgtcgtatctgagcgggctggcaaggcgcatagnnn

SEQ ID NO: 126428 - DNA, 258 bp, Homo sapiens
  misc_feature: GYAE6OF01CYYTY.12.73.G07.1.454.CMB.1.raw
  modified_base (253)..(258): a, c, t, g, unknown or other
  misc_feature (253)..(258): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttccccgcctcctcacgtcgtatctgagcgggctggcaaggcgcatagnnnnnn

SEQ ID NO: 126429 - DNA, 309 bp, Homo sapiens
  misc_feature: GYAE6OF01D8S76.12.73.G07.1.454.CMB.1.raw
  modified_base (260)..(263): a, c, t, g, unknown or other
  misc_feature (260)..(263): n is a, c, g, or t
  modified_base (266)..(309): a, c, t, g, unknown or other
  misc_feature (266)..(309): n is a, c, g, or t
tcagatacgacgtacacgaccggtgctcgatttagctctacgctcgagggaacgatggccaccctgaccatccgcagggtcgaggccggggatcgaggccgactattattgtcaggtgtgggataatggcagtgatcatgtcttattcggcggagggaccacgctgaccgtcctaagtcagcccaaggctgccccctcggtcacgtctgttccccgccctcctctacgtcgtatctgagcgggctggcaaggcgcatagnnnnacnnnnnnnnnnnnnnnnnnnnnnnnnnnnnnnnnnnnnnnnnnnn

SEQ ID NO: 126430 - DNA, 256 bp, Homo sapiens
  misc_feature: GYAE6OF01DCC5T.12.73.G07.1.454.CMB.1.raw
  modified_base (255)..(256): a, c, t, g, unknown or other
  misc_feature (255)..(256): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcgggctggcaaggcgcatagnn

SEQ ID NO: 126431 - DNA, 257 bp, Homo sapiens
  misc_feature: GYAE6OF01BICM3.12.73.G07.1.454.CMB.1.raw
  modified_base (253)..(257): a, c, t, g, unknown or other
  misc_feature (253)..(257): n is a, c, g, or t
tcagatacgacgtacacgaccggtgctcgatttagctctacgctcagggaacatggccaccctgaccatccgcagggtcgaggccgggatgaggccgactattattgtcaggtgtgggataatggcagtgatcatgtcttattcggcggagggaccacgctgaccgtcctaagtcagcccaaggctgcccctcggtcactctgttcccaccctcctctacgtcgtatctgagcgggctggcaaggcgcatagnnnnn

SEQ ID NO: 126432 - DNA, 258 bp, Homo sapiens
  misc_feature: GYAE6OF01D5655.12.73.G07.1.454.CMB.1.raw
  modified_base (255)..(258): a, c, t, g, unknown or other
  misc_feature (255)..(258): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgataatgtcttattcggcggagggaccacgctgaccgtcctaagtcagccaaaggctgcccactcggtcactctgttcccaccctcctctactgctagtctgagcgggctggcaaggcgcatagnnnn

SEQ ID NO: 126433 - DNA, 256 bp, Homo sapiens
  misc_feature: GYAE6OF01ENEW0.12.73.G07.1.454.CMB.1.raw
  modified_base (254)..(256): a, c, t, g, unknown or other
  misc_feature (254)..(256): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttcccgccctcctctacgtcgtatctgagcgggctggcaaggcgcatagnnn

SEQ ID NO: 126434 - DNA, 265 bp, Homo sapiens
  misc_feature: GYAE6OF01B6W0A.12.73.G07.1.454.CMB.1.raw
  modified_base (255)..(265): a, c, t, g, unknown or other
  misc_feature (255)..(265): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgataatgtcttattcggcggagggaccacgctgaccgtcctaagtcagccaaaggctgcccactcggtcactctgttcccgccctcctctactgctagtctgagcgggctggcaaggcgcatagnnnnnnnnnnn

SEQ ID NO: 126435 - DNA, 535 bp, Homo sapiens
  misc_feature: GYAE6OF01EFLHK.12.73.G07.1.454.CMB.1.raw
  modified_base (294)..(294): a, c, t, g, unknown or other
  misc_feature (294)..(294): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
  modified_base (522)..(522): a, c, t, g, unknown or other
  misc_feature (522)..(522): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctatttttagaaggtgtccagtgtgaagtgctgttggtggagtctgggggaggcctggtcaagcctgggggatccctgagactctcctgtgcagcctctggattcagcttcagtcactatagtatgaactgggtccnccagactccgtggggaaggggctgggagtgggtctnattcatcagtagtgaccaanaattacatttacacgccgactcagtgaaggggccgttacaccatctccagagacaacgccaatcgactcactgaatctgacaactagaaacgctagagagaccgaggacgacggactaattattctgtgacgtagtaagtttagaggacgacgagagtaagggagggggganagtggcgtacggg

SEQ ID NO: 126436 - DNA, 271 bp, Homo sapiens
  misc_feature: GYAE6OF01C46JT.12.73.G07.1.454.CMB.1.raw
  modified_base (254)..(271): a, c, t, g, unknown or other
  misc_feature (254)..(271): n is a, c, g, or t
tcagatacgacgtacacgaccggtgctcgatttagctctacgctcagggaacagtggccaccctgaccatccgcagggtcgaggccgggatgaggccgactattattgtcaggtgtgggataatggcagtgatcatgtcttattcggcggagggaccacgctgaccgtcctaagtcagcccaaggctgccccctggtcactctgttcccaccctcctctacgtcgtatctgagcggctgggcaaggcgcatagnnnnnnnnnnnnnnnnnn

SEQ ID NO: 126437 - DNA, 548 bp, Homo sapiens
  misc_feature: GYAE6OF01D36B9.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccgccagactccgtggggaaggggctgggagtgggtctcattcatcagtagtgaccaacaattacatttacacgccgactcagtgaagggtccgttcaccatctccagagacaacgaccaatacgactcactagaatctagacaactagaaacgacctagaagacggaccgacggaccgacggactaatttattcttgtgacgtagtaagtttagaggacgacgagagtaagggagggggggagagtggcggtacggg

SEQ ID NO: 126438 - DNA, 261 bp, Homo sapiens
  misc_feature: GYAE6OF01BMEKU.12.73.G07.1.454.CMB.1.raw
  modified_base (255)..(261): a, c, t, g, unknown or other
  misc_feature (255)..(261): n is a, c, g, or t
tcagatacgacgtacacgaccggtgctcgatttagctctacgctcagggaacatggccaccctgaccatccgcagggtcgaggccgggatgaggccgactattattgtcaggtgtgggataatggcagtgatcatgtcttattcggcggagggaccacgctgaccgtcctaagtcagcccaaggctcgccccctcggtcactctcgttcccacctcctctacgtcgtatctgagcgggctggcaaggcgcatagnnnnnnn

SEQ ID NO: 126439 - DNA, 257 bp, Homo sapiens
  misc_feature: GYAE6OF01EOPH3.12.73.G07.1.454.CMB.1.raw
  modified_base (255)..(257): a, c, t, g, unknown or other
  misc_feature (255)..(257): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctcgccccctcggtcactctgttccccgccctcctctacgtcgtatctgagcggctggcaggcgcatagnnn

SEQ ID NO: 126440 - DNA, 261 bp, Homo sapiens
  misc_feature: GYAE6OF01C7GWG.12.73.G07.1.454.CMB.1.raw
  modified_base (255)..(261): a, c, t, g, unknown or other
  misc_feature (255)..(261): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctcgccccctggtcactctcgttcccacctcctctacgtcgtatctgagcggctggacaaggcgcatagnnnnnnn

SEQ ID NO: 126441 - DNA, 614 bp, Homo sapiens
  misc_feature: GYAE6OF01CGFV7.12.73.G07.1.454.CMB.1.raw
  modified_base (303)..(303): a, c, t, g, unknown or other
  misc_feature (303)..(303): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgcttattttagaaggtgtcagtgtgagtgctgttggtggagtcgtgggggagcctggtcaagccgtgggggactcccgtgacgactctccgtgtgcagcctcgtggattcagtcttcagtcaacttatagtatgaacgtcgggtccnccagactccggtaggggacgggctgggagttggtctctattcatcgaagtagacgaccaaataattactatttacgacgccactcgagtaggaacgggtccgtacaccgtatctacgagacgaacaacgaccaatcgactacactagtaactcgtacgacaacgaagaaacgactagagaacggaccggaagacgacgtactaatttacttcgtagtagtacgtaaggttaagtttaaggaacggtaacggaacggtaaggaagggtaaacggggaacgggggggacgaagggtcgggtacgggtacgggg

SEQ ID NO: 126442 - DNA, 277 bp, Homo sapiens
  misc_feature: GYAE6OF01DVC2K.12.73.G07.1.454.CMB.1.raw
  modified_base (252)..(277): a, c, t, g, unknown or other
  misc_feature (252)..(277): n is a, c, g, or t
tcagatacgacgtacacgaccggtgctcgatttagctctacgctcagggaacagtggccaccctgaccatccgcagggtcgaggccggggatgaggccgactattattgtcaggtgtgggataatggcagtgatcatgtcttattcggcggagggaccagctgaccgtcctaagtcagcccaaggctgccccctggtcactctgttcccgcctcctatacgtcgtatctgagcggctggcaaggcgcatagnnnnnnnnnnnnnnnnnnnnnnnnnn

SEQ ID NO: 126443 - DNA, 578 bp, Homo sapiens
  misc_feature: GYAE6OF01EHF58.12.73.G07.1.454.CMB.1.raw
  modified_base (393)..(393): a, c, t, g, unknown or other
  misc_feature (393)..(393): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagcctgggggatccctgagactctcctgtgcagcctctggattcagcttcagtcactatagtatgaacgtgggtccgccagacctccgtaggggaggggctgggagtgggtctcattcgatcgagtagtcgaccaactaattacatttacacgccgactcagtgaggccgtcacntctcagacgacaacgccaatgactacactagaactctagaccaactacgaaacgtccgtagagacggaccggaggacgaacggtactaacttttacttacgtgtcgagtaaggtaaaggttttaaggaacggaacgtaccgaaggtaaggtaaggggagggggggtacaggtggacggttacggg

SEQ ID NO: 126444 - DNA, 261 bp, Homo sapiens
  misc_feature: GYAE6OF01D6QK3.12.73.G07.1.454.CMB.1.raw
  modified_base (258)..(261): a, c, t, g, unknown or other
  misc_feature (258)..(261): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgcccctcggtcactctcgttccctaccctcctcctacgtcgtactctgagcggcgtggcgaagcgcatagnnnn

SEQ ID NO: 126445 - DNA, 259 bp, Homo sapiens
  misc_feature: GYAE6OF01DQJC7.12.73.G07.1.454.CMB.1.raw
  modified_base (255)..(259): a, c, t, g, unknown or other
  misc_feature (255)..(259): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttccccgccctcctctacgtcgtatctgagcgggctggcaaggcgcatagnnnnn

SEQ ID NO: 126446 - DNA, 757 bp, Homo sapiens
  misc_feature: GYAE6OF01CRUR6.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggactggggctccgctgggtcttccttgttgctattttagaaggtgtccagtgtgaagtgctggttggtggagtcgtgggggaggccgtggtcaagccgtgggggactcccgtgagtactctccgtgtgcacgcctcgtggtattcagtccttcagtacacttaatagtataggaacgtgggtccgccacgtaccgtccggtagggggaacgggcgtagggtacggtgggtcctacgtaattcgtactacgtacggtaaggttccgaaacctaaaaccgttaactttaaacgtaacgtttttaacccgacccgtacccggttactaccgtaagggttacgggaaccggggttacccggttacaaccctacgtaccctaccgaggaaccgaaccgaaaccgaacccgtaagtacgtaacctactacgtacgtaaatccgtagtaacctaacgtaagaaaccgtcgtaagacgtaccggacggaacggaccgtacggtaattaagtttctttacggtacgttaggtaccggttaaagtttaaacgggtttaacgggaacgggtacggaacggtaagggaaggtaaacgggggggaggggggtaccaaggggttcggggtaccggtaaccggggg

SEQ ID NO: 126447 - DNA, 560 bp, Homo sapiens
  misc_feature: GYAE6OF01AMF89.12.73.G07.1.454.CMB.1.raw
  modified_base (293)..(293): a, c, t, g, unknown or other
  misc_feature (293)..(293): n is a, c, g, or t
  modified_base (540)..(540): a, c, t, g, unknown or other
  misc_feature (540)..(540): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccncagactccgtgggaggggctggagtgggtctcattcatcagtagtgaccaacaattacattactacgccgactcagtgaacgggtccgttacaccatctaccagacgacacgaccaagtcgactcactagtaatctagacaactagaaacgctagagacgccgaaggacgacgactaactttattcgtgtcgaggtagttaacgtttaaggagggtaacggacgaggaagtaaggggaggggggganacggtgggtacggtaccggg

SEQ ID NO: 126448 - DNA, 540 bp, Homo sapiens
  misc_feature: GYAE6OF01AVUPI.12.73.G07.1.454.CMB.1.raw
  modified_base (293)..(293): a, c, t, g, unknown or other
  misc_feature (293)..(293): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccnccagactcctgggaagggctggagtgggtctcattcatcagtagtgaccaacaattacatttacacgccgactcagtgaaggccgttcaccatctcagagacaacgaccaatagactcactgaatctcgacaactagaaaacgcctagacgacggaccgaacggacgacggactaatttattctgtgcgtaagtaaggtttagaggtacgacgagacgtaagggaggggggagagtgggcgtacggg

SEQ ID NO: 126449 - DNA, 253 bp, Homo sapiens
  misc_feature: GYAE6OF01EEWAK.12.73.G07.1.454.CMB.1.raw
  modified_base (247)..(247): a, c, t, g, unknown or other
  misc_feature (247)..(247): n is a, c, g, or t
  modified_base (252)..(253): a, c, t, g, unknown or other
  misc_feature (252)..(253): n is a, c, g, or t
tcagatacgacgtacacgaccggtgctcgatttagctctacgctcagggaacatggccaccctgaccatccgcagggtcgaggccgggatgaggccgactattattgtcaggtgtgggataatggcagtgatcatgtcttattcggcggagggaccacgctgaccgtcctaagtcagcccaaggctcgccccctggtcactctgttcccaccctcctctacgtcgtatctgagcgggctggcaggcncatgnn

SEQ ID NO: 126450 - DNA, 261 bp, Homo sapiens
  misc_feature: GYAE6OF01E0M06.12.73.G07.1.454.CMB.1.raw
  modified_base (256)..(261): a, c, t, g, unknown or other
  misc_feature (256)..(261): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctcgttccccgccctcctctacgtcgtatctgagcgggctggcaaggcgcatagnnnnnn

SEQ ID NO: 126451 - DNA, 268 bp, Homo sapiens
  misc_feature: GYAE6OF01ELATO.12.73.G07.1.454.CMB.1.raw
  modified_base (257)..(268): a, c, t, g, unknown or other
  misc_feature (257)..(268): n is a, c, g, or t
tcagatacgacgtacacgaccggtgctcgatttagctctacgctcagggaacagtggccaccctgaccatccgcagggtcgaggccggggatgaggccgactattattgtcaggtgtgggataatggcagtgatcatgtcttattcggcggagggaccacgctgaccgtcctaagtcagcccaaggctcgcccctcggtcactctcgttccccaccctcctctacgtcgtatctgagcggctggcaaggcgcatagnnnnnnnnnnnn

SEQ ID NO: 126452 - DNA, 691 bp, Homo sapiens
  misc_feature: GYAE6OF01D7I9F.12.73.G07.1.454.CMB.1.raw
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
tcagatacgacgtacacgaccggtgctcgatttagctctacgctcaggggggagaaaggagccttagccctggattccaaggcctatccacttggtgagcagcactgagcaccgagaattcaccatggaactggggctccgctgggtcttccttgttgctattttagaaggtgtccagtgtgaagtgctggttggtggagtcgtgggggagcctggtcaagccgtgggggactccctgagactctccgtgtgcagtcctcgtggtacttcagcctttcagtcactatagtatgaacgtgggtcccnccgagactccggtagggggacgggtctgggaggtgggtctcgattcatcgagtagngaccaactattactatttacaccgccactcgagtggaacgggtcccgttacaacctatcctaccagaacgaaccaacgacctaagtacgtacctacactagtaactcgtcgacctaaacgtaacgaaacgtccgtaggaacggaccggtacccggaaggacccgtaacggtacttaagttttactttcgttaggtacggtaacggtaaaggtttaaacggttttaagggaaacgggtaaacccgaaggtaaacgggaaacgggttaaaggggggggaacggggggggtaacctaggggttaaccggggtacgggttaaccccggggggg

SEQ ID NO: 126453 - DNA, 583 bp, Homo sapiens
  misc_feature: GYAE6OF01CCG6M.12.73.G07.1.454.CMB.1.raw
  modified_base (293)..(293): a, c, t, g, unknown or other
  misc_feature (293)..(293): n is a, c, g, or t
  modified_base (417)..(417): a, c, t, g, unknown or other
  misc_feature (417)..(417): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctggtcttccttgttgctattttagaaggtgtccagtgtgaagtgctgttggtggagtcgtgggggaggcctggtcaagcctgggggatccctgagactctcctgtgcagcctctggattcagcttcagtcactatagtatgaactgggtccncagactcgtggagggctggaggtggtctcgattccgatcgagtagtcgacaactaattataactttacacgccgactcagtggaacggccgttcaccatctcagagacaacgaccaatcgactnactcgaatctgacaacgtagaaacgccgtaagacgacgaccggaaggaaccgacggtacctaagtttacgtttcgtagtcgtacggtaaggttaaggttttaaggacgggtaaacgacgaaggtaaggtaaggggaggggggacgagggtgggtacggtaccgggg

SEQ ID NO: 126454 - DNA, 678 bp, Homo sapiens
  misc_feature: GYAE6OF01DLQXS.12.73.G07.1.454.CMB.1.raw
  modified_base (287)..(287): a, c, t, g, unknown or other
  misc_feature (287)..(287): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgcttattttagaaggtgtccagtgtgaagtgctgttggtggagtcgtgggggaggcctggtcaagccgtgggggatccctgagactctcctgtgcacgcctctggattcagtcttcagtcacttatagtangaacgtgggtcccgccagcctccggtaggggaacggggcgtgggagttgggtctctatacatcgagtagtcgacctaaactaatttactacttttacgaccggtaccactcgtaggtcggaacggggtccgttacaccgtactcctccaagacgacaaccgactaagtacgtacctccacgtataacttccgtacgtaacctaaacgtacggaaaacgccgttaggaacggaccggtaccgggaagggaaccgtaacggtactttaacgttttactttcgtaggtacgtacggtaaggttaaacgggttttaggaacgggtaacgtacgtaagggtaacgggtaaaggggggtacggggggtacgtaacggtcgggacggttaaccggggg

SEQ ID NO: 126455 - DNA, 709 bp, Homo sapiens
  misc_feature: GYAE6OF01C9894.12.73.G07.1.454.CMB.1.raw
  modified_base (301)..(301): a, c, t, g, unknown or other
  misc_feature (301)..(301): n is a, c, g, or t
  modified_base (676)..(676): a, c, t, g, unknown or other
  misc_feature (676)..(676): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggccgtggtcaagccgtgggggactcccgtgagactctcctgtgcagcctctggattcagcttcagtcactatagtatgtaacgtcgggtccnccagaccgtccgtaggggaaggggctgggaggttgggtctcattcgatacgagtgtcgaccaaactaattactatttactacgaccactcagtcgggaacgggtccgttacaccgtactccgtaccacggtaacgaaccgaaaccgaccctaacgtacgaactaccacgtacgtaacttcgtacgaactaaacgtaacgaaaacgtccgtaggaacgaacgggaccgggtaagggaacccgtaacgggtaactttaagtttttaaccgtttcgttacggttacggtacggttaagggttaaaacggtttttaaggggaaaccggttaaacggaaccgtaaggtaaacgggtaaacggggggaacggggggggtanaacggggttaaggggtccggttaacccgggggg

SEQ ID NO: 126456 - DNA, 273 bp, Homo sapiens
  misc_feature: GYAE6OF01C7H76.12.73.G07.1.454.CMB.1.raw
  modified_base (259)..(273): a, c, t, g, unknown or other
  misc_feature (259)..(273): n is a, c, g, or t
tcagatacgacgtacacgaccggtgctcgatttagctctacgctcagggaacatggccaccctgaccatccgcagggtcgaggccgggggatgaggccgactattattgtcaggtgtgggataatggcagtgatcatgtcttattcggcggagggaccacgctgaccgtcctaagtcagcccaaggctcgccccctcggtcactctcgttccccgccctcctctacgtcgtatctgagcgggctggcaaggcgcatagnnnnnnnnnnnnnnn

SEQ ID NO: 126457 - DNA, 739 bp, Homo sapiens
  misc_feature: GYAE6OF01DUP56.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactggggctccgctggtcttccttgtgcttatttagaggtgtcagtgtgagtgctggttggtggagtcggtgggggagccgtggtcaacggccgtgggggactcccgtgagtacctctccgtgtcgcacgtcctcgtggtacttcgacgtcttacgagtcactagtagtagtaggtaccgtcgggtccgaccgtagtaccgtcggtaggggaacgggtcgtgggaggtcggtctacgtactcgtatacgaggtacggtacaacctaaactaacgttaacttaacgtttacccgtaaccggtacccgtaacgtacgtaagggtacgggtaaccgggttccgttaccaaccctacgttaccgaccgaaaggacgtaaccgacctaccgaagtccgactacacgtactaacgtcgtaacgacaacgttaacgaacgtcgtaaggacggtacggacccggtaaacgggaacccgtaacggtaactttaacgtttcttaggtacgtacggaaaggttaacgggttaaaggtttaagggaacgggtaaacgacggtaaaaggaaggggtacgggggggaacgggtataaccggggtagggtacgggttaaccggggg

SEQ ID NO: 126458 - DNA, 654 bp, Homo sapiens
  misc_feature: GYAE6OF01EQPF4.12.73.G07.1.454.CMB.1.raw
  modified_base (428)..(428): a, c, t, g, unknown or other
  misc_feature (428)..(428): n is a, c, g, or t
  modified_base (481)..(481): a, c, t, g, unknown or other
  misc_feature (481)..(481): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagccgtgggggactccctgagactctcctgtgcagcctcgtggattcagcttcgagtcactatagtatgaacgtgggtcccgcctaaggaccttcggtagggggaacggggtctgggaggtgggtctcgtattcatcgagttagtcgaccaactaattactatttacaccgaccgtactcgtacggtgaacgggcccgttacacctactcnccgagacgaccgaacacaatacgactcctacgtgtaactctacgacaacgtanaaacgtcctagacgacgaccgtaaggaccgacgggtactaattttacgttactagggtaccggacggtaacggttaaacggttttaaggaacgggtaaccggtaacgaaaggtaaacgggttaaacggggggacgggggggtaacgtagggtcgggtacgggttacccggggg

SEQ ID NO: 126459 - DNA, 570 bp, Homo sapiens
  misc_feature: GYAE6OF01E26WY.12.73.G07.1.454.CMB.1.raw
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (431)..(431): a, c, t, g, unknown or other
  misc_feature (431)..(431): n is a, c, g, or t
tcagatacgacgtacacgaccggtgctcgatttagctctacgctcaggggggaggaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagcctgggggatccctgagactctcctgtgcagcctctggacttcagcttcagtcactatagtatgaactggggtcccnccagactccctggggaaggggctgggagtgggtctcattcatcagtagtgaccaanaattacatttacacgccgactcagtgaagggccgttcaccatctccagagacaacgccaagtgactcactagatcncacaactacgaaacgcctagaggacgaccgaggacgacggactatttacttctgtacgacgtaggtaagttttaaggaaggtaacgacgtaacggaacggtaacggggacgggggggacacgtgggtacggtaccgggg

SEQ ID NO: 126460 - DNA, 264 bp, Homo sapiens
  misc_feature: GYAE6OF01BTVSY.12.73.G07.1.454.CMB.1.raw
  modified_base (250)..(250): a, c, t, g, unknown or other
  misc_feature (250)..(250): n is a, c, g, or t
  modified_base (256)..(264): a, c, t, g, unknown or other
  misc_feature (256)..(264): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctcgccccctggtcactctcgttccccgccctcctctacgtcgtatcgagcgggctggcaaggcncatagnnnnnnnnn

SEQ ID NO: 126461 - DNA, 270 bp, Homo sapiens
  misc_feature: GYAE6OF01CR2CH.12.73.G07.1.454.CMB.1.raw
  modified_base (259)..(270): a, c, t, g, unknown or other
  misc_feature (259)..(270): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctcgccccctcggtcactctcgttccccgccctcctctacgtcgtatctgagcgggctggcaaggcgcagtagnnnnnnnnnnnn

SEQ ID NO: 126462 - DNA, 262 bp, Homo sapiens
  misc_feature: GYAE6OF01BON8U.12.73.G07.1.454.CMB.1.raw
  modified_base (252)..(262): a, c, t, g, unknown or other
  misc_feature (252)..(262): n is a, c, g, or t
tcagatacgacgtacacgaccggtgctcgatttagctctacgctcagggaacatcggccaccctgaccatccgcagggtcgaggccggggatgaggccgactattattgtcaggtgtgggataatggcagtgatcatgtcttattcggcgaggaccagctgaccgtcctaagtcagcccaaggctgccccctggtcactctgttccccgcctctctacgtcgtatctgagcgggctggcaaggcgcatacgnnnnnnnnnnn

SEQ ID NO: 126463 - DNA, 263 bp, Homo sapiens
  misc_feature: GYAE6OF01EUE7T.12.73.G07.1.454.CMB.1.raw
  modified_base (249)..(249): a, c, t, g, unknown or other
  misc_feature (249)..(249): n is a, c, g, or t
  modified_base (255)..(263): a, c, t, g, unknown or other
  misc_feature (255)..(263): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctcgttcccgccctcctctacgtcgtatctgagcgggctggcaaggcncatagnnnnnnnnn

SEQ ID NO: 126464 - DNA, 623 bp, Homo sapiens
  misc_feature: GYAE6OF01B9ETA.12.73.G07.1.454.CMB.1.raw
  modified_base (258)..(258): a, c, t, g, unknown or other
  misc_feature (258)..(258): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagccgtgggggatcccgtgagactctcctgtgcacgcctntggattcgagtcttcagtcactagtagtatgaacgtgggtccgccagacctccggtaggggagggtcctgggtagttgggtcctactagttcagtcaggtagtaccgaccaaactaattactagtttaccacgccgtatcagtaggaacgggtccgttacacctagtcctcgaagacgacaacgacccaatcgaacctacactagaactccgtagacaacgtagaaaccgtcgtagacgacgaccggacgaccgaacggtactagtttacttcgtagtacggtacgtaacgttaaggtttaaggaacggtacgtaacgaaggtaaggtaacgggggaggggtacaagggttggacggttacgggg

SEQ ID NO: 126465 - DNA, 275 bp, Homo sapiens
  misc_feature: GYAE6OF01CXZV8.12.73.G07.1.454.CMB.1.raw
  modified_base (260)..(275): a, c, t, g, unknown or other
  misc_feature (260)..(275): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggccacgctgaccgtctaagtcagcccaaggctcgccccctggtcactctcgttcccgccctcctctacgtcgtatcgtgacggcggctggacaaggtcgacaagtgnnnnnnnnnnnnnnnn

SEQ ID NO: 126466 - DNA, 265 bp, Homo sapiens
  misc_feature: GYAE6OF01B0FCI.12.73.G07.1.454.CMB.1.raw
  modified_base (260)..(265): a, c, t, g, unknown or other
  misc_feature (260)..(265): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttagttcggcggagggaccacgctgaccgtcctaagtcagcccaaggctcgccccctggtcactctcgttccccgccctcctctacgtcgtatcgtgagcgggctggacaaggcgcatagnnnnnn

SEQ ID NO: 126467 - DNA, 553 bp, Homo sapiens
  misc_feature: GYAE6OF01B6NJS.12.73.G07.1.454.CMB.1.raw
  modified_base (349)..(349): a, c, t, g, unknown or other
  misc_feature (349)..(349): n is a, c, g, or t
  modified_base (400)..(400): a, c, t, g, unknown or other
  misc_feature (400)..(400): n is a, c, g, or t
  modified_base (543)..(543): a, c, t, g, unknown or other
  misc_feature (543)..(543): n is a, c, g, or t
tcagatacgacgtacacgaccggtgctcgatttagctctacgctcaggggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctgggtcaagcctgggggatccctgagactctcctgtgcagcctctggattcagtcttcagtcactatagtatgaactgggtccgcagactccgtgggaagggctggagtggatctcattcatcagtgtgaccaaanaattactatttacacgccgactcagtgaacgggtcgtcacatctccgaganacaacgaccaatgactactactagaactctagacaacgtaagaaagccgtagacgacgtaccggaggaacacggactaagtttattctgtagacgtaggtaagtttaggaacggacgacgaggtaagtaagggaggggggagnggtggtacgg

SEQ ID NO: 126468 - DNA, 791 bp, Homo sapiens
  misc_feature: GYAE6OF01DDYO5.12.73.G07.1.454.CMB.1.raw
  modified_base (634)..(634): a, c, t, g, unknown or other
  misc_feature (634)..(634): n is a, c, g, or t
tcagatacgacgtacacgaccggtgctcgatttagctctacgctcagggggagaaagggagccttagccctggattccaaggcctatccacttggtgagcagcactgagcacgagaattcaccagtggactgggctcgctggtcttctgtgcttatttagaggtgtcagtgtgagtgcgtgtggtggagtcgtggggacgccgtggtcaacggtccgtagggggactcccgtaggacgtctcctccgtggtcgcgcgtcctcgtggtacttacgtaggtcctttacgacgtactaaccgttaagttaagttacgtacggtaaccggttcggggttccccgacccgtaacggtacccgttaccggggttagggggaaccgggtcgtaggggtagggttcggtcctactactttcgacgttacggtacggtagttaccgaaaccgtaaattaaccgtttaactaaacccgtttaccgtaacccggtaccgtaactacgttagggaaccggggttaacgggtccccgtttacgaacccgttcgttaccctaacggaacgaaccgaaccgaacccgtacgtaactaccggtaaccttacacgttaagactttcgacgaccgtaaacgaacggttaacncggtaacggaagccggaaccgggtaggaacctaggtaactttaacgttttgtcggtcgtagtaacggtaaggttttaaacgggttaggaaacggtcccgaagaaggggtaacgggtaaggggggcgggtaagaacggtggggtaacggtaccggggg

SEQ ID NO: 126469 - DNA, 740 bp, Homo sapiens
  misc_feature: GYAE6OF01A0VNV.12.73.G07.1.454.CMB.1.raw
  modified_base (313)..(313): a, c, t, g, unknown or other
  misc_feature (313)..(313): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagccgtgggggactccctgagacctctcctgtcgcacgcctcgtaggtacttcagtcttcacgtccactatagtagtagaacgttcgggtacccnccgacgtacctccggtaggggaacgggcgtgggtagggtcggtctctacttcagtacgtagtacgtcgaccgaaactaactttaactacgtttaaccaccggtacccgtacttacggacgtagggtaacggggtcccgttacgacctactcccgtacccgaagacgaaccgaaccgaccctaagtccgtactacgacctagtaacctcgtcgacctaaacgtaacgaaacggtccgtaggacggacggtacccggaagggaacccgtaacgggtaacctttaattttaccgttgtacggttaccggtacgggttaaacggttaaacggttttaagggaacgggtaaccgtaaacggaacgggtaaacgggtaaacgggggggtacggggggggacttacggggtaaggggtcccggttaccgggggg

SEQ ID NO: 126470 - DNA, 888 bp, Homo sapiens
  misc_feature: GYAE6OF01BRQCA.12.73.G07.1.454.CMB.1.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgcgtgggtcttccttgttgcttattttagaaggtgtccagtgtgagtgcttggttggtgagtcggtggggngctggtcagcgtggggctccgngacgactctcgtgtcgcncgtcctgtcggtactcagtcttcacgtctaactagtagttatacggtaaccggttcgggtaccccgaccgacggtaccgttcccgggtaaggggggaacggggtcggttaggggtcgggtttacgggttccttacgttacttaccgtagttaccggtaagttaacgggtcctaacccctaaaactttaaactttaacccgttaaacgtttacccgtaacccgggaccccttaacgtacggtaacgggtacgggtaaaccggggttccccgggtttaccctaaacccgttaccgttaccccgtaaccggtaaaccggaaaccggtaacccgaaacccggtaccctaaaacgtccgtaaaccgtacctaacgtaccggttaactacccgtcgtaaacctaaccgtaaaggtaaacccgtaccggtaacgggaacgggacccgggtaaccgggtaacccggaaccggttaacggttaacgttttaaacgtttttccggtttaggtacgggttactacgggggttaaaagtttaacggggttttaacgggaacggttaaaccgtacgggaaacgggttaaaggggtaaacggggggggtagggggtaaccgaaggggtttaccgggtccggggtaacggggg

SEQ ID NO: 126471 - DNA, 877 bp, Homo sapiens
  misc_feature: GYAE6OF01ESAWI.12.73.G07.1.454.CMB.1.raw
  modified_base (784)..(784): a, c, t, g, unknown or other
  misc_feature (784)..(784): n is a, c, g, or t
tcagatacgacgtacacgaccggtgctcgatttagctctacgctcagggggagaaaggagccttagccctggattccaagcctatccacttggtgagcagcactgagcaccgagaattcaccatggaactggggctccgcgtgggttcttccttgttgcttattttagaaggtgtccagtgtagagtgctggttggtggagtcggtgggggagtccgtggtcaacgtccgtgggggacctcccgtgacgtaccttcttccgtgtcgcgtacgtccgttacgtgggtactttccgtaacggttccctttacgtacggttccttaaaccgtttaagttaacggttaacgttacggtaaacccggttccggggttacccccgacccgaagggtttaccccggtaccggggttaacgggggggaaccgggggtcggttacgggggtacggttccgggggtttccctttgttaacgtttccgtaacgtttacgaacggttacgtacggtaaccctaaaaccttaacgttttaactaaccgttttaaccggaaccgtacccgggttaaactcggtaacggtaccggggtaaccgggtacccggttactaccctacgtttaccgtaaccgaaaggttaaccggaaacccgaaacccgtacctaaacgggtttacaacccgtttaaccgagtttaacgaccctttacggaccgtaaacgttaacggtaaacgaaaccgtccggtacgaacggacccggaccgggacgaaccgtacgtaacgtttacgttttntacgtcgggttataaggtagttaaggttaaggacggttacgaacgtaggaaacgggtgggggacgggtatcgggttaagggcggtaccggggg

SEQ ID NO: 126472 - DNA, 329 bp, Homo sapiens
  misc_feature: GYAE6OF01BY9AS.12.73.G07.1.454.CMB.1.raw
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
  modified_base (268)..(329): a, c, t, g, unknown or other
  misc_feature (268)..(329): n is a, c, g, or t
tcagatacgacgtacacgaccggtgctcgatttagctctacgctcaggggaacgatggccacccctgaccatccgcagggtcgaggccggggatgacggccgactattattgtcaggtgtgggataatggcagtgatcatgtcttagttcggcggagggaccacgctacggaccgtcctaagtcacgacccaaggctcgccccctggcactcgtcgtcccgcctcctctacgtcgtatcgngacgcggcgtggccaaggcncatagtnnnnnnnnnnnnnnnnnnnnnnnnnnnnnnnnnnnnnnnnnnnnnnnnnnnnnnnnnnnnnn

SEQ ID NO: 126473 - DNA, 808 bp, Homo sapiens
  misc_feature: GYAE6OF01AXX1Z.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactgggctccgctggtcttcttgtgctattttagaaggtgtccagtgtgaagtgctgttggtggagtcggtgggggaggccgtggtcaaggtccgtgggggactcccgtgacgtacctctcctggtcgcacggtcctcgtggtacttcgagtccttacgtacgttcgaaccttagtaagtacgtagtaaccggtcggggtaccccaccgaggtaccgttccggtagggggacggggtcgtgggtacgggttcggtccttactagttcacgtcgtaaggttacgtcgtaacctaaacttaacttacgttaactttacgtaccgaccgtacgtacgtaacgggtacgggaaccggggttcccgttacacccgtaacgttccgttaaccgaacggtaaccggtaacccgaaaccggtaaccctaacgtaccggaaacttaccctaacgttaacggtaacgttccgtaaccggtaactaaacccggtaagtaaaaccgtcccggttaaggaaccgggacggtaaccgggtaccgggaaaccgtaccggttaacgtttaacttttacggttacgtacgtacggttacggtaaacggtttaaggtttacgggaaacgggtcgtacgtaaaggtacggggtaacgggggaggggggaccttagggtcccggttacgggtacccgggg

SEQ ID NO: 126474 - DNA, 869 bp, Homo sapiens
  misc_feature: GYAE6OF01B2RQ1.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttcttgttgctattttagaaggtgtccagtgtgaagtgcgttggttggtggagtcggtgggggcgccgtggtacaaggccggtcgggggtactcccgtgacgtacttcctcgtagtcgcacgtcctcgtggtacttccgattccgttactacgttacctaacgtttaagtaacggttagttacggtaaccggttccggggtccccgaccgtaacggtaccgttaccggggtacggggggtaacggggtccggtagggggtacgggttcgggttccgttacgtacgttacgtaacgttcggtaacggttacgtaccggtaaccctaaaacgttaaacgttttaaccttaaacgttttaaccccggtaaccggacccgttaaccgtacggtaacggggtacccggggtaaccgggttcccgggttaaccaacccggttacctcccggtaaccgtaaagaacgggaaacccaaaccgttaaccgtaaagaccggttaacctacgtaacgttacgtaaactcggtaacggaaaccctcggtaaacaacggtcctagggaaccgtaccggacccggtaaggtaccgtaacgttaactttattttaccgttcgtagggaccgttaagtaacggttttaaaggtacggaaacgggtaacgcggttaaaagggacgggtaacggggggggtacggggaatacggggttggggtaaccgggttaccggggg

SEQ ID NO: 126475 - DNA, 265 bp, Homo sapiens
  misc_feature: GYAE6OF02GKC08.12.73.G07.1.454.CMB.1.raw
  modified_base (249)..(265): a, c, t, g, unknown or other
  misc_feature (249)..(265): n is a, c, g, or t
tcagatacgacgtacacgaccggtgctcgatttagctctacgctcagggaacatggccaccctgaccatccgcagggtcgaggccgggatgaggccgactattatgtcaggtgtggataatggcagtgatcatgtcttattcggcggagggaccacgctgaccgtcctaagtcagcccaaggctgcccctggtcactctgttcccacctctctacgtcgtatctgagcgggctgggcaaggcgcatagnnnnnnnnnnnnnnnnn

SEQ ID NO: 126476 - DNA, 258 bp, Homo sapiens
  misc_feature: GYAE6OF02G3EVP.12.73.G07.1.454.CMB.1.raw
  modified_base (255)..(258): a, c, t, g, unknown or other
  misc_feature (255)..(258): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcgggctggcaaggcgcatagnnnn

SEQ ID NO: 126477 - DNA, 260 bp, Homo sapiens
  misc_feature: GYAE6OF02F2UNT.12.73.G07.1.454.CMB.1.raw
  modified_base (255)..(260): a, c, t, g, unknown or other
  misc_feature (255)..(260): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttcccaccctcctctacgtcgtatctgagcgggctgggcaaggcgcatagnnnnnn

SEQ ID NO: 126478 - DNA, 257 bp, Homo sapiens; identical to SEQ ID NO: 126420
  misc_feature: GYAE6OF02H9FMB.12.73.G07.1.454.CMB.1.raw
  modified_base (255)..(257): a, c, t, g, unknown or other
  misc_feature (255)..(257): n is a, c, g, or t

SEQ ID NO: 126479 - DNA, 255 bp, Homo sapiens
  misc_feature: GYAE6OF02ICC7L.12.73.G07.1.454.CMB.1.raw
  modified_base (254)..(255): a, c, t, g, unknown or other
  misc_feature (254)..(255): n is a, c, g, or t
tcagatacgacgtacacgaccggtgctcgatttagctctacgctcagggaacatggccaccctgaccatccgcagggtcgaggccgggatgaggccgactattattgtcaggtgtgggataatgtcagtgatcatgtcttattcggcggagggaccacgctgaccgtcctaagtcagcccaaggctgccccctcggtcactctgttcccaccctcctctacgtcgtatctgagcgggctggcaaggcgcatagnn

SEQ ID NO: 126480 - DNA, 260 bp, Homo sapiens
  misc_feature: GYAE6OF02GICG0.12.73.G07.1.454.CMB.1.raw
  modified_base (254)..(260): a, c, t, g, unknown or other
  misc_feature (254)..(260): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttcccaccctcctctacgtcgtatctgagcgggctggcaaggcgcatagnnnnnnn

SEQ ID NO: 126481 - DNA, 256 bp, Homo sapiens
  misc_feature: GYAE6OF02HAAZ7.12.73.G07.1.454.CMB.1.raw
  modified_base (254)..(256): a, c, t, g, unknown or other
  misc_feature (254)..(256): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttcccaccctcctctacgtcgtatctgagcgggctggcaaggcgcatagnnn

SEQ ID NO: 126482 - DNA, 260 bp, Homo sapiens
  misc_feature: GYAE6OF02JQ0MX.12.73.G07.1.454.CMB.1.raw
  modified_base (252)..(260): a, c, t, g, unknown or other
  misc_feature (252)..(260): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttcccacctctctacgtcgtatctgagcgggctggcaaggcgcatagnnnnnnnnn

SEQ ID NO: 126483 - DNA, 260 bp, Homo sapiens; identical to SEQ ID NO: 126480
  misc_feature: GYAE6OF02JFTHL.12.73.G07.1.454.CMB.1.raw
  modified_base (254)..(260): a, c, t, g, unknown or other
  misc_feature (254)..(260): n is a, c, g, or t

SEQ ID NO: 126484 - DNA, 258 bp, Homo sapiens
  misc_feature: GYAE6OF02HZG0S.12.73.G07.1.454.CMB.1.raw
  modified_base (255)..(258): a, c, t, g, unknown or other
  misc_feature (255)..(258): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttccccgccctcctctacgtcgtatctgagcgggctggcaaggcgcatagnnnn

SEQ ID NO: 126485 - DNA, 263 bp, Homo sapiens
  misc_feature: GYAE6OF02G74QE.12.73.G07.1.454.CMB.1.raw
  modified_base (253)..(263): a, c, t, g, unknown or other
  misc_feature (253)..(263): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccgcctcctctacgtcgtatctgagcgggctggcaggcgcatagnnnnnnnnnnn

SEQ ID NO: 126486 - DNA, 257 bp, Homo sapiens
  misc_feature: GYAE6OF02FO06Z.12.73.G07.1.454.CMB.1.raw
  modified_base (255)..(257): a, c, t, g, unknown or other
  misc_feature (255)..(257): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccgccctcctctacgtcgtatctgagcgggctggcaaggcgcatagnnn

SEQ ID NO: 126487 - DNA, 259 bp, Homo sapiens
  misc_feature: GYAE6OF02HHX09.12.73.G07.1.454.CMB.1.raw
  modified_base (255)..(259): a, c, t, g, unknown or other
  misc_feature (255)..(259): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcgggctggcaaggcgcatagnnnnn

SEQ ID NO: 126488 - DNA, 258 bp, Homo sapiens
  misc_feature: GYAE6OF02IBO93.12.73.G07.1.454.CMB.1.raw
  modified_base (254)..(258): a, c, t, g, unknown or other
  misc_feature (254)..(258): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccgcctcctctacgtcgtatctgagcgggctggcaaggcgcatagnnnnn

SEQ ID NO: 126489 - DNA, 259 bp, Homo sapiens
  misc_feature: GYAE6OF02HALFL.12.73.G07.1.454.CMB.1.raw
  modified_base (255)..(259): a, c, t, g, unknown or other
  misc_feature (255)..(259): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccgccctcctctacgtcgtatctgagcgggctggcaaggcgcatagnnnnn

SEQ ID NO: 126490 - DNA, 537 bp, Homo sapiens
  misc_feature: GYAE6OF02GIOEE.12.73.G07.1.454.CMB.1.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (287)..(288): a, c, t, g, unknown or other
  misc_feature (287)..(288): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (305)..(306): a, c, t, g, unknown or other
  misc_feature (305)..(306): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
tcagatacgacgtacacgaccggtgctcgatttagctctacgctcagggaaacgatggccaccctggaccatccgcacgggtccgaggcccgggactgaggccgacgtattatggtcacggtggtgggataatggcacgtgatcatcgtcttattcggcggaggaccacggctgaccgtcctaagtcagtcccaaggctcgccccctggtaccactctgttcccgcccttcctctacgtcgtatctcgagcggctggcaacggcgcatacgccancatgntatnagnntancgccncgcgcgngnntctctctcgtcagcngcacncgcncncactctctcgtcgcncgcgcgcgacgacgacgntagtatatacgcgtacncgtactanactacagacactatnttgtcgtacgacgtacgacgacgtacgtctacgtacgcgacgaccgacgaccaccactactactctacgtccgtcccgtcctccgtacgtacgtacgtacgtacgtacggtacggcggacggtacgacgacg

SEQ ID NO: 126491 - DNA, 258 bp, Homo sapiens
  misc_feature: GYAE6OF02I287U.12.73.G07.1.454.CMB.1.raw
  modified_base (254)..(258): a, c, t, g, unknown or other
  misc_feature (254)..(258): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttcccaccctcctctacgtcgtatctgagcgggctggcaaggcgcatagnnnnn

SEQ ID NO: 126492 - DNA, 544 bp, Homo sapiens
  misc_feature: GYAE6OF02IK733.12.73.G07.1.454.CMB.1.raw
  modified_base (427)..(427): a, c, t, g, unknown or other
  misc_feature (427)..(427): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccgccagactcctggggaagggctggagtgggtctcattcgatcagtagtgacctaacaattacatttactacgccgactcagtgagggccgttcaccatctcagagacaacgcaatcgactacactagaatactancaactagaaagcctagagacgacgacggacgacgactaattacttactgtagacgtagtaagtttagaggtaacgacgaagtagtaacgggagggggacgaggtacggtagtacggg

SEQ ID NO: 126493 - DNA, 262 bp, Homo sapiens
  misc_feature: GYAE6OF02FMZ34.12.73.G07.1.454.CMB.1.raw
  modified_base (255)..(262): a, c, t, g, unknown or other
  misc_feature (255)..(262): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcgggctggcaaggcgcatagnnnnnnnn

SEQ ID NO: 126494 - DNA, 260 bp, Homo sapiens
  misc_feature: GYAE6OF02IL2OH.12.73.G07.1.454.CMB.1.raw
  modified_base (255)..(260): a, c, t, g, unknown or other
  misc_feature (255)..(260): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttccccgccctcctctacgtcgtatctgagcgggctggcaaggcgcatagnnnnnn

SEQ ID NO: 126495 - DNA, 257 bp, Homo sapiens
  misc_feature: GYAE6OF02HJY9A.12.73.G07.1.454.CMB.1.raw
  modified_base (254)..(257): a, c, t, g, unknown or other
  misc_feature (254)..(257): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcggctggcaaggcgcatagnnnn

SEQ ID NO: 126496 - DNA, 538 bp, Homo sapiens
  misc_feature: GYAE6OF02JD13H.12.73.G07.1.454.CMB.1.raw
  modified_base (348)..(348): a, c, t, g, unknown or other
  misc_feature (348)..(348): n is a, c, g, or t
  modified_base (525)..(525): a, c, t, g, unknown or other
  misc_feature (525)..(525): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccgccagacctccgtggggaaggggctggagtgggtctcattcatcagtagtgccaanaattacatttacacgccgactcagtgaacgggccggttcaccatctccagagacaacgaccaatcgactcactagaactctacgacaactagaaacgcctagagacgaccgaggacgacgactaatttattctgtgagtagtaagtttagaggaacgagagagtaagggaggggganaggtggagtcggg

SEQ ID NO: 126497 - DNA, 264 bp, Homo sapiens
  misc_feature: GYAE6OF02I5XPA.12.73.G07.1.454.CMB.1.raw
  modified_base (252)..(264): a, c, t, g, unknown or other
  misc_feature (252)..(264): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgataatgtcttattcggcggagggaccacgctgaccgtcctaagtcagccaaaggctgcccactcggtcactctgttcccgcctctctactgctagtctgagcggctggcaaggcgcatagnnnnnnnnnnnnn

SEQ ID NO: 126498 - DNA, 260 bp, Homo sapiens
  misc_feature: GYAE6OF02G5QVY.12.73.G07.1.454.CMB.1.raw
  modified_base (253)..(260): a, c, t, g, unknown or other
  misc_feature (253)..(260): n is a, c, g, or t
tcagatacgacgtacacgaccggtgctcgatttagctctacgctcagggaacatggccaccctgaccatccggcagggtcgaggccggggatgaggccgactattattgtcaggtgtgggataatggcagtgatcatgtcttattcggcggagggaccagctgaccgtcctaagtcagcccaaggctgccccctggtcactctgttcccacctcctctacgtcgtatctgagcgggctggcaaggcgcatagnnnnnnnn

SEQ ID NO: 126499 - DNA, 258 bp, Homo sapiens
  misc_feature: GYAE6OF02I6EYO.12.73.G07.1.454.CMB.1.raw
  modified_base (254)..(258): a, c, t, g, unknown or other
  misc_feature (254)..(258): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccctcctctacgtcgtatctgagcggctggcaaggcgcatagnnnnn

SEQ ID NO: 126500 - DNA, 551 bp, Homo sapiens
  misc_feature: GYAE6OF02HZ2N1.12.73.G07.1.454.CMB.1.raw
  modified_base (296)..(296): a, c, t, g, unknown or other
  misc_feature (296)..(296): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagcctgggggatccctgagactctcctgtgcagcctctggatttcagcttcagtcactatagtatgaactgggtcccncagacctccgtgggaagggctggagtgggtctcattcatcagtagtgaccaacaattacatttacacgccgactcagtgaacgggccggttacacctatctccagacgacaacgaccaatcgactcactagaactctgacaactagaaacgcgtagagacgaccgaaggaccacggactaattactttgtgtgacgtagtaagtttaggaggaacgacgaggagtaaggggagggggacgaggtggacgtacggg

SEQ ID NO: 126501 - DNA, 260 bp, Homo sapiens
  misc_feature: GYAE6OF02GM132.12.73.G07.1.454.CMB.1.raw
  modified_base (255)..(260): a, c, t, g, unknown or other
  misc_feature (255)..(260): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccgccctcctctacgtcgtatctgagcgggctggcaaggcgcatagnnnnnn

SEQ ID NO: 126502 - DNA, 586 bp, Homo sapiens
  misc_feature: GYAE6OF02IBHH6.12.73.G07.1.454.CMB.1.raw
  modified_base (293)..(293): a, c, t, g, unknown or other
  misc_feature (293)..(293): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctatttttagaaggtgtccagtgtgaagtgctgttggtggagtctgggggaggcctggtcaagcctgggggatccctgagactctctgtgcagcctctggattcagcttcagtcactatagtatgaactgggtccnccagactccgtaggggaagggctgggagtgggtctcgattcatcaggtagtgaccaataattacatttacacgccgactcgagtacgaacgggccggttcaccgtatctcaagacgaacaacgaccaactagtactaccactgtaaactcctgacctaaactagaaacgcgtacgagacggaccgaggaacgacggactaaagtttattcgtgtacgacgtaggttaacggttaggaacggtaacgtagaggtaaggtaggggaggggggtacgaggtacggacggttacggg

SEQ ID NO: 126503 - DNA, 543 bp, Homo sapiens
  misc_feature: GYAE6OF02HH4DP.12.73.G07.1.454.CMB.1.raw
  modified_base (293)..(293): a, c, t, g, unknown or other
  misc_feature (293)..(293): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccnccagactcctgggaaggggctggagtgggtctcattcatcagtagtgccaacaattacatttacacgcgactcagtgaagggccggttcaccatctcagagacaacgccaatgactcactgaatctgcaacgtagaaacgcctgacgacgaccgacggacaccggactaatttatttctgtgacggtagtaaggttttaggaaggtaacgacgaagtagtaagggacggggggcgaggtggacgtacggg

SEQ ID NO: 126504 - DNA, 259 bp, Homo sapiens
  misc_feature: GYAE6OF02IOQ84.12.73.G07.1.454.CMB.1.raw
  modified_base (249)..(249): a, c, t, g, unknown or other
  misc_feature (249)..(249): n is a, c, g, or t
  modified_base (254)..(259): a, c, t, g, unknown or other
  misc_feature (254)..(259): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctcgttccccaccctcctctacgtcgtatctgagcggctggcaaggcncatgnnnnnn

SEQ ID NO: 126505 - DNA, 612 bp, Homo sapiens
  misc_feature: GYAE6OF02GLXXC.12.73.G07.1.454.CMB.1.raw
  modified_base (589)..(589): a, c, t, g, unknown or other
  misc_feature (589)..(589): n is a, c, g, or t
tcagatacgacgtacacgaccggtgctcgatttagctctacgctcagggggagaaaggagccttaggccctggattccaaggcctatccaccttggtcgagcagcactgagcaccgagaattcaccatggaactggggctccgctgggtcttccttgttgctattttagaaggtgtccagtgtgaagtgctgttggtggagtcgtgggggaggcctggtcaagccgtgggggatccctgagactctccgtgtcgcagcctctggatttcgagtccttcgagtcactactagtatgaactgggtccgcagactccgtggggaacgggcgtgggaggtgggtcgtcgattcagtcgagtgtcgaccaaagaacttacatttactacgtcgtactcagtaggaacgggccggttcaccgtatctaccgagacgacaaccgaccaactgtacctcacgtagaactctgaccactagaaacgcctagagacggaccgaggaaccgacggtaactaagttttaacttcgtaggtacggagtaaggttaaggtttagaacggtaacggactaaggtacgttaaggggcgggggtanagggttacgggaccttaccgggg

SEQ ID NO: 126506 - DNA, 803 bp, Homo sapiens
  misc_feature: GYAE6OF02FVYTV.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagccgtgggggatccctgagactctcctgtgcagcctctggattcagcttcagtcactatagtatgaacgtgggtccgccagacctccgtggggaaggggcgtgggaggtgggtcctcgtatttcatcgagtacggtcgacccaaactaatttactaacttttaccgtaccgtcccggtaactcgtaaggttacgggaacggggtcccggtttaccaacccgtacttacccgtacccgaacggtaacggaaacccaaaccggtaaccctaaaagttaccggtaacccttaccgtaaccgttaacgtaaacgttaccgttacgtaaccctaaaaccgttaaggaaaaacccgtccgttacggaaacgggtaaccggtacccgggaaacgggtaacccggtaaccgggtaaccgttaaaacgtttttacgttttaccgttacgggttacggtaaccgggttaaaggtttaaacgggtttttaacggaaacgggggttaaacccgtaacggtaagggtaaacggtaacgggggggtaacgggggggggtacgtaacggggttacggggtaaccgggttaacccggggg

SEQ ID NO: 126507 - DNA, 605 bp, Homo sapiens
  misc_feature: GYAE6OF02JAA4F.12.73.G07.1.454.CMB.1.raw
  modified_base (293)..(293): a, c, t, g, unknown or other
  misc_feature (293)..(293): n is a, c, g, or t
  modified_base (441)..(441): a, c, t, g, unknown or other
  misc_feature (441)..(441): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgcttattttagaaggtgtccagtgtgaagtgctgttggtggagtctgggggagcctggtcaagcctgggggatccctgagactctcctgtgcagcctctggattcagccttcagtcactatagtatgactgggtccnccagactccgtgggaagggctggagtgggtctcatttcatcagtagtgaccaacaattacatttacacgccgtactcaagtggacgggtcccggttacaccactcctccgaacgtacgaaccaacgacctactacgactaccacgtanaacttcgacgtacctaactaacgaaaccgccgtaggaacgacgaccgtacggaccgacgtactaatttattcgtacgtgtacgtaggtaaggttttaaggacgggtaaacgcgtaaggacggtaagggggtacgggggggactacggtacgggtacgtacgggg

SEQ ID NO: 126508 - DNA, 266 bp, Homo sapiens
  misc_feature: GYAE6OF02I5UVJ.12.73.G07.1.454.CMB.1.raw
  modified_base (256)..(266): a, c, t, g, unknown or other
  misc_feature (256)..(266): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctcgccccctggtcactctcgttcccaccctcctctacgtcgtatctgagcgggctggacaggcgcatagnnnnnnnnnnn

SEQ ID NO: 126509 - DNA, 551 bp, Homo sapiens
  misc_feature: GYAE6OF02IXJFN.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccgccagactccgtggggaaggggctgggagtgggtctcattcatcagtagtgaccaactaattactatttacctacgccgactcagtgaacgggtccggttacaccatctccagagacaacgaccaatcgactcactagaatctgaccaactagaaacgcctagaacgacgaccgacggacgacgactaatttattctgtgacgtagtaagtttagaaggtaacgacgagagtaagggagggggacgaggtggagtcggg

SEQ ID NO: 126510 - DNA, 637 bp, Homo sapiens
  misc_feature: GYAE6OF02HC5O3.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgcttattttagaaggtgtccagtgtgaagtgctgttggtggagtcgtgggggaggcctggtcaagccgtgggggactcccgtgagactctcctgtcgcagcctcgtggattcagtcttcagtcactatagtatgaacgtcgggtccgccagacctccggtggggaacggggctgggaggttgggtctctacttcatcgagtagtcgacctaactaatttactatttaaccaccgaccgtactcgagtacggaacgggtcccgttacaccgtctacctaccaggaacgtaccgaacgacctaagtacgacctacacgtagaactcgtacgactaacgtagaaacgcctaggagacgaccggaaggaccgacggtacttaagtttacttcgtgtacggtagtaaggttaaggtttaacggacggtaacgacgaaggtaacggtaagggggacgggggtacgtaggtacgggtacggtacgggg

SEQ ID NO: 126511 - DNA, 564 bp, Homo sapiens
  misc_feature: GYAE6OF02F6855.12.73.G07.1.454.CMB.1.raw
  modified_base (294)..(294): a, c, t, g, unknown or other
  misc_feature (294)..(294): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactggggtccnccagacctccgtgggaacggggctgggagtgggtctcagttcatcagtagtcgaccaacaattacatttactacgccgactcagtaggaacgggccggttcacctatctccagagaccaacgaccaatgactcactagaatcagcaactagaaacgctagagacgaccgaggacgacggactaatttattctgtgacgtaagtaaggtttaaggacggtaacgacgaaggtaggtaaggggaggggggacgaggtagggacggtaccggg

SEQ ID NO: 126512 - DNA, 339 bp, Homo sapiens
  misc_feature: GYAE6OF02FL019.12.73.G07.1.454.CMB.1.raw
  modified_base (265)..(266): a, c, t, g, unknown or other
  misc_feature (265)..(266): n is a, c, g, or t
  modified_base (269)..(269): a, c, t, g, unknown or other
  misc_feature (269)..(269): n is a, c, g, or t
  modified_base (272)..(339): a, c, t, g, unknown or other
  misc_feature (272)..(339): n is a, c, g, or t
tcagatacgacgtacacgaccggtgctcgatttagctctacgctcagggaacagtggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttccccgcccttcctctacgtcgtatcgtgacgccgggctggcaacgggccgcaatagnntcngannnnnnnnnnnnnnnnnnnnnnnnnnnnnnnnnnnnnnnnnnnnnnnnnnnnnnnnnnnnnnnnnnnn

SEQ ID NO: 126513 - DNA, 259 bp, Homo sapiens
  misc_feature: GYAE6OF02G61ZI.12.73.G07.1.454.CMB.1.raw
  modified_base (249)..(249): a, c, t, g, unknown or other
  misc_feature (249)..(249): n is a, c, g, or t
  modified_base (254)..(259): a, c, t, g, unknown or other
  misc_feature (254)..(259): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttccccaccctctctacgtcgtatctgagcggctggacaaggcncatgnnnnnn

SEQ ID NO: 126514 - DNA, 279 bp, Homo sapiens
  misc_feature: GYAE6OF02IWYE6.12.73.G07.1.454.CMB.1.raw
  modified_base (248)..(248): a, c, t, g, unknown or other
  misc_feature (248)..(248): n is a, c, g, or t
  modified_base (254)..(279): a, c, t, g, unknown or other
  misc_feature (254)..(279): n is a, c, g, or t
tcagatacgacgtacacgaccggtgctcgatttagctctacgctcagggaacatggccaccctgaccatccgcagggtcgaggccggggatgaggccgactattatgtcaggtgtgggataatggcagtgatcatgtcttattcggcggagggaccacgctgaccgtcctaagtcagcccaaggctcgccccctggtcactctgttcccaccctcctcctacgtcgtatctgagcggctggcaaggcncatagnnnnnnnnnnnnnnnnnnnnnnnnnn

SEQ ID NO: 126515 - DNA, 695 bp, Homo sapiens
  misc_feature: GYAE6OF02IJLJ8.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgcttattttagaaggtgtccagttgtgaagtgcttgttggtggagtcgtgggggagcctggtcaagccgtggggactcctgacgtctctccgtgtcgcacgtcctcgtggtattcagtcttcacgtcacttatagtatagtaacgtcgggtcccacctacgaccgtcgggtaggggaacgggtctgggtaggtgggtctctacttcatacgtaggtcgcgaccaaactaaacttactaactttaccgaccgtccgtactacgtaggtacggaaccgggtccgttaccacgtacttccgacgtaacgacgtaacaaaccgtacctaaattcgacctactaacgtagtaacttactaacgttaaacgaacgtaaacgtccgtaaggacggtaacggaccggaacggtaccgtaccgggtacgttagttacgtttacgttcgtaggtcggaccggtacgggtacccgttaccgtacggttaactaaacttaaacgttttcaaacggtaaacctagtaaacgtttaccggttccgtaacccgg

SEQ ID NO: 126516 - DNA, 739 bp, Homo sapiens
  misc_feature: GYAE6OF02JC9F2.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagcctgggggatccctgacgactctcctgtcgcagcctctggattcagccttcagtcatatagtatagaacgtcgggtcccgaccacgaccgtccgtaggggaacggggtcgtgggaggtcgggtctcgtacttcagtcgagttagtacgacctaaactaatttaacctaattttaccgaccggtacccgtacgttacgtacggtacggtaaacggggtcccggttaccgaccctacgttaccctacccgaacgaacgtaaccgtaacccgacctaacgttacgtaaccttactaacgttagtaacttccgttacgaccctaaacggtaacgaaaccgtacccgttaaggaaccggacggtacccggaacggtaccgaaccggtaacgtttaacttttacgttttacgttacggtacggtacggttaggttaaaggttttacgggaaacgggtaaccgtacgaaggtaacggtaacgggggtaccggggggtataacgggtacgggtaaccggttacgggg

SEQ ID NO: 126517 - DNA, 257 bp, Homo sapiens
  misc_feature: GYAE6OF02I2M2C.12.73.G07.1.454.CMB.1.raw
  modified_base (253)..(257): a, c, t, g, unknown or other
  misc_feature (253)..(257): n is a, c, g, or t
tcagatacgacgtacacgaccggtgctcgatttagctctacgctcagggaacatggccaccctgaccatccgcagggtcgaggccggggatgaggccgactattattgtcaggtgtgggataatggcagtgatcatgtcttattcggcggagggaccagctgaccgtcctaagtcagcccaaggctgccccctggtcactctcgttccccacctcctctacgtcgtatctgagcggctggcaaggcgcatagnnnnn

SEQ ID NO: 126518 - DNA, 829 bp, Homo sapiens
  misc_feature: GYAE6OF02HOGH9.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaactgggctccgctgggtcttccttgttgcttatttagaaggtgtccagtgtgaagtgctgttggtggagtcgtgggggaggcctggtcaagccgtgggggactcccgtgacgactcttccgtgtgcacgcctcgtggtattcacgtcttcagttccaactattagtatacgaacgttcgggtacccgaccgagtacctccggtaggggaacggggcgtggggtaggtcgggtctactacttcgacgttcacggttagtccggaaccctaaacgttaaaacttttaaccttaacttttaacccgtaacccggtaccgaaccgttaccggtaaaggttaaccgggtaacgggggttacccccgttttaaccgaacccctacgttacccgttaccccgaaaggtaaccgaaacccgaaacccggtaccctaaaggtaccgtacttacccgaacgttaggtaacttacgtacgaacccgtaacggtaaaccgtaaaacggttccctaggaacggtaacccggaccgggtaaacggaaccgtaaccggtaaccgtttaaagttttacgttttaccgttggttacgtacggttaacggttttaaaggtttaacggaacgggtaaaccgtacgaaagggtaacgggttaaaacggggacgggggggttaaccggtaacgggttaccggggttaaccggttaccggggg

SEQ ID NO: 126519 - DNA, 983 bp, Homo sapiens
  misc_feature: GYAE6OF02GOX4D.12.73.G07.1.454.CMB.1.raw
tcagatacgacgtacacgaccggtgctcgatttagctctacgctcagggggagaaaggagccttagccctggattccaaggcctatccacttggtgagcagcactgagcaccgagaattcaccatggaacgtgggctccgcgtgggtcttccttgttgcttatttagaaggtgtccagtgtagaagtgcgttgttggtggagtcgtggggaggccgtggtacgaagccgtgggggactcccgtagagacgtctccgtgtcgacacgtcctcgtacgggtacttcgaggtcctttacgaacgttacctaaccttaagtaagttacgttaggaaccgttcggggtacccgtaccgaacggtacccgttccggtaacgggggaacgggggtccgttagggggtaacgggttacgggggttcccgttacctaacgttttaccggtaacgttaaccgtaagggttaacggttaccggaacccctaaaaaccgttaaaacgttttaaacccgttaaacgtttttaacccggaaaccccggttacccgttaaccggttaaaccgttaacggggtacgggtaaaaccgggggttaccccgggtttacccaacccgtttaaacgtcccgttaacccggaaggtaaaccgtaaacccggaacccggacccttaaaagtaccgtaaccctacccggtaacttaaccgggtaaacgttccgtacgggtaaaccgtaaacccgttaaacggaaaaccggttccgttaaacgggaaccgggaaccggtacccgggtaaaccgggaaccgtaacccgggttaacgtttaaaacgtttttagtttaccggtgggttttaccgacgggtttaaaggtttaaacgggtttttaaacggggaaccggtaaacgggaacccgttaagggtaaacggggtaaacggggggttacggggggaaccttaaacggggttcggggttaaacccggttaaccggggggg

SEQ ID NO: 126520 - DNA, 578 bp, Homo sapiens
  misc_feature: GYAE6OF02HTIR1.12.73.G07.1.454.CMB.1.raw
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactgggctccgctgggtcttccgttgttgctattttagaggtgtccagtgtgaagtgctgttggtggagtctgggggagccgtggtcgaagcctgggggatccccgtgagactcncctgtgcagcctctggattcagcttnagtcactatagtangaactgggtccgcagacctcctagggaaggggctggagtgggtcncattcagtcagtagtgccaagaattacaatttactacgcgacgtcagtgaacgggccggttacaccaatctccctagacgacaacgccgaatgactcactgaaatcagcgaacgtagaaacgcctagacgtacgccgagacgtacgacgtaaactttaacttctcgtagacgtacggtaagttttagaacggtaacgaccgaaggtaacgtaacgggacggggggtacgacggtacggtacgttaaccgg

SEQ ID NO: 126521 - DNA, 604 bp, Homo sapiens
  misc_feature: GYAE6OF02GUE8H.12.73.G07.1.454.CMB.1.raw
  modified_base (295)..(295): a, c, t, g, unknown or other
  misc_feature (295)..(295): n is a, c, g, or t
  modified_base (518)..(518): a, c, t, g, unknown or other
  misc_feature (518)..(518): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagcctgggggatccctgagactctcctgtgcagcctctggattcagcttcagtcactatagtatgaacgtgggtccnccagacctccgtaggggaaggggtcgtgggagtgggtctcgtattcatcgagttagtcgtaccaaactaattacaatttacctacgaccgtactcgagtcggaacggggtcccgttacaacctactctaccgagacgaaccaacgaccaatacgactacactagaatctgacaactacgaacgctagacgacgaccggaggacgacggtacaattttttttancttcggtgacggtaaggtaaggtttacgaagggaacgtacaggaaggtaagggggaggggggtacgaggtacgggacggtacgggg

SEQ ID NO: 126522 - DNA, 704 bp, Homo sapiens
  misc_feature: GYAE6OF02GCN5U.12.73.G07.1.454.CMB.1.raw
  modified_base (294)..(294): a, c, t, g, unknown or other
  misc_feature (294)..(294): n is a, c, g, or t
tcagatacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtcgtgggggagcctggtcaagcctgggggatccctgagactctcctgtgcagcctcgtggattcagcttcagtcactatagtatgaactgggtccncagactccgtggggaagggcgtgggagtggtctctacttcatctagtagtcgacccgaaactaagtttaactaacgttttaccgtaaccgtacccgtaaccttcgaaggtaggtaacgggggtcccgtttaccaaccgtacgtacccttacccgaacggtaacgaaccaaccgaacccaaagtacgtaccgtaccaacgtagtaactcgttacgacctaaactaacgaaaacgtccgtacggaaggacggtacccggaggaaccgacggtaacctaatttttacgttcgttcggtacggtacggtaacggttaaacgggttttaaggaacgggtaaaccgaggtaaacggtaagggtaagggggaggggggggtaccggtaagggttacgggtaccgggttaaccggggg

SEQ ID NO: 126523 - DNA, 835 bp, Homo sapiens
  misc_feature: GYAE6OF02GFEG6.12.73.G07.1.454.CMB.1.raw
  modified_base (140)..(140): a, c, t, g, unknown or other
  misc_feature (140)..(140): n is a, c, g, or t
  modified_base (337)..(337): a, c, t, g, unknown or other
  misc_feature (337)..(337): n is a, c, g, or t
tcagatacgacgtacacgaccggtgctcgatttagctctacgctcagggggaggaaaggagccttagccctggattccaaggcctatccacttggtgagcagcactgagcaccgagaattcaccatggactgggctccgntggtcttcctgttgctatttagaagtcgtccagtcgtgaagtcgcgtgttcggtggagtcgtggggacgccgtggtacgaagccgtgggggactccctgagtacctcgtaccgtgtacgacgacggtacctaccgtaggtaactttccgacgtcttcaagtaccaacttataagtacaggtaacgttcgggtacccncaacgtccgtccggtaggggtaacgggcgtacgggacggttgggtacctacacgtttacgacgttcgtaacgttagtaccgaacctaaacgttaaacgtttaccttaacgtttaaccgtaccggtacccgtacgtaacgtaacgggttacggtaaccggggtacccgttttaaccgaaacccctagtttacccgaaccgtaacgggtaaaccgaaacccgtaaacccgaacgtaaacgttaccgaacgtttaccgacgtaacggtaaccttaccgttaaccgaacccgttaaacaaccgtaaaccggtaccgtaacggtaaggaacccggaccggtaaacgtaccggaaaccgtacgtttaaagtttccgttaaccgtggttacgtacggttaacgttaacggtttaacggaacggttaaccgacgtttaaacgggaacggggttaccggggaacgggggttaaccgaacggggttacggtcccggggttaaccgggg

SEQ ID NO: 126524 - DNA, 420 bp, Homo sapiens
  misc_feature: GYAE6OF01ATASO.12.24.C02.1.454.CMB.1.raw
  modified_base (416)..(420): a, c, t, g, unknown or other
  misc_feature (416)..(420): n is a, c, g, or t
tcagatacgacgtacacgaccggtgctcgatttagtacagatcgttagggaagggctggagtggattgggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttcccctggcgccctgctccaggagcacctccgagagcacagcggccctgggctgcctggtcaaggctacttcctacgtcgtatctgagcgggctggcaaggcgcatagnnnnn

SEQ ID NO: 126525 - DNA, 423 bp, Homo sapiens
  misc_feature: GYAE6OF01BQNV3.12.24.C02.1.454.CMB.1.raw
  modified_base (420)..(423): a, c, t, g, unknown or other
  misc_feature (420)..(423): n is a, c, g, or t
tcagatacgacgtacacgaccggtgctcgatttagtacagatcgttagggaaagggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtatctgagcgggctggcaaggcgcatagnnnn

SEQ ID NO: 126526 - DNA, 422 bp, Homo sapiens
  misc_feature: GYAE6OF01EVNSB.12.24.C02.1.454.CMB.1.raw
  modified_base (419)..(422): a, c, t, g, unknown or other
  misc_feature (419)..(422): n is a, c, g, or t
tcagatacgacgtacacgaccggtgctcgatttagtacagatcgttagggaaagggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttcccctggcgccctgctccaggagcacctccgagagcacagcggccctgggctgcctggtcaaggactacttcctacgtcgtatctgagcgggctggcaaggcgcatagnnnn

SEQ ID NO: 126527 - DNA, 420 bp, Homo sapiens
  misc_feature: GYAE6OF01C4KV0.12.24.C02.1.454.CMB.1.raw
  modified_base (417)..(420): a, c, t, g, unknown or other
  misc_feature (417)..(420): n is a, c, g, or t
tcagatacgacgtacacgaccggtgctcgatttagtacagatcgttagggaagggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtctcccctggcgccctgctccaggagcacctccgagagcacagcggccctgggctgcctggtcaaggactacttcctacgtcgtatctgagcgggctggcaaggcgcatagnnnn

SEQ ID NO: 126528 - DNA, 424 bp, Homo sapiens
  misc_feature: GYAE6OF01EEI6E.12.24.C02.1.454.CMB.1.raw
  modified_base (422)..(424): a, c, t, g, unknown or other
  misc_feature (422)..(424): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaaggggacaatggtcatcgtctcttcagcctccaccaagggcccatcggtcttccccctggcgccctgctccaggagcacctccgagagcacagcgtccctgggctgcctggtcaaggactacttcctacgtcgtatctgagcgggctggcaaggcgcatagnnn

SEQ ID NO: 126529 - DNA, 452 bp, Homo sapiens
  misc_feature: GYAE6OF01DBZVU.12.24.C02.1.454.CMB.1.raw
  modified_base (426)..(426): a, c, t, g, unknown or other
  misc_feature (426)..(426): n is a, c, g, or t
  modified_base (433)..(452): a, c, t, g, unknown or other
  misc_feature (433)..(452): n is a, c, g, or t
tcagatacgacgtacacgaccggtgctcgatttagtacagatcgttagggaaaggggcgtgggagtggattggggaaatctatcatagtggtaccaccgtactacagcccgtcactcaacagtcgccgtcaccatatcggtggacgagtccaagaaccagttctccctgagcctgacctctgtgactgccgcggactcggccctatatttctgtgcgagagatcgagatgtgtcatcgcggggctcttttgatatctggggccaaagggacaatggtcatcgtctcttcagcctccaccaagggccccatcggtcttccccctggcgccctgctccaggagcacctccgagagcacagcggccctgggctgcctggtcaaggctaacttcctacgttcgtatcctgagcgggactgggcaagggcncatacgnnnnnnnnnnnnnnnnnnnn

SEQ ID NO: 126530 - DNA, 430 bp, Homo sapiens
  misc_feature: GYAE6OF01BLAKE.12.24.C02.1.454.CMB.1.raw
  modified_base (420)..(430): a, c, t, g, unknown or other
  misc_feature (420)..(430): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcgtggctcttttgatatctggggccaagggacaatggtcatcgtctcttcagcctccaccaagggcccatcggtctcccctggcgccctgctccaggagcacctccgagagcacagccggcctgggctgcctggtcaaggactacttcctacgtcgtatctgagcgggctgggcaaggcgcatagnnnnnnnnnnn

SEQ ID NO: 126531 - DNA, 421 bp, Homo sapiens
  misc_feature: GYAE6OF01BG02T.12.24.C02.1.454.CMB.1.raw
  modified_base (419)..(421): a, c, t, g, unknown or other
  misc_feature (419)..(421): n is a, c, g, or t
tcagatacgacgtacacgaccggtgctcgatttagtacagatcgttagggaaagggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggccgccctgctccaggagcacctccgagagcacagcgccctgggctgcctggtcaaggactactcctacgtcgtatctgagcgggctggcaaggcgcatagnnn

SEQ ID NO: 126532 - DNA, 457 bp, Homo sapiens
  misc_feature: GYAE6OF01CTE9O.12.24.C02.1.454.CMB.1.raw
  modified_base (347)..(347): a, c, t, g, unknown or other
  misc_feature (347)..(347): n is a, c, g, or t
  modified_base (440)..(457): a, c, t, g, unknown or other
  misc_feature (440)..(457): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatcgtggggaccaagggacaatggtcaatcgtctcttcagcctccaccaaggcccatcggtctcccctgcgccctgctccaggacgcaccgtccgagngcacagtccggccctgggctgccgtggtaccaagggacctacttccgtacgtcgtactcgtgaggcgggctggaccgaagggcgacgaatagnnnnnnnnnnnnnnnnnn

SEQ ID NO: 126533 - DNA, 438 bp, Homo sapiens
  misc_feature: GYAE6OF01B44B8.12.24.C02.1.454.CMB.1.raw
  modified_base (431)..(438): a, c, t, g, unknown or other
  misc_feature (431)..(438): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggccccatcggtccttcccccgtggccgccctgcctcccgaggacgccacctccgagacgcacagccggcccgtgggctcgcctggtcaaggcttactcctacgtctatctgagcggctggcaaggcacatagnnnnnnnn

SEQ ID NO: 126534 - DNA, 441 bp, Homo sapiens
  misc_feature: GYAE6OF01DX0II.12.24.C02.1.454.CMB.1.raw
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (421)..(441): a, c, t, g, unknown or other
  misc_feature (421)..(441): n is a, c, g, or t
tcagatacgacgtacacgaccggtgctcgatttagtacagatcgttagggaaaggggctggagtggattaggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtctccccnggcgcctgctccaggngcacctccgagacgcacagcgccctgggctgcctgcaaggactacttcctacgtcgtatctgagcgggntggacaaggcgacatagnannnnnnnnnnnnnnnnnnnnn

SEQ ID NO: 126535 - DNA, 427 bp, Homo sapiens
  misc_feature: GYAE6OF01CUF07.12.24.C02.1.454.CMB.1.raw
  modified_base (413)..(413): a, c, t, g, unknown or other
  misc_feature (413)..(413): n is a, c, g, or t
  modified_base (419)..(427): a, c, t, g, unknown or other
  misc_feature (419)..(427): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctcaccaagggcccatcggtctcccctggccgccctgctccaggagcacctccgagacgcacagcggccctgggctgcctggcaaggactacttcctacgtcgtatctgacgcggctggcaaggcncatagnnnnnnnnn

SEQ ID NO: 126536 - DNA, 423 bp, Homo sapiens
  misc_feature: GYAE6OF01E5GT7.12.24.C02.1.454.CMB.1.raw
  modified_base (419)..(423): a, c, t, g, unknown or other
  misc_feature (419)..(423): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcgtcttcccctggccgccctgctccaggagcacctccgagacgcacagcggccctgggctgcctggtcaaggactattcctacgtcgtatctgagcgggctggcaggcgcatagnnnnn

SEQ ID NO: 126537 - DNA, 424 bp, Homo sapiens
  misc_feature: GYAE6OF01CU726.12.24.C02.1.454.CMB.1.raw
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (421)..(424): a, c, t, g, unknown or other
  misc_feature (421)..(424): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatcgtgggggccaagggacaatggtcatcgtctcttcagcctccaccaagggcccatcggtcttcccctggccgccctgctccaggagcacctccgagacgcacagcggccctgggctgcctggtcaaggactacttccacgtcgtatcngagcgggntggcaaggcnangnnnn

SEQ ID NO: 126538 - DNA, 669 bp, Homo sapiens
  misc_feature: GYAE6OF01APL20.12.24.C02.1.454.CMB.1.raw
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (610)..(610): a, c, t, g, unknown or other
  misc_feature (610)..(610): n is a, c, g, or t
tcagatacgacgtacacgaccggtgctcgatttagtacagatcgttaggaaaggggctgggagtggattcgggaaatctatcgattacgtggtacctacgtacttacagcccgtcactcaacagtcgacgtcaccatatcggtggacgagttccaagaaccagttctcccgttgtagtcctgaccttacgtgtcgactgccgcggactcggccctatatttcgtgtgcgagagatcgagatgtgtcgactcggcggggcttcttttgatatcgtggggccaagggacgaatcggtcatcgtctcttcagcctccaccaagggccccagtcggtccttcccccgtgggccggcccttggccttccgacggtacgtccttaaccgttccgaagaggtccgaacgaacggcccgggtccccgttcggggcccttacggccccgtttcggggttaccgaaaacgggggtacccttaacctttccccgtaacgttacgttccgtaacttacgtaggacggtaccggggtcctacgggaccaacggggtcccgtacgttaacgttaggatacgagcgtacgngcgngacgacgcgcgacgtcgtacgtacgtgtgngagagagtcgtacgacgtacgtacgtacgacgtacgtacgtagtcgtcggtcggtacgg

SEQ ID NO: 126539 - DNA, 460 bp, Homo sapiens
  misc_feature: GYAE6OF01C1IL5.12.24.C02.1.454.CMB.1.raw
  modified_base (449)..(460): a, c, t, g, unknown or other
  misc_feature (449)..(460): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatcgtggggccaagggacaatggcatcgtctcttcagccctcaccaacgggccccatccggtccttccccgtggcccgcctgcctccaggcgccacctccgagacgcacgacgccggcccgtgggcctcgccgtggtacaaaggtaccttacttcctacgtcgtatccgtgacgcgggctgggaccaagggcacagtagnnnnnnnnnnnn

SEQ ID NO: 126540 - DNA, 190 bp, Homo sapiens
  misc_feature: GYAE6OF01DHHMF.12.24.C02.1.454.CMB.1.raw
  modified_base (189)..(190): a, c, t, g, unknown or other
  misc_feature (189)..(190): n is a, c, g, or t
tcagatacgacgtacacgaccggtgctcgatttagtacagatcgttagggaagggctggagtggattggggaaatctatcatagtggtaccacgtactacagcccgtcactcaacagtcgcgtcaccatatcggtggacgagtccaagaaccagttctccctgagcctgacctctgtgctgccgcggann

SEQ ID NO: 126541 - DNA, 438 bp, Homo sapiens
  misc_feature: GYAE6OF01BCEHV.12.24.C02.1.454.CMB.1.raw
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (430)..(438): a, c, t, g, unknown or other
  misc_feature (430)..(438): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcggcggggcttcttttgatatcgtgggggccaagggacaatggtcatcgtctcttcagcctccaccaagggcccatcgtcttccccctggccgccctgctccaggacgccaccgtccgagacgcacgagcggcccgtgggctgcctggtcaaggctacttcctacgtctatctgagcgggntggcaaggcncatacgnnnnnnnnn

SEQ ID NO: 126542 - DNA, 446 bp, Homo sapiens
  misc_feature: GYAE6OF01CI2XD.12.24.C02.1.454.CMB.1.raw
  modified_base (347)..(347): a, c, t, g, unknown or other
  misc_feature (347)..(347): n is a, c, g, or t
  modified_base (431)..(431): a, c, t, g, unknown or other
  misc_feature (431)..(431): n is a, c, g, or t
  modified_base (437)..(446): a, c, t, g, unknown or other
  misc_feature (437)..(446): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcggcgggcttcttttgatatcgtggggaccaagggacaatggtcatcgtctcttcagcctccaccgaacggggccccatccggtccttccccccgtggccgccctgcctccaggnccacctcgagacgcacagccggccctgggctgccgtggtcaaggctacttcctacgtcgtatcgtgagcgggctggcaagggcncatagnnnnnnnnnn

SEQ ID NO: 126543 - DNA, 457 bp, Homo sapiens
  misc_feature: GYAE6OF01CPT9C.12.24.C02.1.454.CMB.1.raw
  modified_base (340)..(340): a, c, t, g, unknown or other
  misc_feature (340)..(340): n is a, c, g, or t
  modified_base (451)..(457): a, c, t, g, unknown or other
  misc_feature (451)..(457): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgaatgccgcggactcggccctatatttctgtgcgagagatcgagatgtgtcatcgcggggcttcttttgatatcgtggggaccaagggacaatggtcatcgtctcttcagcctccacacgggcccatccggtcttcccccgtgccgccctgcctccagganccacctccgagacgccacacggccggcccgtgggcctcgccgtgggtaccgaaaggaccttacctacgtcgttatcgtggaggcggggctgggacaacgggcgactagagnnnnnnn

SEQ ID NO: 126544 - DNA, 428 bp, Homo sapiens
  misc_feature: GYAE6OF01AS5E9.12.24.C02.1.454.CMB.1.raw
  modified_base (421)..(428): a, c, t, g, unknown or other
  misc_feature (421)..(428): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtctccccctggcgccctgctccaggagcacctccgagagcacagcggccctgggctgcctggtcaaggctacttcctacgtcgtatctgagcgggctgggcaagggcgcatagnnnnnnnn

SEQ ID NO: 126545 - DNA, 599 bp, Homo sapiens
  misc_feature: GYAE6OF01DMLVY.12.24.C02.1.454.CMB.1.raw
  modified_base (568)..(599): a, c, t, g, unknown or other
  misc_feature (568)..(599): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaaagaaccagttctccctgagcctgacctctgtgactgccgcggactcggccctatatttctgtgcgagagatcgagatgtgtcatcggcgggcttcttttgatatcgtggggaccaagggacaagtggctaatcgttctcttcacgtcctccaccgaacgggccctacgtccggtccctttccccccgtcgggcccgtccccgtcgccttacccgacgggacgccccaaccccgtccggaagacgccgaaccgacgggtccccggggcccgttcgggggccttccgggcccgttacgggtaaccgtaaacgggttaccctttaacccgttttcccgttacgggtttccgttaacgttccgtgggaacggggtccggggtcgttacggggccgtaaacgggccgtactaacgtaggatgcnnnnnnnnnnnnnnnnnnnnnnnnnnnnnnnn

SEQ ID NO: 126546 - DNA, 526 bp, Homo sapiens
  misc_feature: GYAE6OF01CQVCW.12.24.C02.1.454.CMB.1.raw
  modified_base (302)..(302): a, c, t, g, unknown or other
  misc_feature (302)..(302): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
  modified_base (508)..(526): a, c, t, g, unknown or other
  misc_feature (508)..(526): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaaagaaccagttctccctgagcctgacctctgtgactgccgcggactcggccctatactttctgtgcgagagatcgagatgtgtcagtcggcggggcttcgttttgatatcgtggggaccgaagggaacaagtggtcaacttcgtctcttcgaanccctaccaaccgaaacgggccccaagtttccggttcccttccccccgtggccccgtcccgtcgacctcccgaacggacgaccgtaccgtcccggaagccgaccgaacgacggtcccggaccgtgggctcggcctaggtaccaaaggtacctaccttccgtacgtcgtatcgnggacggcggtcgaggacgaacggccanaagtagnnnnnnnnnnnnnnnnnnn

SEQ ID NO: 126547 - DNA, 517 bp, Homo sapiens
  misc_feature: GYAE6OF01E3RWY.12.24.C02.1.454.CMB.1.raw
  modified_base (507)..(517): a, c, t, g, unknown or other
  misc_feature (507)..(517): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcagtcggcggggtcttcttttgattagtcgtggggccaagggacaagtggtcatcgtctcttcagccctccaccgacgggcccagtccggttcccttcccccgtggcccgtcccgtcgcctccgaggacgccaccccgtcgacgacgaccacgacggcccggcccgtgggcctcgccgtggtaccgaaacggtaccttaccgttccgttaccggttccgttaacgtccgtagggaccgggtcgggtcgtacgggacgtaacgggccgtacaagtaggnnnnnnnnnnn

SEQ ID NO: 126548 - DNA, 526 bp, Homo sapiens
  misc_feature: GYAE6OF01DNXFM.12.24.C02.1.454.CMB.1.raw
  modified_base (353)..(353): a, c, t, g, unknown or other
  misc_feature (353)..(353): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (507)..(526): a, c, t, g, unknown or other
  misc_feature (507)..(526): n is a, c, g, or t
tcagatacgacgtacacgaccggtgctcgatttagtacagatcgttagggaaaggggctggagtggattggggaaatctatcatagtggtaccacgtactacagccccgtcactcaacagtcgcgtcaccatatcggtggacgagtccaaagaaccagttctccctgagcctgacctctgtgactgccgcggactcggccctatatttctgtgcgagagatcgagatgtgtcatcggcggggcttcttttgattactcgtcggggaccgaagggacaaagtgggtcaattcgtcctcttcgacgtccctcccaaccgaacggggccccacgttccggttccctttccccccgnggcccgccctgccctccgaggcgccaccgtccgacgagccaacgacgcccggcccgtgggcctcgcccgttggtacaacggtactttaccttccgtacgttcgtaacgtcgtaggacggtcgggtctacgggcgaacgggcncgaataggntgnnnnnnnnnnnnnnnnnnnn

SEQ ID NO: 126549 - DNA, 510 bp, Homo sapiens
  misc_feature: GYAE6OF01A6D8I.12.24.C02.1.454.CMB.1.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
  modified_base (470)..(471): a, c, t, g, unknown or other
  misc_feature (470)..(471): n is a, c, g, or t
  modified_base (475)..(477): a, c, t, g, unknown or other
  misc_feature (475)..(477): n is a, c, g, or t
  modified_base (483)..(483): a, c, t, g, unknown or other
  misc_feature (483)..(483): n is a, c, g, or t
  modified_base (486)..(510): a, c, t, g, unknown or other
  misc_feature (486)..(510): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgnggactcggccctatatttcngtgcgagagatcgagatgtgtcatcgcggggctcttttgatatcgtggggccaagggacaatggtcatcgtctcttnagcctccaccaacgggcccatccggtccttcccccnggccgccctgctccgagganccacctccgagacgctacgacggccggcccgngggctcgcctgggtaccaagggtaccttacgttcccgtacggtccgtaagtcttaggacggcggggtacttgggaccgtaagggccacgataggccnnagcnnncagctncgnnnnnnnnnnnnnnnnnnnnnnnnn

SEQ ID NO: 126550 - DNA, 465 bp, Homo sapiens
  misc_feature: GYAE6OF01CADRG.12.24.C02.1.454.CMB.1.raw
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (453)..(465): a, c, t, g, unknown or other
  misc_feature (453)..(465): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatattctgtgcgagagatcgagatgtgtcatcggcgggcttcttttgatatcggtgggaccgaagggacaagtgtcatcgtctcttcacgcctccacgaacggcccatccgtcctccccgtcgcccgtcctcgcctccgacggacgcctaccgtccgagacgcgacgacggcccggccgtggcctcgtccgtcggtacgaacgtcttacctccgtacgtctntcgcgacggtcgctcggacacggcancgngnnnnnnnnnnnnn

SEQ ID NO: 126551 - DNA, 539 bp, Homo sapiens
  misc_feature: GYAE6OF01CF0WG.12.24.C02.1.454.CMB.1.raw
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (504)..(504): a, c, t, g, unknown or other
  misc_feature (504)..(504): n is a, c, g, or t
  modified_base (507)..(539): a, c, t, g, unknown or other
  misc_feature (507)..(539): n is a, c, g, or t
tcagatacgacgtacacgaccggtgctcgatttagtacagatcgttagggaaaggggctggagtggattgggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcagtcggcggggtcttcgttttgattacgtcgtcgggggaccaaaggggacaagttggtactattccgtcttcttcacgtccctacccacgaacgggtcccagttcccggttccttcccccgnggcccnccctgccctcgaggcnccaccgtcgagagccagcgccggcccgtgggctcgcgtcggtacgaacggtaccttaccgttccgtacggttcgtagtccggtaggacgggtccgggtcgtacgggacgaacgggtccgatagtacggngtnnnnnnnnnnnnnnnnnnnnnnnnnnnnnnnnn

SEQ ID NO: 126552 - DNA, 593 bp, Homo sapiens
  misc_feature: GYAE6OF01CMKUQ.12.24.C02.1.454.CMB.1.raw
  modified_base (259)..(259): a, c, t, g, unknown or other
  misc_feature (259)..(259): n is a, c, g, or t
  modified_base (303)..(303): a, c, t, g, unknown or other
  misc_feature (303)..(303): n is a, c, g, or t
  modified_base (417)..(417): a, c, t, g, unknown or other
  misc_feature (417)..(417): n is a, c, g, or t
  modified_base (556)..(556): a, c, t, g, unknown or other
  misc_feature (556)..(556): n is a, c, g, or t
  modified_base (562)..(567): a, c, t, g, unknown or other
  misc_feature (562)..(567): n is a, c, g, or t
  modified_base (569)..(593): a, c, t, g, unknown or other
  misc_feature (569)..(593): n is a, c, g, or t
tcagatacgacgtacacgaccggtgctcgatttagtacagatcgttagggaaagggggctggagtggattggggaaatctatcatagtggtaccacgtactacagcccgtcactcaacagtcgcgtcaccatatcgggtggacgagtccaaagaaccagttcctccctgagcctgaccctctgtgactgccgcggactccggaccctagttactttctgtggcgaagagatcggatacgtgtgtacagtcggcggggtnttcttttgattacgtcggtggggaccaaagggactaagttggtnaacgttcgttcttaccttcgaagtcccctaccaaccggaaccgggtacccctacgttccggttaccccttcccccggtggaccccgtccgttcgcccgttacgaacggggaccncccgaaccgtaccggaagacgaccacgacgggcccggtacgcggacgtcgaccgttggaacgaacgttaccgttactacgaccggtttcgataccgtaggacgggcgggtccgaggacgaacggcgtacaagtagcganagcagnnnnnnannnnnnnnnnnnnnnnnnnnnnnnn

SEQ ID NO: 126553 - DNA, 470 bp, Homo sapiens
  misc_feature: GYAE6OF01BEBTF.12.24.C02.1.454.CMB.1.raw
  modified_base (159)..(159): a, c, t, g, unknown or other
  misc_feature (159)..(159): n is a, c, g, or t
  modified_base (421)..(421): a, c, t, g, unknown or other
  misc_feature (421)..(421): n is a, c, g, or t
  modified_base (455)..(470): a, c, t, g, unknown or other
  misc_feature (455)..(470): n is a, c, g, or t
tcagatacgacgtacacgaccggtgctcgatttagtacagatcgttagggaaagggctggagtggattggggaaatctatcatagtggtaccacgtactacagcccgtcactcaacagtcgcgtcaccatatcggtggacgagtccaagaaccagttcnccctgagcctgacctctgtgactgccgcggactcggccctatatttctgtgcgagagatcgagatgtgtccatcgcggggctcttttgatatctggggccaagggacaatggtcaatcgtctcttcagcctccaccaacggcccctatccggtcttcccccctggccgccctcgctacccgaggacgccaacctccggacgacggcaccgagccgggcccctggggctgccctgggtccagggactcttcctaccgtgtacncgtgagtcgggcttgggcaacgggtcgcatacgnnnnnnnnnnnnnnnn

SEQ ID NO: 126554 - DNA, 597 bp, Homo sapiens
  misc_feature: GYAE6OF01DGLR2.12.24.C02.1.454.CMB.1.raw
  modified_base (231)..(231): a, c, t, g, unknown or other
  misc_feature (231)..(231): n is a, c, g, or t
  modified_base (562)..(562): a, c, t, g, unknown or other
  misc_feature (562)..(562): n is a, c, g, or t
  modified_base (569)..(597): a, c, t, g, unknown or other
  misc_feature (569)..(597): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgaccctctgtgactgccgcggactcggccctatatttctgtgcgagagatcgagatgtgtnagtcggcggggtcttctttttgattactcgttggggacccgaaaggggacaaagttggactaatcggttcctcttcaacggtccctacccgaaccgaaccgggccccgtaacgttccccgggttcccttcccccccgttgggccccgtccccgtcgtacccgttacccgaagggacgtccccaaccgttaccggaaggacacgaactacggcccggccgttccgggacgtccgccgttacggtacgaaacgtccgttaacctttccgtaccgttaccgtagttccgtagggaccgcgggtgtacgggacgtaacgggaccagtaacgtgancgatcgnnnnnnnnnnnnnnnnnnnnnnnnnnnnn

SEQ ID NO: 126555 - DNA, 759 bp, Homo sapiens
  misc_feature: GYAE6OF01EMTTQ.12.24.C02.1.454.CMB.1.raw
  modified_base (453)..(453): a, c, t, g, unknown or other
  misc_feature (453)..(453): n is a, c, g, or t
  modified_base (666)..(666): a, c, t, g, unknown or other
  misc_feature (666)..(666): n is a, c, g, or t
  modified_base (678)..(678): a, c, t, g, unknown or other
  misc_feature (678)..(678): n is a, c, g, or t
  modified_base (685)..(685): a, c, t, g, unknown or other
  misc_feature (685)..(685): n is a, c, g, or t
  modified_base (692)..(692): a, c, t, g, unknown or other
  misc_feature (692)..(692): n is a, c, g, or t
  modified_base (697)..(697): a, c, t, g, unknown or other
  misc_feature (697)..(697): n is a, c, g, or t
  modified_base (701)..(701): a, c, t, g, unknown or other
  misc_feature (701)..(701): n is a, c, g, or t
  modified_base (735)..(735): a, c, t, g, unknown or other
  misc_feature (735)..(735): n is a, c, g, or t
  modified_base (747)..(747): a, c, t, g, unknown or other
  misc_feature (747)..(747): n is a, c, g, or t
  modified_base (753)..(753): a, c, t, g, unknown or other
  misc_feature (753)..(753): n is a, c, g, or t
tcagatacgacgtacacgaccggtgctcgatttagtacagatcgttagggaaagggctggagtggattggggaaatctatcatagtggtaccacgtactacagcccgtcactcaacagtcgcgtcaccatactcggtaggacgacgtaccaaagaacctagttcctccctagacgcctcgacctctgcgtactcgccggcggtacgtccggaccttaagttcttcgtggtacgacggtaacgaagtagttacggaagtacgtttacggtacgtacgtacggtaccggggtccggggttctttttacttttacgggaactttacgggttaccgggacggggaaaccgtaaaacggtaaccgtaaggttcggtacctacgttccgttccttactacgaccgtacccgacccgaaacgggtaaccgcccttacggttcccgttacccgtttccccncggtacccggccttccgaaccgtaccgaggaccgtacccaacggttaccgagaccgaacgaccggacgggtacccggtccgtacggtcccgtacgacggttaacgaaccgtaaacccgttaccgtttaacccgttccgtaacggttacgttacgttacgggttacgacgggtacgtacgggtacgtaacggaacgtacgaacgtacgtactanacgacagtaccngcacggntactganacgtnacgngactacgacttcgaaagtcgacgtacgactagtnaccatcgtaagnacgtanacgtca

SEQ ID NO: 126556 - DNA, 475 bp, Homo sapiens
  misc_feature: GYAE6OF01EWMTW.12.24.C02.1.454.CMB.1.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (349)..(350): a, c, t, g, unknown or other
  misc_feature (349)..(350): n is a, c, g, or t
  modified_base (363)..(363): a, c, t, g, unknown or other
  misc_feature (363)..(363): n is a, c, g, or t
  modified_base (443)..(443): a, c, t, g, unknown or other
  misc_feature (443)..(443): n is a, c, g, or t
  modified_base (445)..(475): a, c, t, g, unknown or other
  misc_feature (445)..(475): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccctagttctccctgagcctgacctctgtgactgccgcggactccggccctatatttctgtgcgagagatcgganatgtgtcatcggcgggcttctttgatatcgtggggacctaagggacaatggcatcgtctctnagcctccaccaaggccatccggtccttcccgnggccnccctgctcacggngctaccncgnngcacgtgcgccgnggctggcctggtacaacggtctacctctacgtcgttatcgtcgacggcgggacctgggagaacgggcctagagttaacgnannnnnnnnnnnnnnnnnnnnnnnnnnnnnnn

SEQ ID NO: 126557 - DNA, 669 bp, Homo sapiens
  misc_feature: GYAE6OF01C8JC8.12.24.C02.1.454.CMB.1.raw
  modified_base (119)..(119): a, c, t, g, unknown or other
  misc_feature (119)..(119): n is a, c, g, or t
  modified_base (264)..(264): a, c, t, g, unknown or other
  misc_feature (264)..(264): n is a, c, g, or t
  modified_base (594)..(594): a, c, t, g, unknown or other
  misc_feature (594)..(594): n is a, c, g, or t
  modified_base (628)..(628): a, c, t, g, unknown or other
  misc_feature (628)..(628): n is a, c, g, or t
  modified_base (637)..(637): a, c, t, g, unknown or other
  misc_feature (637)..(637): n is a, c, g, or t
  modified_base (640)..(669): a, c, t, g, unknown or other
  misc_feature (640)..(669): n is a, c, g, or t
tcagatacgacgtacacgaccggtgctcgatttagtacagatcgttagggaaaggggctggagtggattggggaaatctatcatagtggtaccacgttactacagcccgtcactcaacngtcgcgtcaccatatcgggtggacagtccaaacgaaccctagttcctccctgacgcctcgacctcgtgtgactcgccggcggtaccgtccggcccttatttacctttctaggtcgacggaaggtagagtaggaaatagttggttntaacccggtagtcccggggtccggggttccttttaggtttttacgaacgttcggttacgggtaccgggggtaaaccgaaacgggtaacctaaggtttcgggactttaccggttcccgtttctttacccgtttacccgaaccgtcccccgtaaacggaaccccggggtaaccggtaccccttacggtttcccccggttcccctttcccccggcgggtcccccttaccggcctaccgccggaacggtaccggtacccctaaccgcgaaacgtcgaccgccggacgtccggccgttacggctcgtacggtacaccgtacgtactccggttacngttctacctggaccgtggaacgtcgacggtaacncggatagtncgnnnnnnnnnnnnnnnnnnnnnnnnnnnnnn

SEQ ID NO: 126558 - DNA, 424 bp, Homo sapiens
  misc_feature: GYAE6OF02IF98W.12.24.C02.1.454.CMB.1.raw
  modified_base (421)..(424): a, c, t, g, unknown or other
  misc_feature (421)..(424): n is a, c, g, or t
tcagatacgacgtacacgaccggtgctcgatttagtacagatcgttagggaaagggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggccccatcggtcttccccctggcgccctgctccaggagcacctccgagagcacagcggccctgggctgcctggtcaaggactacttcctacgtcgtatctgagcgggctggcaaggcgcatagnnnn

SEQ ID NO: 126559 - DNA, 506 bp, Homo sapiens
  misc_feature: GYAE6OF02HNU4E.12.24.C02.1.454.CMB.1.raw
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (392)..(392): a, c, t, g, unknown or other
  misc_feature (392)..(392): n is a, c, g, or t
  modified_base (486)..(486): a, c, t, g, unknown or other
  misc_feature (486)..(486): n is a, c, g, or t
  modified_base (488)..(506): a, c, t, g, unknown or other
  misc_feature (488)..(506): n is a, c, g, or t
tcagatacgacgtacacgaccggtgctcgatttagtacagatcgttagggaaaggggacgtggagcggattggggaaagtctatcatagtggtaccacgtactacagcccgtcactcaacagtcgcgtcaccatatcggtggacggagtccaagaaccagttctccctgagcctgacctctgtgactgccgcggactcggccctatatttctgtgcgagagatcgagatgtgtcatcgcggggctcttttgatatctgggggccaagggacaatgggtcatcgtctntttcgagcctccaacggaacggcccagttcggttcccttcccccggnggcctccngtcctacgaggcncctacccgtcggagcgaccacgacggcccggtccggngggctcgccgttacggaacgaaacggtaccttaccttccgttacggtcgttactcgtacggcgggccgggcgtcggacgaacgggcactagtgngnnnnnnnnnnnnnnnnnnn

SEQ ID NO: 126560 - DNA, 422 bp, Homo sapiens
  misc_feature: GYAE6OF02F2ZP7.12.24.C02.1.454.CMB.1.raw
  modified_base (421)..(422): a, c, t, g, unknown or other
  misc_feature (421)..(422): n is a, c, g, or t
tcagatacgacgtacacgaccggtgctcgatttagtacagatcgttagggaaagggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaaggggacaatggtcatcgtctcttcagcctccaccaagggccccatcggtcttccccctggcgccctgctccaggagcacctccgagagcacagcggccctgggctgcctggtcaaggctacttcctacgtcgtatctgagcgggctggcaaggcgcatagnn

SEQ ID NO: 126561 - DNA, 505 bp, Homo sapiens
  misc_feature: GYAE6OF02HO6XZ.12.24.C02.1.454.CMB.1.raw
  modified_base (493)..(505): a, c, t, g, unknown or other
  misc_feature (493)..(505): n is a, c, g, or t
tcagatacgacgtacacgaccggtgctcgatttagtacagatcgttagggaaaggggctggagcggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcgacgtcctaccaaccggaacggacccacgtccggttccccttcccccgtcggcccgtccccgtcgccctaccgaaggacgcctacccgtccggagacgaccacgacggccggcccgtgggctcgccgtcggtacgaaacggtaccttacctttaccgtaccgttcgtactcgtaggacggcgggtcgtggacgaaggccgactagtagnnnnnnnnnnnnn

SEQ ID NO: 126562 - DNA, 426 bp, Homo sapiens
  misc_feature: GYAE6OF02I0GPW.12.24.C02.1.454.CMB.1.raw
  modified_base (420)..(426): a, c, t, g, unknown or other
  misc_feature (420)..(426): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctctttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtatctgagcgggctggcaaggcgcatagnnnnnnn

SEQ ID NO: 126563 - DNA, 427 bp, Homo sapiens
  misc_feature: GYAE6OF02HOFY5.12.24.C02.1.454.CMB.1.raw
  modified_base (417)..(417): a, c, t, g, unknown or other
  misc_feature (417)..(417): n is a, c, g, or t
  modified_base (423)..(427): a, c, t, g, unknown or other
  misc_feature (423)..(427): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtatcctgagcgggctggcaagggcncatagnnnnn

SEQ ID NO: 126564 - DNA, 424 bp, Homo sapiens
  misc_feature: GYAE6OF02HSBQ3.12.24.C02.1.454.CMB.1.raw
  modified_base (422)..(424): a, c, t, g, unknown or other
  misc_feature (422)..(424): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcctcagcctccaccaagggcccatcggtcttccccctggcaccctcctccaagagcacctctgggggcacgagcggccctgggctgcctggtcaaggactacttcctacgtcgtatctgagcgggctggcaaggcgcatagnnn

SEQ ID NO: 126565 - DNA, 426 bp, Homo sapiens
  misc_feature: GYAE6OF02GDFGY.12.24.C02.1.454.CMB.1.raw
  modified_base (415)..(415): a, c, t, g, unknown or other
  misc_feature (415)..(415): n is a, c, g, or t
  modified_base (421)..(426): a, c, t, g, unknown or other
  misc_feature (421)..(426): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtatctgagcgggctggcaaggcncatagnnnnnn

SEQ ID NO: 126566 - DNA, 428 bp, Homo sapiens
  misc_feature: GYAE6OF02FZWDT.12.24.C02.1.454.CMB.1.raw
  modified_base (335)..(335): a, c, t, g, unknown or other
  misc_feature (335)..(335): n is a, c, g, or t
  modified_base (422)..(428): a, c, t, g, unknown or other
  misc_feature (422)..(428): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaaggggacaatggtcatcgtctcttcagcctccaccaagggcccatcggtcttccccctggcgccctgctccaggngcacctccgagagcacagcggccctgggctgcctggtcaaggactacttcctacgtcgtatctgagcgggctggcaaggcgcatagnnnnnnn

SEQ ID NO: 126567 - DNA, 428 bp, Homo sapiens
  misc_feature: GYAE6OF02F2B17.12.24.C02.1.454.CMB.1.raw
  modified_base (422)..(428): a, c, t, g, unknown or other
  misc_feature (422)..(428): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggccccatcggtcttccccctggcgccctgctccaggagcacctccgagagcacagcggccctgggctgcctggtcaaggactacttcctacgtcgtatctgagcgggctggcaaggcgcatagnnnnnnn

SEQ ID NO: 126568 - DNA, 474 bp, Homo sapiens
  misc_feature: GYAE6OF02G7C2H.12.24.C02.1.454.CMB.1.raw
  modified_base (459)..(474): a, c, t, g, unknown or other
  misc_feature (459)..(474): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaagtggtcatcgtctcttcacgcctccaccgaacgggcccagtccggtccttcccccgtggccgcccctgcctccgaggcgccacccgtccgagcgcacgagccggccgtgggctcgccgtggtacaaaggtacctaccgttccgtacgttcgtatcgtggacggccgggctgggacgaaggccgacagtagnnnnnnnnnnnnnnnn

SEQ ID NO: 126569 - DNA, 427 bp, Homo sapiens
  misc_feature: GYAE6OF02IU7OT.12.24.C02.1.454.CMB.1.raw
  modified_base (421)..(427): a, c, t, g, unknown or other
  misc_feature (421)..(427): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtatctgagcgggctggcaaggcgcatagnnnnnnn

SEQ ID NO: 126570 - DNA, 426 bp, Homo sapiens
  misc_feature: GYAE6OF02GR9AZ.12.24.C02.1.454.CMB.1.raw
  modified_base (345)..(345): a, c, t, g, unknown or other
  misc_feature (345)..(345): n is a, c, g, or t
  modified_base (418)..(426): a, c, t, g, unknown or other
  misc_feature (418)..(426): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccagggcccatcggtcttccccctggcgccctgctccaggagcacctccgagngcacagcgccctgggctgcctggtcaaggctacttcctacgtcgtatctgagcgggctggcaaggcgcatagnnnnnnnnn

SEQ ID NO: 126571 - DNA, 430 bp, Homo sapiens
  misc_feature: GYAE6OF02IYWCD.12.24.C02.1.454.CMB.1.raw
  modified_base (415)..(415): a, c, t, g, unknown or other
  misc_feature (415)..(415): n is a, c, g, or t
  modified_base (420)..(430): a, c, t, g, unknown or other
  misc_feature (420)..(430): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggcaatggtcatcgtctcttcagcctccaccaagggcccatcggtcttccccctggcgccctgctccaggagcacctcccgagacgcacagcggccctgggctgcctggtcaaggctacttcctacgtcgtatctgagcgggctggcaaggcncatgnnnnnnnnnnn

SEQ ID NO: 126572 - DNA, 423 bp, Homo sapiens
  misc_feature: GYAE6OF02GXVRF.12.24.C02.1.454.CMB.1.raw
  modified_base (335)..(335): a, c, t, g, unknown or other
  misc_feature (335)..(335): n is a, c, g, or t
  modified_base (420)..(423): a, c, t, g, unknown or other
  misc_feature (420)..(423): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggccgccctgctccaggngcacctccgagacgcacagcggccctgggctgcctggtcaggactactcctacgtcgtatctgagcgggctggcaggcgcatagnnnn

SEQ ID NO: 126573 - DNA, 499 bp, Homo sapiens
  misc_feature: GYAE6OF02JMPCV.12.24.C02.1.454.CMB.1.raw
  modified_base (234)..(234): a, c, t, g, unknown or other
  misc_feature (234)..(234): n is a, c, g, or t
  modified_base (262)..(263): a, c, t, g, unknown or other
  misc_feature (262)..(263): n is a, c, g, or t
  modified_base (268)..(269): a, c, t, g, unknown or other
  misc_feature (268)..(269): n is a, c, g, or t
  modified_base (475)..(499): a, c, t, g, unknown or other
  misc_feature (475)..(499): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatattctgtgcgagagatcgagatgtgtcaatcncgggggctctttttgatagtcttggggnngagannagtgtctatcgtctctcacgcctaccgaccgaacggaccgtacgtccgttccttccccgtcggccgccctcgccgtacgacggacgccacctaccgacgacgacgacgacggccggccgtcggccgtcgtccgtacggtacgaacgtactacttaccgtacgtcgtactcgtcgacggcggcgtacggacgacggacgacgatagnnnnnnnnnnnnnnnnnnnnnnnnn

SEQ ID NO: 126574 - DNA, 426 bp, Homo sapiens
  misc_feature: GYAE6OF02FX7KN.12.24.C02.1.454.CMB.1.raw
  modified_base (417)..(417): a, c, t, g, unknown or other
  misc_feature (417)..(417): n is a, c, g, or t
  modified_base (423)..(426): a, c, t, g, unknown or other
  misc_feature (423)..(426): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggacgcacctccgagagcacagcggccctgggctgcctggtcaaggactacttcctacgtcgtatctgagcgggctggcaagggcncatagnnnn

SEQ ID NO: 126575 - DNA, 416 bp, Homo sapiens
  misc_feature: GYAE6OF02IAL8C.12.24.C02.1.454.CMB.1.raw
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (408)..(408): a, c, t, g, unknown or other
  misc_feature (408)..(408): n is a, c, g, or t
  modified_base (412)..(416): a, c, t, g, unknown or other
  misc_feature (412)..(416): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctcaccaggcccatcggtcttcccctgcgccctgcctccaggncaccncgagagcacgagccggcctgggctgcctggtacaaggctacttctacgtctatctgagcgggctggcaggcgnatgnnnnn

SEQ ID NO: 126576 - DNA, 439 bp, Homo sapiens
  misc_feature: GYAE6OF02G256N.12.24.C02.1.454.CMB.1.raw
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (434)..(439): a, c, t, g, unknown or other
  misc_feature (434)..(439): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccgaacgggcccagtcggtccttcccccgtggccgccctgcctccaggacgccaccgtccgagacgcacaggccggcccgtgggctgccgtggtcaaggactacttcctacgtcgtatctgacgcggntggnaggcncatgnnnnnn

SEQ ID NO: 126577 - DNA, 430 bp, Homo sapiens
  misc_feature: GYAE6OF02FN89V.12.24.C02.1.454.CMB.1.raw
  modified_base (423)..(430): a, c, t, g, unknown or other
  misc_feature (423)..(430): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctgggggccaagggacaatggtcatcgtctcttcagcctccaccaagggcccatcggtcttccccctggccgccctgctccaggagcacctccgagagcatagcggccctgggctgcctggtcaaggactacttcctacgtcgtatctgagcgggctggcaaggcgcatagnnnnnnnn

SEQ ID NO: 126578 - DNA, 530 bp, Homo sapiens
  misc_feature: GYAE6OF02JXCIU.12.24.C02.1.454.CMB.1.raw
  modified_base (220)..(220): a, c, t, g, unknown or other
  misc_feature (220)..(220): n is a, c, g, or t
  modified_base (514)..(515): a, c, t, g, unknown or other
  misc_feature (514)..(515): n is a, c, g, or t
  modified_base (518)..(530): a, c, t, g, unknown or other
  misc_feature (518)..(530): n is a, c, g, or t
tcagatacgacgtacacgaccggtgctcgatttagtacagatcgttagggaaaggggcgtggaggtggagttgggggaaagtctatcatagtggtacacgtactacagcccgtcactcaacagtcgcgtcaccatatcggtggacgagtccaagaaccagttctccctgagcctgacctctgtgactgccgcggactcggccctatatttctgtgcgagngatcgagatgtgtcatcgcggggctcttttagatatcgtggggccaagggacaagtgggtccagtcgtccgtcttcgagtccttaccaccgaaacggggccccaacgttccgggttcccttccccccgtgggtcccggccccttcggccttaccccgagggaccggcctaacccgtcccgagacgtccaaccgacggccggtcccgtggggcctcggccgtggtaacaacgggaccttacgtcctacggtccgtaatcccgtgacggcgggctcgggcaacgggcgccatcggnnatnnnnnnnnnnnnn

SEQ ID NO: 126579 - DNA, 457 bp, Homo sapiens
  misc_feature: GYAE6OF02I6QUR.12.24.C02.1.454.CMB.1.raw
  modified_base (447)..(457): a, c, t, g, unknown or other
  misc_feature (447)..(457): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatcgtggggccaagggacaatggtcatcgtctcttcagcctccaccaacgggcccatcggtcttcccccctggccgccctgcctccgaggagcaccctccgagagccacacggccggccctggggctgcccgtgggtcaaaggtacctaccttccgtacgtcgtactctgacggcggcgtggcgaaggcgacagtagnnnnnnnnnnn

SEQ ID NO: 126580 - DNA, 547 bp, Homo sapiens
  misc_feature: GYAE6OF02JOQQW.12.24.C02.1.454.CMB.1.raw
  modified_base (295)..(295): a, c, t, g, unknown or other
  misc_feature (295)..(295): n is a, c, g, or t
  modified_base (518)..(518): a, c, t, g, unknown or other
  misc_feature (518)..(518): n is a, c, g, or t
  modified_base (521)..(525): a, c, t, g, unknown or other
  misc_feature (521)..(525): n is a, c, g, or t
  modified_base (527)..(547): a, c, t, g, unknown or other
  misc_feature (527)..(547): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggcccctatatttctgtgcgagagatcgagatgtgtcatcggcggggtctcttttgatagtcgtggggcccaaggggacaaagtggtacattcgtctcttnagccctccaccgaacgggcccagttccggtacccttcccccgtggcccgtcccgtcgcctccgtacggaccggtaccaccccgttaccgacgtaccgaccgacccgtacggcccggcccgtcggggcctccggtccgtcggtacgaacggaccttacccgttacctacgtccggttatccgtagacggtccgggcgtacggacgacggtcggactagtaacgncgnnnnngnnnnnnnnnnnnnnnnnnnnn

SEQ ID NO: 126581 - DNA, 476 bp, Homo sapiens
  misc_feature: GYAE6OF02FZX36.12.24.C02.1.454.CMB.1.raw
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
  modified_base (452)..(476): a, c, t, g, unknown or other
  misc_feature (452)..(476): n is a, c, g, or t
tcagatacgacgtacacgaccggtgctcgatttagtacagatcgttagggaaagggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggcttcttttgattatcgtgggggaccaaggggacaatggtcatcgttctcttcagcctccaccaagggcccatcggtcttccccctggccnccctgcctccaggcncacctccgagacncacgagccggcccgtgggctcgccgtggtcgaacggacttaccttccgtacgtcgtactcgtcgaggcgggctgggctaacgggcacgataggnnnnnnnnnnnnnnnnnnnnnnnnn

SEQ ID NO: 126582 - DNA, 472 bp, Homo sapiens
  misc_feature: GYAE6OF02G0YI4.12.24.C02.1.454.CMB.1.raw
  modified_base (347)..(347): a, c, t, g, unknown or other
  misc_feature (347)..(347): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
  modified_base (439)..(442): a, c, t, g, unknown or other
  misc_feature (439)..(442): n is a, c, g, or t
  modified_base (444)..(445): a, c, t, g, unknown or other
  misc_feature (444)..(445): n is a, c, g, or t
  modified_base (447)..(472): a, c, t, g, unknown or other
  misc_feature (447)..(472): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctctttgatatctggggccaagggacaatggtcatcgtctcttcagcctccacaagggcccagtccggtcttccccctggcgccctgcctccaggtgccacctcgagngcacagcggcctgggctgccgtggtcaaggactacgttcctacgtcgtanctggacggcgggctgggcaacggccgtacataggcngancgnnnngnncnnnnnnnnnnnnnnnnnnnnnnnnnn

SEQ ID NO: 126583 - DNA, 559 bp, Homo sapiens
  misc_feature: GYAE6OF02HJ6XN.12.24.C02.1.454.CMB.1.raw
  modified_base (526)..(559): a, c, t, g, unknown or other
  misc_feature (526)..(559): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcggcgggcttcttttgatatcgtggggccaagggacaatggtcatcgtctcttcagcctccacccaacggggccccaagtccggttccctttccccccgtgggcccgccccgttcgccctcccgaagggcgcccaaccctcccggaagacgccaacgacggccggccccttggggcctcggccgttcgggtcgaaacgggtaccttaaccgtttcccgtaacggttccgttaacgttccgtaggtacggccggggtcgtacggggcgaaacgggtccggacgaacgttaacggnnnnnnnnnnnnnnnnnnnnnnnnnnnnnnnnnn

SEQ ID NO: 126584 - DNA, 490 bp, Homo sapiens
  misc_feature: GYAE6OF02IDH63.12.24.C02.1.454.CMB.1.raw
  modified_base (252)..(252): a, c, t, g, unknown or other
  misc_feature (252)..(252): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (466)..(490): a, c, t, g, unknown or other
  misc_feature (466)..(490): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtgacgagtccaagaaccagttcctccctgagcctgacctctgtgactcgccgcggactcggccctatactttctgtgcgagagatcggagtatgtcgtcagttcgggcgggtcttnttttgattagtcgtcggggaccaagggacaagtcggtacagtcgtctctttcacgtccctccaccgaacggcccagttccgttcccttccccgnggcccacctncctccgacggctccnccgtacgangcacgngccggcgtcggcncgctcgganacgcttacctccgtacgtcgtactgacgtcggcggtcgtgacgaggtcgataagacgnnnnnnnnnnnnnnnnnnnnnnnnn

SEQ ID NO: 126585 - DNA, 554 bp, Homo sapiens
  misc_feature: GYAE6OF02FX7ZQ.12.24.C02.1.454.CMB.1.raw
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (510)..(510): a, c, t, g, unknown or other
  misc_feature (510)..(510): n is a, c, g, or t
  modified_base (528)..(528): a, c, t, g, unknown or other
  misc_feature (528)..(528): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggcctaagggacaatggtcatcgtctcttcagcctccaccaagggcccatcggtcttcccctggcgccctgctccaggagccacctcgagacgccacagccgggccctggggctcggcctagggtcaaacgggtacctacgttaccctacgttcgtaactcgtacgtacggccgggacttcgggacaaacgggccgtaccaacgttacgagntcgancntacgcacgtntacgagtcgntagcgtactcgagtcncgtcgagtctagcctacncgacgtcgacgtcgcgtcncgtntcg

SEQ ID NO: 126586 - DNA, 511 bp, Homo sapiens
  misc_feature: GYAE6OF02ISGI3.12.24.C02.1.454.CMB.1.raw
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
  modified_base (474)..(474): a, c, t, g, unknown or other
  misc_feature (474)..(474): n is a, c, g, or t
  modified_base (482)..(511): a, c, t, g, unknown or other
  misc_feature (482)..(511): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcgactcggccctattatttctgtgcgagagatcgagatgtcgtcatcgcggggcttcttttagatatcgtcggggaccaagggaccaagtggtccaagttcgtacttcttnacggccctaccaaccgaaacggggcccagttccggtccttccccgnggccnccctggcctcgaggcncacctcgagacgcacgacgcggacctgggctgccttgacaacggtactacgttacctaacggtcgtaactcgttaggcgacgggctcggacgacggccgatacgtagcntagcagtnnnnnnnnnnnnnnnnnnnnnnnnnnnnnn

SEQ ID NO: 126587 - DNA, 710 bp, Homo sapiens
  misc_feature: GYAE6OF02IAIFQ.12.24.C02.1.454.CMB.1.raw
  modified_base (124)..(124): a, c, t, g, unknown or other
  misc_feature (124)..(124): n is a, c, g, or t
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (402)..(402): a, c, t, g, unknown or other
  misc_feature (402)..(402): n is a, c, g, or t
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
  modified_base (617)..(617): a, c, t, g, unknown or other
  misc_feature (617)..(617): n is a, c, g, or t
  modified_base (624)..(624): a, c, t, g, unknown or other
  misc_feature (624)..(624): n is a, c, g, or t
tcagatacgacgtacacgaccggtgctcgatttagtacagatcgttagggaaaggggcgtggagtggattggggaaatctatcatagtggtaccacgtactacagcccgtcactcaacgagtcncgtcaccatatcggtggacgtagtccaacgaaccagttcctccctgagtcctcgacctctgtgactcgcgcgacgtccgcctattactttcgngtcggcgagagtactcggagactgtcgtcgaacgtcgggacgggtcctttnttttaggactttacgtcggtacggggaaccaagggtaactaacgggtgtactacgtcggtccttcgttcgaccgtcccttaccgaacccggaaacgggcccccgttacgttccccggtttaccccttccccggnggtccccgtcccgtacgtccgttccgaacggctacccctacccggtagtacgaccgactacggccgacccgggtcccgtagggtctccgggtaccgtcggtaaacctaaaccgggttccttaaccggttccgttacgttaccgtttacgctttcgggaaccgggtccggttactggaccggaaggcctacgtaagcgtcgcncgtacngtcgtanctacgcncgacgcgtctacgtcacgacgtctcttcgttacgtcgcgtacgtactacgtacgtcgtacgtacgacgtacgtcgtacgtcgtacg

SEQ ID NO: 126588 - DNA, 548 bp, Homo sapiens
  misc_feature: GYAE6OF02G77UD.12.24.C02.1.454.CMB.1.raw
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (386)..(386): a, c, t, g, unknown or other
  misc_feature (386)..(386): n is a, c, g, or t
  modified_base (505)..(505): a, c, t, g, unknown or other
  misc_feature (505)..(505): n is a, c, g, or t
  modified_base (507)..(508): a, c, t, g, unknown or other
  misc_feature (507)..(508): n is a, c, g, or t
  modified_base (511)..(511): a, c, t, g, unknown or other
  misc_feature (511)..(511): n is a, c, g, or t
  modified_base (515)..(516): a, c, t, g, unknown or other
  misc_feature (515)..(516): n is a, c, g, or t
  modified_base (520)..(522): a, c, t, g, unknown or other
  misc_feature (520)..(522): n is a, c, g, or t
  modified_base (524)..(539): a, c, t, g, unknown or other
  misc_feature (524)..(539): n is a, c, g, or t
  modified_base (542)..(543): a, c, t, g, unknown or other
  misc_feature (542)..(543): n is a, c, g, or t
  modified_base (545)..(548): a, c, t, g, unknown or other
  misc_feature (545)..(548): n is a, c, g, or t
tcagatacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgaccttctgtgactgccgcggactcggccctatatttctgtgcgagagatcgagattgtgtacagtccggcggggtcttctttttgacttagtcgtcggggaccaaagggactaagtggtcattcgtcttcttacnctcctcccaacgacgggcccctagtccgttccttcccccggngtccgcccttcggcctcgaggcgccaccgtccgagacncacgacgggccgcccgtagggcctcgccgtaggtaccaacggtaccttaccgttacccttaacgtccgttactcgtcggaacgggtcgggcgtacggacaacgggcaccgtagtgtacngnncgnatcnncgcnnngnnnnnnnnnnnnnnnnagnngnnnn

SEQ ID NO: 126589 - DNA, 305 bp, Homo sapiens
  misc_feature: GYAE6OF01EMX7H.13.8.A08.1.454.CMB.1.raw
  modified_base (301)..(305): a, c, t, g, unknown or other
  misc_feature (301)..(305): n is a, c, g, or t
tcagtcacgtactacacgaccggtgctcgatttagcatactctacagggcttctaatcgggactctgggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnnnnn

SEQ ID NO: 126590 - DNA, 306 bp, Homo sapiens
  misc_feature: GYAE6OF01BXEFN.13.8.A08.1.454.CMB.1.raw
  modified_base (303)..(306): a, c, t, g, unknown or other
  misc_feature (303)..(306): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatccttcccgccatctgatagtacgtgactgagcgggctggcaaggcgcatagnnnn

SEQ ID NO: 126591 - DNA, 304 bp, Homo sapiens
  misc_feature: GYAE6OF01BAB0J.13.8.A08.1.454.CMB.1.raw
  modified_base (301)..(304): a, c, t, g, unknown or other
  misc_feature (301)..(304): n is a, c, g, or t
tcagtcacgtactacacgaccggtgctcgatttagcatactctacagggcttctaatcgggactctgggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnnnn

SEQ ID NO: 126592 - DNA, 308 bp, Homo sapiens
  misc_feature: GYAE6OF01C3B7A.13.8.A08.1.454.CMB.1.raw
  modified_base (301)..(308): a, c, t, g, unknown or other
  misc_feature (301)..(308): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgcatctgatagtacgtgactgagcgggctggcaaggcgcatagnnnnnnnn

SEQ ID NO: 126593 - DNA, 363 bp, Homo sapiens
  misc_feature: GYAE6OF01CZG8W.13.8.A08.1.454.CMB.1.raw
  modified_base (330)..(330): a, c, t, g, unknown or other
  misc_feature (330)..(330): n is a, c, g, or t
  modified_base (348)..(363): a, c, t, g, unknown or other
  misc_feature (348)..(363): n is a, c, g, or t
tcagtcacgtactacacgaccggtgctcgatttagcatactctacagggcttctaatcgggactctggggtcccagagagattcagcggcagtgggtcaggcacttattcacactgaaaatcgaagagggtggagctggagatgcggtgggtacttaatcgtgacatgacaagctaacacacgtcgccctccgctctaccgttcgacgaaggacacgacgtggagaagtaacggaaacgtaagttggcggctgaccaacacttcgttcttcttactacttcccgttcccactattcgtagattagtacgtcgacgtaggacggcgggtcngacgaaggccataagagnnnnnnnnnnnnnnnn

SEQ ID NO: 126594 - DNA, 304 bp, Homo sapiens; identical to SEQ ID NO: 126591
  misc_feature: GYAE6OF01CL3PJ.13.8.A08.1.454.CMB.1.raw
  modified_base (301)..(304): a, c, t, g, unknown or other
  misc_feature (301)..(304): n is a, c, g, or t

SEQ ID NO: 126595 - DNA, 208 bp, Homo sapiens
  misc_feature: GYAE6OF01E0SQQ.13.8.A08.1.454.CMB.1.raw
  modified_base (205)..(208): a, c, t, g, unknown or other
  misc_feature (205)..(208): n is a, c, g, or t
tcagtcacgtactacacgaccggtgctcgatttagcatactctacagggggtggaatctgtgggagaggaggccagcactaggagtcggcggtgtttccattcggtgatcagcagtgaacacagaggactcaccatggagtttgggctgcctggtcaaggactacttcctagtacgtgactgagcgggctggcaaggcgcatagnnnn

SEQ ID NO: 126596 - DNA, 304 bp, Homo sapiens
  misc_feature: GYAE6OF01BNIAH.13.8.A08.1.454.CMB.1.raw
  modified_base (301)..(304): a, c, t, g, unknown or other
  misc_feature (301)..(304): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccattgatagtacgtgactgagcgggctggcaaggcgcatagnnnn

SEQ ID NO: 126597 - DNA, 306 bp, Homo sapiens; identical to SEQ ID NO: 126590
  misc_feature: GYAE6OF01EKEGA.13.8.A08.1.454.CMB.1.raw
  modified_base (303)..(306): a, c, t, g, unknown or other
  misc_feature (303)..(306): n is a, c, g, or t

SEQ ID NO: 126598 - DNA, 291 bp, Homo sapiens
  misc_feature: GYAE6OF01DMML2.13.8.A08.1.454.CMB.1.raw
  modified_base (287)..(291): a, c, t, g, unknown or other
  misc_feature (287)..(291): n is a, c, g, or t
tcagtcacgtactacacgaccggtgctcgatttagcatactctacagggccactgacatcccagccaggttcaatggcagtgggtctggaacagacttcactctcaccatcagcagcctagagccagaagattttgcaatttattactgtcaacaacgtaggagctggcccctgatcaccttcggccatgggacacgactggacattaaacgaactgtggctgcaccatctgtctcatcttccgccatctgatagtacgtgactgagcggctggcaaggcgcatagnnnnn

SEQ ID NO: 126599 - DNA, 327 bp, Homo sapiens
  misc_feature: GYAE6OF01D6EMP.13.8.A08.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (310)..(327): a, c, t, g, unknown or other
  misc_feature (310)..(327): n is a, c, g, or t
tcagtcacgtactacacgaccggtgctcgatttagcatactctacagggcttctaatcgggactctggggtcccagagagattcagcggcagtgggtcaggcactgatttcacactgaaatcagcagggtgaggctgagatgttattgggctctattattgcatgcaatcaaacacaactcggccgtactacttttcggccgaggggacccaagctggagattacaatcgaatgtgctgcacatctntctcnctcctccnctatctatatagtcgtgtacgtggacggcggcgtggacgacgcacagtgnnnnnnnnnnnnnnnnnn

SEQ ID NO: 126600 - DNA, 306 bp, Homo sapiens
  misc_feature: GYAE6OF01AOBRE.13.8.A08.1.454.CMB.1.raw
  modified_base (301)..(306): a, c, t, g, unknown or other
  misc_feature (301)..(306): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcggctggcaaggcgcatagnnnnnn

SEQ ID NO: 126601 - DNA, 192 bp, Homo sapiens
  misc_feature: GYAE6OF01D5UPB.13.8.A08.1.454.CMB.1.raw
  modified_base (179)..(192): a, c, t, g, unknown or other
  misc_feature (179)..(192): n is a, c, g, or t
tcagtcacgtactacacgaccggtgctcgatttagcatactctacaacacgacaaagggcccatcggtcttcccctggcaccctcctccaagagcacctctggggcacagcggccctgggctgcctggtcaaggactacttcctagtacgtgactgagcgggctggcaaggcgcatagnnnnnnnnnnnnnn

SEQ ID NO: 126602 - DNA, 311 bp, Homo sapiens
  misc_feature: GYAE6OF01DR8K9.13.8.A08.1.454.CMB.1.raw
  modified_base (301)..(311): a, c, t, g, unknown or other
  misc_feature (301)..(311): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatccttcccgcatctgatagtactgactgagcgggctggcaaggcgcatagnnnnnnnnnnn

SEQ ID NO: 126603 - DNA, 206 bp, Homo sapiens
  misc_feature: GYAE6OF01BS4Z0.13.8.A08.1.454.CMB.1.raw
  modified_base (205)..(206): a, c, t, g, unknown or other
  misc_feature (205)..(206): n is a, c, g, or t
tcagtcacgtactacacgaccggtgctcgatttagcatactctacagggggtggaatctgtgggagaggaggccagcactaggagtcggcggtgtttccattcggtgatcagcagtgaacacagaggactcaccatggagtttgggctgcctggtcaaggactacttcctagtacgtgactgagcgggctggcaaggcgcatagnn

SEQ ID NO: 126604 - DNA, 294 bp, Homo sapiens
  misc_feature: GYAE6OF01C9ABI.13.8.A08.1.454.CMB.1.raw
  modified_base (286)..(294): a, c, t, g, unknown or other
  misc_feature (286)..(294): n is a, c, g, or t
tcagtcacgtactacacgaccggtgctcgatttagcatactctacagggatccctgatcgattcactggctccaacgaaggggacacggccaccctgaccatcagcagggtcgaagccggggatgaggccgactatttctgtcaggtgtgggacagtaatagtgatgaagtggttttcggcggcggaccaagctgaccgtcctaggtcagccaaggctcgccccctggtcactctcgtcccgccctcctctagtacgtgactgagcggctggacaagggccatagnnnnnnnnn

SEQ ID NO: 126605 - DNA, 310 bp, Homo sapiens
  misc_feature: GYAE6OF01C0A0U.13.8.A08.1.454.CMB.1.raw
  modified_base (217)..(217): a, c, t, g, unknown or other
  misc_feature (217)..(217): n is a, c, g, or t
  modified_base (302)..(302): a, c, t, g, unknown or other
  misc_feature (302)..(302): n is a, c, g, or t
  modified_base (304)..(310): a, c, t, g, unknown or other
  misc_feature (304)..(310): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggaccacgactgganatagaacgaactgtggactgcaccatctgtcttcatccttcccgcatctgattagacgtgactgagcgggctggcaaggcactangnnnnnnn

SEQ ID NO: 126606 - DNA, 253 bp, Homo sapiens
  misc_feature: GYAE6OF01EHOQT.13.8.A08.1.454.CMB.1.raw
  modified_base (200)..(200): a, c, t, g, unknown or other
  misc_feature (200)..(200): n is a, c, g, or t
  modified_base (207)..(253): a, c, t, g, unknown or other
  misc_feature (207)..(253): n is a, c, g, or t
tcagtcacgtactacacgaccggtgctcgatttagcatactctacagggggtggaagtcgtgtgggagaggaggccagcactaggagtcggcggtgtttccattcggtgatcagcagtgaacacagaggactcaccatggagtttgggctgcctggtcaaggctacttcctagtacgtgactgagcgggctggcaaggcnctatagnnnnnnnnnnnnnnnnnnnnnnnnnnnnnnnnnnnnnnnnnnnnnnn

SEQ ID NO: 126607 - DNA, 299 bp, Homo sapiens
  misc_feature: GYAE6OF01DHXP0.13.8.A08.1.454.CMB.1.raw
  modified_base (286)..(286): a, c, t, g, unknown or other
  misc_feature (286)..(286): n is a, c, g, or t
  modified_base (292)..(299): a, c, t, g, unknown or other
  misc_feature (292)..(299): n is a, c, g, or t
tcagtcacgtactacacgaccggtgctcgatttagcatactctacagggcttctaatcgggactctggggtcccagagagattcagcggcagtgggtcaggcacttatttcacattgaaaatcaccagggtggaggctgaggatgttggatttattactgcatgcaagctacattctggcctttcactttcggccctggaccaaagtggataccaatcgaactgtgctgcaccatctgtctcatcctccgcatctgatagtacgtgactgagcggctggcaaggcncatagnnnnnnnn

SEQ ID NO: 126608 - DNA, 311 bp, Homo sapiens
  misc_feature: GYAE6OF01AZFVZ.13.8.A08.1.454.CMB.1.raw
  modified_base (302)..(311): a, c, t, g, unknown or other
  misc_feature (302)..(311): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttccgccatctgatagtacgtgactgagcgggctggcaaggcgcagtagnnnnnnnnnn

SEQ ID NO: 126609 - DNA, 403 bp, Homo sapiens
  misc_feature: GYAE6OF01DFB8E.13.8.A08.1.454.CMB.1.raw
  modified_base (366)..(403): a, c, t, g, unknown or other
  misc_feature (366)..(403): n is a, c, g, or t
tcagtcacgtactacacgaccggtgctcgatttagcatactctacagggatccctgatcgattcactggctccaacgaaggggacacggccaccctgaccatcagcagggtcgaagccggggatgaggccgactattttcctgtcgaggtggtgggataagtaagttaggtgtagtaggtaaggttttggggttttccgggcggggaccggaacgaagtcgtacggtacccgttcggttacggcgaccgaccgaacggtctccccgtccccgtcggtacctccttcgttccgtccccgtccccttccgtagtacggttacgtcgacgtggcggcgggtacgtcggacgaacgggcgtactaagcgnnnnnnnnnnnnnnnnnnnnnnnnnnnnnnnnnnnnnn

SEQ ID NO: 126610 - DNA, 310 bp, Homo sapiens
  misc_feature: GYAE6OF01B1T7X.13.8.A08.1.454.CMB.1.raw
  modified_base (306)..(310): a, c, t, g, unknown or other
  misc_feature (306)..(310): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggcttgaggatgctggggtctattactgcatgcaagctacacactggcctccgctcaccttcggaccaagggacacgactggagatagaacgaactgtggctgcaccatctgtcttcatccttcccgccatctgatagtacgtgactgaggcgggctggcaaggcgcatagnnnnn

SEQ ID NO: 126611 - DNA, 314 bp, Homo sapiens
  misc_feature: GYAE6OF01COS0T.13.8.A08.1.454.CMB.1.raw
  modified_base (166)..(166): a, c, t, g, unknown or other
  misc_feature (166)..(166): n is a, c, g, or t
  modified_base (266)..(266): a, c, t, g, unknown or other
  misc_feature (266)..(266): n is a, c, g, or t
  modified_base (307)..(314): a, c, t, g, unknown or other
  misc_feature (307)..(314): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgnaagctacacactggcctccgctccaccttcggccaagggacacgactggagatagaacgactgtggctgcaccatctgtcttcactccttcccgcatctnaatgtacgtgactggacgcgggctggacaggcacagtacgnnnnnnnn

SEQ ID NO: 126612 - DNA, 352 bp, Homo sapiens
  misc_feature: GYAE6OF01EUD0X.13.8.A08.1.454.CMB.1.raw
  modified_base (316)..(317): a, c, t, g, unknown or other
  misc_feature (316)..(317): n is a, c, g, or t
  modified_base (320)..(352): a, c, t, g, unknown or other
  misc_feature (320)..(352): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtgaggctgaggatgctggggtctattactgcatgcaagctacacactggcctccgctcaccttcggccaaagggcacgactggagatagaaacgactgtggctgccaccatctgtcttcactccttcccgccaatctagatagtacgtgactggacggcgggtctgggacgaaggtcgcaagtagnngcnnnnnnnnnnnnnnnnnnnnnnnnnnnnnnnnn

SEQ ID NO: 126613 - DNA, 314 bp, Homo sapiens
  misc_feature: GYAE6OF01EQ8JI.13.8.A08.1.454.CMB.1.raw
  modified_base (302)..(314): a, c, t, g, unknown or other
  misc_feature (302)..(314): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatccttcccgcatctgatagtacgtgactgagcgggctggcaaggcgcatagnnnnnnnnnnnnn

SEQ ID NO: 126614 - DNA, 314 bp, Homo sapiens
  misc_feature: GYAE6OF01A505C.13.8.A08.1.454.CMB.1.raw
  modified_base (306)..(314): a, c, t, g, unknown or other
  misc_feature (306)..(314): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatccttcccgccatctgatagtacgtgactgaggcgggctggcgaaggcgcaatagnnnnnnnnn

SEQ ID NO: 126615 - DNA, 208 bp, Homo sapiens; identical to SEQ ID NO: 126595
  misc_feature: GYAE6OF01BX4DG.13.8.A08.1.454.CMB.1.raw
  modified_base (205)..(208): a, c, t, g, unknown or other
  misc_feature (205)..(208): n is a, c, g, or t

SEQ ID NO: 126616 - DNA, 192 bp, Homo sapiens
  misc_feature: GYAE6OF01CWXI6.13.8.A08.1.454.CMB.1.raw
  modified_base (180)..(192): a, c, t, g, unknown or other
  misc_feature (180)..(192): n is a, c, g, or t
tcagtcacgtactacacgaccggtgctcgatttagcatactctacaacacacgaaagggcccatcggtcttccccctggcaccctcctccaagagcacctctgggggcacagcggccctgggctgccttggcaaggctacttcctagtacgtgactgagcggctggcaaggcgacatagnnnnnnnnnnnnn

SEQ ID NO: 126617 - DNA, 373 bp, Homo sapiens
  misc_feature: GYAE6OF01EUR30.13.8.A08.1.454.CMB.1.raw
  modified_base (179)..(179): a, c, t, g, unknown or other
  misc_feature (179)..(179): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
  modified_base (340)..(342): a, c, t, g, unknown or other
  misc_feature (340)..(342): n is a, c, g, or t
  modified_base (344)..(373): a, c, t, g, unknown or other
  misc_feature (344)..(373): n is a, c, g, or t
tcagtcacgtactacacgaccggtgctcgatttagcatactctacagggcttctaatcgggactctggggtcccagagagattcagcggcaggtgggtcaggcactttatttcacactgaaatcgacagggtggaggctgaggatgctggggtcttattacgtgcatgacagctacacnctcggcctccgctcgaccttcggaccgaaggcacgcgtaggagatacgaacgtactggtcggctcgccactatctacgttctactacgtcccttacccgctacttctagtaactcgtacgttgtacgaggacggcggngtcggagtacggngacagtgctnnncnnnnnnnnnnnnnnnnnnnnnnnnnnnnnn

SEQ ID NO: 126618 - DNA, 300 bp, Homo sapiens
  misc_feature: GYAE6OF02IGCOZ.13.8.A08.1.454.CMB.1.raw
  modified_base (298)..(300): a, c, t, g, unknown or other
  misc_feature (298)..(300): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgttgggatttattactgcatgcaagctacattctggcctttcactttcggccctgggaccaaagtggataccaatcgaactgtggctgcaccatctgtcttcatcttccgccatctgatagtacgtgactgagcgggctggcaaggcgcatagnnn

SEQ ID NO: 126619 - DNA, 304 bp, Homo sapiens
  misc_feature: GYAE6OF02INJ3S.13.8.A08.1.454.CMB.1.raw
  modified_base (301)..(304): a, c, t, g, unknown or other
  misc_feature (301)..(304): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtactgactgagcgggctggcaaggcgcatagnnnn

SEQ ID NO: 126620 - DNA, 302 bp, Homo sapiens
  misc_feature: GYAE6OF02JG9W8.13.8.A08.1.454.CMB.1.raw
  modified_base (296)..(302): a, c, t, g, unknown or other
  misc_feature (296)..(302): n is a, c, g, or t
tcagtcacgtactacacgaccggtgctcgatttagcatactctacaggcttctaatcgggactctgggtcccagagagattcagcggcagtgggtcaggcacttatttcacactgaaatcgacagggtggaggctgaggatgctgggtctattactgcatgcaagctacacactggcctccgctcaccttcggccaagggcacgactggagatagaacgaactgtggctgcaccatctgtcttcatcttccgccatctgatagtacgtgactgagcgggctggcaaggcgcatagnnnnnnn

SEQ ID NO: 126621 - DNA, 303 bp, Homo sapiens
  misc_feature: GYAE6OF02GGSAK.13.8.A08.1.454.CMB.1.raw
  modified_base (302)..(303): a, c, t, g, unknown or other
  misc_feature (302)..(303): n is a, c, g, or t
tcagtcacgtactacacgaccggtgctcgatttagcatactctacagggcttctaatcgggactctggggtcccagagagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtggctgcaccatctgtcttcatcttcccgccatctgatagtacgtgactgagcgggctggcaaggcgcatagnn

SEQ ID NO: 126622 - DNA, 306 bp, Homo sapiens
  misc_feature: GYAE6OF02F815T.13.8.A08.1.454.CMB.1.raw
  modified_base (302)..(306): a, c, t, g, unknown or other
  misc_feature (302)..(306): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnnnnn

SEQ ID NO: 126623 - DNA, 292 bp, Homo sapiens
  misc_feature: GYAE6OF02HZCJD.13.8.A08.1.454.CMB.1.raw
  modified_base (288)..(292): a, c, t, g, unknown or other
  misc_feature (288)..(292): n is a, c, g, or t
tcagtcacgtactacacgaccggtgctcgatttagcatactctacagggatccctgatcgattcactggctccaacgaaggggacacggccaccctgaccatcagcagggtcgaagccggggatgaggccgactatttctgtcaggtgtgggacagtaatagtgatgaagtggttttcggcggcgggaccaagctgaccgtcctaggtcagcccaaggctgccccctcggtcactctgttcccgccctcctctagtacgtgactgagcgggctggcaaggcgcatagnnnnn

SEQ ID NO: 126624 - DNA, 224 bp, Homo sapiens
  misc_feature: GYAE6OF02IXO85.13.8.A08.1.454.CMB.1.raw
  modified_base (206)..(224): a, c, t, g, unknown or other
  misc_feature (206)..(224): n is a, c, g, or t
tcagtcacgtactacacgaccggtgctcgatttagcatactctacagggggtggaatcgtgtgggagaggaggccagcactaggagtcggcggtgtttccattcggtgatcagcagtgaacacagaggactcaccatggagtttgggctgcctggtcaaggactacttcctagtacgtgactgagcgggctggcaaggcgcatagnnnnnnnnnnnnnnnnnnn

SEQ ID NO: 126625 - DNA, 305 bp, Homo sapiens
  misc_feature: GYAE6OF02FZIEB.13.8.A08.1.454.CMB.1.raw
  modified_base (302)..(305): a, c, t, g, unknown or other
  misc_feature (302)..(305): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnnnn

SEQ ID NO: 126626 - DNA, 290 bp, Homo sapiens
  misc_feature: GYAE6OF02H947A.13.8.A08.1.454.CMB.1.raw
  modified_base (286)..(290): a, c, t, g, unknown or other
  misc_feature (286)..(290): n is a, c, g, or t
tcagtcacgtactacacgaccggtgctcgatttagcatactctacagggatccctgatcgattcactggctccaacgaagggacacggccaccctgaccatcagcagggtcgaagccggggatgaggccgactatttctgtcaggtgtgggacagtaatagtgatgaagtggttttcggcggcgggaccaagctgaccgtctaggtcagcccaaggctgccccctcggtcactctgttcccaccctcctctagtacgtgactgagcgggctggcaaggcgcatagnnnnn

SEQ ID NO: 126627 - DNA, 307 bp, Homo sapiens
  misc_feature: GYAE6OF02IG88F.13.8.A08.1.454.CMB.1.raw
  modified_base (301)..(307): a, c, t, g, unknown or other
  misc_feature (301)..(307): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgcatctgatagtacgtgactgagcgggctggcaaggcgcatagnnnnnnn

SEQ ID NO: 126628 - DNA, 311 bp, Homo sapiens
  misc_feature: GYAE6OF02HI40R.13.8.A08.1.454.CMB.1.raw
  modified_base (301)..(311): a, c, t, g, unknown or other
  misc_feature (301)..(311): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggcacgactggagatagaacgaactgtggctgcaccatctgtcttcatcttcccgccatctgatagtacgtgactgagcgggctggcaaggcgcatagnnnnnnnnnnn

SEQ ID NO: 126629 - DNA, 307 bp, Homo sapiens
  misc_feature: GYAE6OF02HMZNI.13.8.A08.1.454.CMB.1.raw
  modified_base (297)..(297): a, c, t, g, unknown or other
  misc_feature (297)..(297): n is a, c, g, or t
  modified_base (303)..(307): a, c, t, g, unknown or other
  misc_feature (303)..(307): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaaagggcacgactggagatagaacgactgtggctgcaccatctgtcttcattcttcccgccatctgatagtacgtgactgagcggctggccaagggcncatagnnnnn

SEQ ID NO: 126630 - DNA, 307 bp, Homo sapiens; identical to SEQ ID NO: 126627
  misc_feature: GYAE6OF02ISXN1.13.8.A08.1.454.CMB.1.raw
  modified_base (301)..(307): a, c, t, g, unknown or other
  misc_feature (301)..(307): n is a, c, g, or t

SEQ ID NO: 126631 - DNA, 220 bp, Homo sapiens
  misc_feature: GYAE6OF02IH2MF.13.8.A08.1.454.CMB.1.raw
  modified_base (208)..(220): a, c, t, g, unknown or other
  misc_feature (208)..(220): n is a, c, g, or t
tcagtcacgtactacacgaccggtgctcgatttagcatactctacagggggtggaagtctgtgggagaggaggccagcactagggagtcggcggtgtttccattcggtgatcagcagtgaacacagaggactcaccatggagtttgggctgcctggtcaaaggactacttcctagtacgtgactgagcgggctggcaaggcgcatagnnnnnnnnnnnnn

SEQ ID NO: 126632 - DNA, 294 bp, Homo sapiens
  misc_feature: GYAE6OF02HYP8J.13.8.A08.1.454.CMB.1.raw
  modified_base (290)..(294): a, c, t, g, unknown or other
  misc_feature (290)..(294): n is a, c, g, or t
tcagtcacgtactacacgaccggtgctcgatttagcatactctacagggccactgacatcccagccaggttcaatggcagtgggtctggaacagacttcactctcaccatcagcagcctagagccagaagattttgcagcttattactgtcagcagcgtagcaactggcctccggccctttcggcggagggaccaaggtggagatcaaaacgaactgtggctgcaccatctgtcttcatcttcccgccatctgatagtacgtgactgagcgggctggcaaggcgcatagnnnnn

SEQ ID NO: 126633 - DNA, 307 bp, Homo sapiens
  misc_feature: GYAE6OF02IQCGZ.13.8.A08.1.454.CMB.1.raw
  modified_base (296)..(296): a, c, t, g, unknown or other
  misc_feature (296)..(296): n is a, c, g, or t
  modified_base (302)..(307): a, c, t, g, unknown or other
  misc_feature (302)..(307): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcncatagnnnnnn

SEQ ID NO: 126634 - DNA, 208 bp, Homo sapiens; identical to SEQ ID NO: 126595
  misc_feature: GYAE6OF02IQ8VJ.13.8.A08.1.454.CMB.1.raw
  modified_base (205)..(208): a, c, t, g, unknown or other
  misc_feature (205)..(208): n is a, c, g, or t

SEQ ID NO: 126635 - DNA, 309 bp, Homo sapiens
  misc_feature: GYAE6OF02IQQHE.13.8.A08.1.454.CMB.1.raw
  modified_base (303)..(309): a, c, t, g, unknown or other
  misc_feature (303)..(309): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatccttcccgccatctgatagtactgactgagcgggctgggcaaggcgcatagnnnnnnn

SEQ ID NO: 126636 - DNA, 305 bp, Homo sapiens
  misc_feature: GYAE6OF02I8FX4.13.8.A08.1.454.CMB.1.raw
  modified_base (297)..(305): a, c, t, g, unknown or other
  misc_feature (297)..(305): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacaggtggaggctgaggatgctggggtctattactgcatgcaagctacacactggcctccgctcaccttggccaagggacacgactggagatagaacgaactgtggctgcaccatctgtcttcatcttccgcatctgatagtacgtgactgagcgggctggcaagcgcatagnnnnnnnnn

SEQ ID NO: 126637 - DNA, 667 bp, Homo sapiens
  misc_feature: GYAE6OF02GTRYI.13.8.A08.1.454.CMB.1.raw
  modified_base (618)..(618): a, c, t, g, unknown or other
  misc_feature (618)..(618): n is a, c, g, or t
tcagtcacgtactacacgaccggtgctcgatttagcatactctacaggggctgggagaggagccccagccctgagattcccacgtgttgccattcggtgatcagcgctgaacacagaggactcgccatggagtttgggctgagcttgggttttccttgttgctattttaaaaggtgtccagtgtgaggtgcagctggtagagtcgtggggaggtgtggtacggcgtcgggggtccctcagactctcctgtcgcaacctcgtggattcgagtatttgatgagtatggcatacacgtcgggtcccgacccgaaccgtccgaaggggaacgggctggcgtacggtcggttctcggttaggtaagtaaacgtaggaagtggtacgaccaaggacctaactaacgtttagcgacacggtacttcgtaggtacgggtaacgggacctacgttacccgaacctacttacccgtaaccgaagggaacgacgtggtaccggaaccccggaataacccgttccgtaacttagtccgtaagaactaaagttacgaaacttggttcgtaacggggaactcggaacggtaccgaccgtctttagtactttcggagttcggaggttacggtnccggtagtcggtacgttcggtaaccttagaacggttaggcggttaacgg

SEQ ID NO: 126638 - DNA, 311 bp, Homo sapiens
  misc_feature: GYAE6OF02GA2DR.13.8.A08.1.454.CMB.1.raw
  modified_base (299)..(299): a, c, t, g, unknown or other
  misc_feature (299)..(299): n is a, c, g, or t
  modified_base (305)..(311): a, c, t, g, unknown or other
  misc_feature (305)..(311): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgccaccatctgtcttcatccttcccgcctatctgatagtactgactggagcgggctggcaaggcncatagnnnnnnn

SEQ ID NO: 126639 - DNA, 296 bp, Homo sapiens
  misc_feature: GYAE6OF02FVHXO.13.8.A08.1.454.CMB.1.raw
  modified_base (291)..(296): a, c, t, g, unknown or other
  misc_feature (291)..(296): n is a, c, g, or t
tcagtcacgtactacacgaccggtgctcgatttagcatactctacagggccactgacatcccagccaggttcaatggcagtgggtctggaacagacttcactctcaccatcagcagcctagagccagaagattttgcaatttattactgtcaacaacgtaggagctggcccctgatcaccttcggccatgggacacgactggacattaaaacgaactgtggctgcaccatctgtcttcatcttcccgccatctgatagtacgtgactgagcgggctggcaaggcgcatagnnnnnn

SEQ ID NO: 126640 - DNA, 353 bp, Homo sapiens
  misc_feature: GYAE6OF02GMCHO.13.8.A08.1.454.CMB.1.raw
  modified_base (217)..(217): a, c, t, g, unknown or other
  misc_feature (217)..(217): n is a, c, g, or t
  modified_base (305)..(353): a, c, t, g, unknown or other
  misc_feature (305)..(353): n is a, c, g, or t
tcagtcacgtactacacgaccggtgctcgatttagcatactctacagggcttctaatcgggactctggggtcccagagagattcagcggcagtgggtcaggcacttatttcacactgaaaaatcgacagggtggaggctgaggatgctggggtctattactgcatgcaagctacacactggcctccgctcaccttcggccaaagggcacgactgganatagaacgaactgtgctgcaccatctgtcttcatccttcccgcatctgatgtacgtgactgagcgggctggacaaggcgcatagctgnnnnnnnnnnnnnnnnnnnnnnnnnnnnnnnnnnnnnnnnnnnnnnnnn

SEQ ID NO: 126641 - DNA, 328 bp, Homo sapiens
  misc_feature: GYAE6OF02GTH1G.13.8.A08.1.454.CMB.1.raw
  modified_base (273)..(273): a, c, t, g, unknown or other
  misc_feature (273)..(273): n is a, c, g, or t
  modified_base (304)..(306): a, c, t, g, unknown or other
  misc_feature (304)..(306): n is a, c, g, or t
  modified_base (309)..(328): a, c, t, g, unknown or other
  misc_feature (309)..(328): n is a, c, g, or t
tcagtcacgtactacacgaccggtgctcgatttagcatactctacagggcttctaaatcgggactctggggtcccagagagattcagcggcagtgggtcaggcacttatttcacactgaaaatcagcagggtggaggctgaggatgttattgggctctattattgcatgcaagcaacacactggccgtacacttttggccaggggaccaagctggagatcaatcgaactgtgctgcaccatctgtctcatctcccgccatctgactagtcgtnactgagcgggctcggacaaggcgcataggcnnncannnnnnnnnnnnnnnnnnnn

SEQ ID NO: 126642 - DNA, 326 bp, Homo sapiens
  misc_feature: GYAE6OF02GVLKR.13.8.A08.1.454.CMB.1.raw
  modified_base (217)..(217): a, c, t, g, unknown or other
  misc_feature (217)..(217): n is a, c, g, or t
  modified_base (308)..(310): a, c, t, g, unknown or other
  misc_feature (308)..(310): n is a, c, g, or t
  modified_base (312)..(326): a, c, t, g, unknown or other
  misc_feature (312)..(326): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaaagggcacgactggganatagaacgaactgtggctgcaaccatctgtcttcattcttcccgccatctgatagtacgtgacttggagcgggctgggcaaggcgcatagnnngnnnnnnnnnnnnnnn

SEQ ID NO: 126643 - DNA, 360 bp, Homo sapiens
  misc_feature: GYAE6OF02IHF5O.13.8.A08.1.454.CMB.1.raw
  modified_base (218)..(218): a, c, t, g, unknown or other
  misc_feature (218)..(218): n is a, c, g, or t
  modified_base (273)..(273): a, c, t, g, unknown or other
  misc_feature (273)..(273): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (325)..(360): a, c, t, g, unknown or other
  misc_feature (325)..(360): n is a, c, g, or t
tcagtcacgtactacacgaccggtgctcgatttagcatactctacagggcttctaatcggggactctggggtcccagagagattcagcggcagtgggtcaggcacttatttcacactgaaaatcgacagggtggaggctgaggatgctggggtctattactgcatgcaagctacacactcggcctcgctcaccttcggaccaaggacacgacgtgganaatagaacgactggtggctgaccaccgatcctgttcttcaatcctcccgcattcngactagtcgtgactggacgccgggtctggacgaacggcgtcaagtgnancgnnnnnnnnnnnnnnnnnnnnnnnnnnnnnnnnnnnn

SEQ ID NO: 126644 - DNA, 354 bp, Homo sapiens
  misc_feature: GYAE6OF02GY94X.13.8.A08.1.454.CMB.1.raw
  modified_base (325)..(354): a, c, t, g, unknown or other
  misc_feature (325)..(354): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaaagctacacactggacctccgctcaccttcggccaagggacacgactggagatagaacgactgtggactgccacatctgtcttcacttcctcccgcattctagtactagtaccgtgaccttggaggccgggtctcggacgaaagggccacgaagtgcnnnnnnnnnnnnnnnnnnnnnnnnnnnnnn

SEQ ID NO: 126645 - DNA, 317 bp, Homo sapiens
  misc_feature: GYAE6OF02IO6WS.13.8.A08.1.454.CMB.1.raw
  modified_base (299)..(299): a, c, t, g, unknown or other
  misc_feature (299)..(299): n is a, c, g, or t
  modified_base (304)..(317): a, c, t, g, unknown or other
  misc_feature (304)..(317): n is a, c, g, or t
tcagtcacgtactacacgaccggtgctcgatttagcatactctacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggcacgactggagataggaacgaactgtggctgcaccatctgtcttcatcttcccgcatctgatagtacgtgactggagcgggctggcgaagggccnatagnnnnnnnnnnnnnn

SEQ ID NO: 126646 - DNA, 244 bp, Homo sapiens
  misc_feature: GYAE6OF02FN73Y.13.8.A08.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (213)..(244): a, c, t, g, unknown or other
  misc_feature (213)..(244): n is a, c, g, or t
tcagtcacgtactacacgaccggtgctcgatttagcatactctacagggggtggaatctgtgggagaggaggccagcactaggagtcggcggtgtttccattcggtgatcagcagtgaacacagaggactcaccatgggagtttgggctagccttggtacaaggtactacttcctagtacgtgacgtgaggcggctggcaaggcncatagncnnnnnnnnnnnnnnnnnnnnnnnnnnnnnnnn

SEQ ID NO: 126647 - DNA, 489 bp, Homo sapiens
  misc_feature: GYAE6OF01C8LVO.12.49.E05.1.454.CMB.1.raw
  modified_base (446)..(446): a, c, t, g, unknown or other
  misc_feature (446)..(446): n is a, c, g, or t
tcagatacgacgtacacgaccggtgctcgatttagagcgactagcaacacacaaaggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgactaacttattactgtacaaaagtataaacagtcgcccccttnacccttcggacccaaagggaccacggactggagattagaaccg

SEQ ID NO: 126648 - DNA, 496 bp, Homo sapiens
  misc_feature: GYAE6OF01EHFZH.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatcgtgggacagagttcactctcaccatcagcagcctgcagcctgaagatgttgctaacttattactgtacaaaagtataaacagtcgtcccccttcacccgttcggacccgaagggacctacggactggactagttgtaaaccg

SEQ ID NO: 126649 - DNA, 487 bp, Homo sapiens
  misc_feature: GYAE6OF01A4VXC.12.49.E05.1.454.CMB.1.raw
  modified_base (448)..(448): a, c, t, g, unknown or other
  misc_feature (448)..(448): n is a, c, g, or t
  modified_base (479)..(479): a, c, t, g, unknown or other
  misc_feature (479)..(479): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcacatcagcagcctgcagcctgaagattgttgctaacttattactagtacaaaagtactaaacagtcgcccccttnacccttcggccaagggacacgactggacgtnttagaacg

SEQ ID NO: 126650 - DNA, 522 bp, Homo sapiens
  misc_feature: GYAE6OF01DEFJ3.12.49.E05.1.454.CMB.1.raw
  modified_base (228)..(228): a, c, t, g, unknown or other
  misc_feature (228)..(228): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggngagtcagggcattagctaattttttagcctggtatcagcagaaaccagggaaagttccacacctcctgatctatgctgcatcgctttgcaatcagggtcccatctcggttcagcggcagtggatctgggacagagttcactctcaccatcagtcagcctgcagcctgaagatgttagactaatttacttaactagtaactaaaagttataaaccgtagtccgtacccccttacaacccgttcggacccaaagggacctaaccggtaacgtggaacgtaagttaacggaaaccgg

SEQ ID NO: 126651 - DNA, 835 bp, Homo sapiens
  misc_feature: GYAE6OF01CLYD8.12.49.E05.1.454.CMB.1.raw
  modified_base (111)..(111): a, c, t, g, unknown or other
  misc_feature (111)..(111): n is a, c, g, or t
  modified_base (268)..(268): a, c, t, g, unknown or other
  misc_feature (268)..(268): n is a, c, g, or t
tcagatacgacgtacacgaccggtgctcgatttagagcgactagcaacacacaaagggggcagaagtctctctcagtcaggacacagcatggacatgagggtccctgcctnagcctcgtgggacctcgtgctcgctcgtcggtccctaccgagtactaccgagtattggtacgaactagtcggaagtagtaccgaaccctagttcctaccacttcccctccgtgtctacgctattcgttaggtaaggacgaagaggtactccaacctntaccgtacgttcggggcccgggagtacgtacggacggtactaagttacgtaactttaacgtttttacgccgttaggttactacgacgacgaaacggaaaccggtaagggttaacctaccaacctaccgtacgtagtacttacgtagtcgtctacgactacgttccgttagttacgaactacgtaccggaccggttaccctacgtttccggtacggttacgacgggtccggtacgtaaggtcggtacttacgggagggtaactagggtacttcctaaccgttaccgtaacccaaccgttagaccgtacggacctaccggtaccgttaccggaacctaccggtaccgttaagggaaacgtttcggtttacggtaaccgttaaacctttaaacgtttaacgtttaaccgtaacggttaaaaactaaaacgtttaacctaaaccgggttacccgttaccccccgtttaacccccgttaaccgttaaccccggttaccgggaaacccggtaaaccggaaccgtaaccggtaaccggtaaggtaaccgttaaaggttaaaccgggtaaaccgg

SEQ ID NO: 126652 - DNA, 492 bp, Homo sapiens
  misc_feature: GYAE6OF01BFLTN.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagcctggtatcagcagaaaccagggaaagttccacacctctgatctatgctgcatccgtctttgcaatcaggggtcccatctcggttcagcggcagtggatcgtgggacaggtagttcactctcaccatcagcagtcctgcacgcctagaagatgttcgactaacttattactagtacaaagtataactacgtccgccccttcaccttcggacctaaggactacgactggatgtgaacg

SEQ ID NO: 126653 - DNA, 488 bp, Homo sapiens
  misc_feature: GYAE6OF01DIKPX.12.49.E05.1.454.CMB.1.raw
  modified_base (351)..(351): a, c, t, g, unknown or other
  misc_feature (351)..(351): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggtcagcggcagtggntcgtgggacagagttcactctcaccatcagcagcctgcagcctgaagatgttcgactaacttattactgtacaaaagttataaacngtcgtcccccttnacccttcggaccaagggacacgactggangttagaacg

SEQ ID NO: 126654 - DNA, 536 bp, Homo sapiens
  misc_feature: GYAE6OF01BGZ4L.12.49.E05.1.454.CMB.1.raw
tcagatacgacgtacacgaccggtgctcgatttagagcgactagcaacacacaaagggggcagaagtctctctcagtcagggcacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttagcctggtatcagcagaaaccagggaaagttccacacctcctgatctatgctgcatccgtctttgcaatcaggggtcccatctcggttcagcggcagtggatcgtgggacagagttcactctcaccatcagcacgcctgccacgcctagaagtatcgttgactaactttacttaactagtaactaaaagtacttaaaccacgttccgtccccctttacaacccgtttccgggaacccgtaacgggaaccaccggtacgtagggaacgtagttaacggtaaaccgg

SEQ ID NO: 126655 - DNA, 508 bp, Homo sapiens
  misc_feature: GYAE6OF01B3N7G.12.49.E05.1.454.CMB.1.raw
  modified_base (399)..(399): a, c, t, g, unknown or other
  misc_feature (399)..(399): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaatttttagcctggtatcagcagaaaccagggaagttccacacctctgatctatgctgctatccgctttgcaatcgagggtcccatctcggttcagcgcagtggatcgtggacagtagttcactctcaccatcagcacgcctgcagcctgaagntgtgactaactttattactagtaactaaagtataacgtagtaccgtccccttacgacccgttcggaccgtaacgggacctacggactagggaacgtgttaacgaaccgg

SEQ ID NO: 126656 - DNA, 506 bp, Homo sapiens
  misc_feature: GYAE6OF01C4HJJ.12.49.E05.1.454.CMB.1.raw
  modified_base (229)..(229): a, c, t, g, unknown or other
  misc_feature (229)..(229): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttggccgggngagtcagggcattagctaattttttagcctggtatcagcagaaccagggaaagttccacacctctgatctatgctgcatccgctttgctaatcagggtcccatctcggttcagcgcagtgatcgtggacagagttcactctcaccatcagcagcctgcagcctagaagntgtagctaacttnttactgtacaacagaacgttaaccacgtttacccctcctaacgtttcgggaccggtaggaacccgtaagggtacgaagactacgaaacgtaacgg

SEQ ID NO: 126657 - DNA, 508 bp, Homo sapiens
  misc_feature: GYAE6OF01D1O1M.12.49.E05.1.454.CMB.1.raw
  modified_base (460)..(460): a, c, t, g, unknown or other
  misc_feature (460)..(460): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccggcgagtcagggcattagctaatttttagcctggtatcagcagaaaccagggaaagttccacacctcctgatctatgctgcatccgtcttgcaatcgaggggtcccatctcggttcagcggcagtggatcgtgggacagagttcacgtctcaccatcagcagcctgcagcctagaagatgttacgacgtaactttattactagtacaaaagttataaacacgttcgtcccccttanacccgttcggacccgaagggacctacggactgggactagttagaacgg

SEQ ID NO: 126658 - DNA, 496 bp, Homo sapiens
  misc_feature: GYAE6OF01E16V0.12.49.E05.1.454.CMB.1.raw
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (445)..(445): a, c, t, g, unknown or other
  misc_feature (445)..(445): n is a, c, g, or t
  modified_base (458)..(458): a, c, t, g, unknown or other
  misc_feature (458)..(458): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttggccgggcgagtcgagggcattagctaattttttagcctggtatcagcaagaaaccgagggaaacgttccacacctcctgatctatgctgcatccgctttgcaatcgagggtcccagtctcgttcagcggnagtggatcgnggacagtgttcactcncaccatcagcagcctgcagcctagaagtatcgttgacttaatttattactagtaacaaagtataacngtccgtccccttnacccgttcgaccgaaggccacgacaggatagtagaacg

SEQ ID NO: 126659 - DNA, 506 bp, Homo sapiens
  misc_feature: GYAE6OF01CA5DD.12.49.E05.1.454.CMB.1.raw
  modified_base (228)..(228): a, c, t, g, unknown or other
  misc_feature (228)..(228): n is a, c, g, or t
  modified_base (377)..(377): a, c, t, g, unknown or other
  misc_feature (377)..(377): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggngagtcagggcattagctaattttttagcctggtatcagcagaaaccagggaaattccacacctcctgatctatgctgcatccgctttgcaatcaggggtcccatctcggttcagcgcagtgatcgtgggacagagttcactctcaccancagcagcctgcagcctgaagatgttgactaacttattactagtacaaaagtataaacagtccgcccccttacacccgttccggaccgaaacgggacctaaccggactagggacgtagttaggtaaccgg

SEQ ID NO: 126660 - DNA, 538 bp, Homo sapiens
  misc_feature: GYAE6OF01CUN3O.12.49.E05.1.454.CMB.1.raw
  modified_base (228)..(228): a, c, t, g, unknown or other
  misc_feature (228)..(228): n is a, c, g, or t
  modified_base (316)..(316): a, c, t, g, unknown or other
  misc_feature (316)..(316): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggngagtcagggcattagctaattttttacgcctggtatcagcaagaaaccagggaaacgttccacacctcctgatctatgctgcatccgntttgcaatcgagggtcccatctcggttcagcggcagtggatcgtgggacagtagttcactctcaccatcagcagtcctgcagcctagaagtnttgtnacttaacttattaactgtaactaaaagttataaccgtagtacccgtccccccttagaacccgtttccggaacccgtaaagggacctaccggtaacgtacgggaactaacggttaggtaaacccgg

SEQ ID NO: 126661 - DNA, 550 bp, Homo sapiens
  misc_feature: GYAE6OF01D7659.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctcctgtctgcatctgtaggagacagagtcaccatcacttgccgggcgagtcagggcattagctaattttttagcctggtatcagcagaaaccagggaaagttccacacctcctgatctatgctgcactccgtctttgcaagtcgacggggtcccatcgtcggttcacgcggcaggtggatcgtgggacagtagttcactctcaccatcagcacgcctgcacgcctagaacgtattgttacgtacttaactttattaacgtagtaactaaaagttataaaccgtacgttacccgtacccccttactacccgttccggacccgtaaacgggacctaaccggtacgtagggaacgtagttaaggaaacccgg

SEQ ID NO: 126662 - DNA, 642 bp, Homo sapiens
  misc_feature: GYAE6OF01CC3QA.12.49.E05.1.454.CMB.1.raw
  modified_base (232)..(232): a, c, t, g, unknown or other
  misc_feature (232)..(232): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagacgtcaccatcacgttggccggggngagtcgagggctattagcttaattttttagccttggtatcagcaagaaaccgaagggtaaacgttccaacacctcctgtactctatgctgctatccgtctttcgactaagtcgtacggggtcccagttccgtcggttcaggcggacgaggtggacgtcgtacgggacgtagtacgttactacgggggtacctacgtacctactacacgcacgtccgtcgccgacgaccgtacgaacgtagttcgttacgtacgttaactttactttaacgttagttaacgtaaacgttaacgttaaaccgtaccgttacccgttacccccgttacccgttacccggttacccggtaacccggtaaacgggaaccgtaaccggtaaccggtacgggtaaacgtaagttaacggtaaaccgg

SEQ ID NO: 126663 - DNA, 536 bp, Homo sapiens
  misc_feature: GYAE6OF01CHQGX.12.49.E05.1.454.CMB.1.raw
  modified_base (227)..(227): a, c, t, g, unknown or other
  misc_feature (227)..(227): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccggngagtcagggcattagctaattttttagcctggtatcagcagaaaccagggaaagcccctaaggtcctgatctatgctgcatccagtttgcaaagtgggtcccatcgaaggttcagtggcaggtgggtctgggacagtatttcactctcaccatcagcagtctgcaacctgaatattctagctaacttattactagtcaaacagtacgtaacctacgttaacccctcccgtaacgtttccgggaccgggtagggaaccctaaggggtacggaacgacttaccgaaaacgtacgttcggtcggccgtacgg

SEQ ID NO: 126664 - DNA, 489 bp, Homo sapiens
  misc_feature: GYAE6OF01CDE4C.12.49.E05.1.454.CMB.1.raw
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctcctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcgttcagcgcagtggatcgtggacngagttcactctcacatcagcancctgcagcctgaagatgttcgactaacttattactgtactaaagtatacagtccgtccccttacaccgttcggaccaacgggctaacggactaggactataggtaaccg

SEQ ID NO: 126665 - DNA, 493 bp, Homo sapiens
  misc_feature: GYAE6OF01BMWWQ.12.49.E05.1.454.CMB.1.raw
  modified_base (452)..(452): a, c, t, g, unknown or other
  misc_feature (452)..(452): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatcgtgggacagagttcactctcaccatcagcagcctgcagcctgaagatgttgactaactttattactgtaacaaaagtataaacagttccgcccccttnacccgttcggaccgaaggacacgactaggactagtagaacg

SEQ ID NO: 126666 - DNA, 536 bp, Homo sapiens
  misc_feature: GYAE6OF01EF7XM.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaatttttagcctggtatcagcagaaaccagggaaagttccacgacctcctgatctatgctgcatccgctttgcaatcagggtcccatctcggttcagcggcagtggatcgtgggacagacgttcactctacacatcagcagcctgcagcctgaacgatgttagactaactttattactagtacaaaagttactaaactacgttaccgtccccccttactaccccgtttccggaacccgtaaacgggaacccgtaccggaacttagggaacgtaagttaacggtaaacccgg

SEQ ID NO: 126667 - DNA, 559 bp, Homo sapiens
  misc_feature: GYAE6OF01C9FK8.12.49.E05.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtagganacagagtcaccatcacttgccgggngagtcagggcattagctaattttttagcctggtatcagcaagaaaccagggaacgttccacacctcctgatctatgctgcatccgctttgcaatcgagggtcccatctcggttcagcggcagtggatcgtgggactagtacgtcactctcacatcagccagcctgcagcctgaagtattcgttgtactaactttattaacgtagttaacgtaaaaacgttactaaaccgtacgttacccggtacccccctttacgtaacccgtttacccgggaaccgtaaacgggaccctaaccggtaacgttagggaacgtaagttaacggtaaacccgg

SEQ ID NO: 126668 - DNA, 625 bp, Homo sapiens
  misc_feature: GYAE6OF01C5NHF.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggtgagtcaggcattagctaatttttagctgtatcagcaagaaccagggaactcactacctcctgactctatcgactgcctatccgtctttagctaaacgtccgaacggggttccccaagttccgttccgggtttcaacggcggtactagggtaggaacgttccgtacgggaaccgtaaggtacggttacctacgttccgtaaccaacccgtaacttaccgacgtaccgacgcccttacggaccacggtccgttaggaaacgtagttcgttacgtacctaacgtttacttaccgtagtaactaaacgtagttaaactaaattacgttaccctaccgttaacttaccgttttacggaccgtaacggggaccctaaggtaccgtaacggagtagtaaacccg

SEQ ID NO: 126669 - DNA, 583 bp, Homo sapiens
  misc_feature: GYAE6OF01EAORZ.12.49.E05.1.454.CMB.1.raw
  modified_base (230)..(230): a, c, t, g, unknown or other
  misc_feature (230)..(230): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtcctccatcctccctgtctgcatctgtaggagacagagtcaccatcacttggccgggngagtcagggcatagctaatttttagcctggtatcagcagaaccagggaaagttccacacctcctgatctatgctgcactccgctttgcaatcgacggggtccctatcgtcgttcagcggcagtggatcgtagggacgagtacgttacactcacactactcgacgcaccgtcgtacgcgacgtccgtaggaacgtagttagtacgtaacctaacgttacttaacgttacgtaccgtaacgtaaacgtaagttaaacttaaacgttaaccttacccgttacccgttaacgtttaccgtttcgggaacccgggtacgggtaacccgtaaggtaccggtagggtacgtaaaacccgg

SEQ ID NO: 126670 - DNA, 603 bp, Homo sapiens
  misc_feature: GYAE6OF01B2QHQ.12.49.E05.1.454.CMB.1.raw
  modified_base (442)..(442): a, c, t, g, unknown or other
  misc_feature (442)..(442): n is a, c, g, or t
  modified_base (457)..(457): a, c, t, g, unknown or other
  misc_feature (457)..(457): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtcctgcatctggtaggagacagagtcaccatcacgttggccgggcgagtcgagggctattagacttaagtttttagctggtatcagacaagaaacgaggtaacttccactacctctagtatactatcgtactcgacctagttccgtctttcgactaaacgtcggtaacgggttcccctagttccgttacgggttcacggcggtacgtaggtcggtacgttcggtagggactagtacgttccacttctaccactancaggcacgcctgacngtacctagaagtcttggtactaccttaaacgttattaaccgataaactaaaggttacaacgttaccgtacccgttccccttacgtaccgttaccggacccggtaagtaacccgacggtacgtagggtaactacgtaacgtaaccgg

SEQ ID NO: 126671 - DNA, 603 bp, Homo sapiens
  misc_feature: GYAE6OF01CZIB3.12.49.E05.1.454.CMB.1.raw
  modified_base (329)..(329): a, c, t, g, unknown or other
  misc_feature (329)..(329): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtcctccatccctccctgtctgcatcgtgtaggagacagatccacctatcacgttcggccgggcgagtccaggggcattagacttaattttttagcctggtatcgagcaagaaaccagggaacgttccacacctctgactctatgctgctatccgtntttgactaagtccgacgggtcccatcgtcgttcgacggcgacgtaggtcgagtcgtacgggactaggtacgttctactcctacgaactactcgaagtccagcctgaccgtagcctaggaaacgtgttacggttagaaccctttaagtttagttaacgtacgtaaactaaaaagttaactaaaccgtacgttcccgtaccccccttagtaccccggttccggaaaccgtaacgggactaacccggagtagggtaactacggttaacgtaaaccgg

SEQ ID NO: 126672 - DNA, 498 bp, Homo sapiens
  misc_feature: GYAE6OF01B9A0X.12.49.E05.1.454.CMB.1.raw
  modified_base (400)..(400): a, c, t, g, unknown or other
  misc_feature (400)..(400): n is a, c, g, or t
  modified_base (449)..(449): a, c, t, g, unknown or other
  misc_feature (449)..(449): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagcctggtatcagcagaaaccagggaaagttccacacctcctgatctatgctgcatccgctttgcaatcagggtcccatctcgttcagcggcagtggatcgtgggacagagttcactctcaccatcagcagcctgcagcctagaagntgttgactaatttattactagtacaaagtataacacgtcgtcccccttnacccgttcggacccaagggacctacggacgtaggagtagtagtaaccgg

SEQ ID NO: 126673 - DNA, 711 bp, Homo sapiens
  misc_feature: GYAE6OF01CBNZJ.12.49.E05.1.454.CMB.1.raw
  modified_base (204)..(204): a, c, t, g, unknown or other
  misc_feature (204)..(204): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggganacgagacgtccaacctatcctacgttcgggccgggacgtacgtacggacgggactaagttacgtacttttaaagtttttacgccgttaggttactcgacgacgaaacgaaaccggaagggtaaccgttacccaacctaccctaccgtagtacttacttagtcgtcgtcgactacgttccgttcgtttacgaactaacgtaccggtaccgggttaccctacgttccgttacggtacgacgggtcggtacgtacggtaggtacgttcgggtacgggactaggttcgttaccaccttccgtacctaacctactacgaccgacgtaccgtccgtacgccgtaccgtaccgtaggaacgttgtttacgggtactaactttaaccgtttaatttaccggtagtaaaaccgtaaagttacctaacgtaccggttcccccttacccgttacccgtaccggttaccggaaccgtaaggacccacggttacgtagggaaccttagtaacggaaccgg

SEQ ID NO: 126674 - DNA, 556 bp, Homo sapiens
  misc_feature: GYAE6OF01CTN4J.12.49.E05.1.454.CMB.1.raw
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacngagtcaccatcacttgccgggngagtcagggcattagctaatttttagcctggtatcagtcaagaaaccgagggaacgttccacaccctctgatctatgctgcatccgtctttgctaatcgagggtcccagtctcggttcacgcggctagtggatcgtgggactaggtacgttcactctacaccatcagcacgctcgcacgcctagaactatcggttcgtactaactttagttacgtagtaacgtaaagttacgtaaaccgtacgtacccgtccccctttacgaacccgtttcccggaccggaacgggtaccgtaaccggtacgttaggaacgtaggttaacgtaaccgg

SEQ ID NO: 126675 - DNA, 560 bp, Homo sapiens
  misc_feature: GYAE6OF01EVWH8.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccggcgagtcagggcatagctaattttttagcctggtatcagcagaaaccagggaacgttccacacctcctgatctatgctcgctatccgtctttgactaagtcgacggggtcccagtcgtcggttacgagcggctaggtggacgtcgtcgggacagtacgttactacgtctacacctatcacgcagtcctcgcgtacgtccgtagaacgtagttcgtgtactaactttacttacgtacgtaactaaaagtactaaacgtacgttcccgtacccccttcgtaacccgttccggaaccgaacggacccgtaacgacgtaggaagtcgttaagtaaccgg

SEQ ID NO: 126676 - DNA, 557 bp, Homo sapiens
  misc_feature: GYAE6OF01EOSR0.12.49.E05.1.454.CMB.1.raw
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (425)..(425): a, c, t, g, unknown or other
  misc_feature (425)..(425): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagccttggtatcagtcaagaaaccgagggaaacgttccacacctcctgatctatgctgctactccgtctttgactaagtcgacggggtcccattcctcggttcacgcggcaggtggactcgtgggactagngttcactctcacnctacagccagcctgcacgcctagaagtnttgtgtactaactttagttctagtacaaaagttataaacgtacgttccgtacccccttacgtaacccttccggaacccgtaaggggaaccctaacggtaccgttagggaacgttaagttacggtaaacccgg

SEQ ID NO: 126677 - DNA, 702 bp, Homo sapiens
  misc_feature: GYAE6OF01B1JE9.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatccctcctgtctgcatctgtaggagacagacgtccaccatcacgttggccgggcgagtcgagggctagttagtactttaagtttttacgccgttaggtatacgagacgaaacgaaaccggtaagggtaaacgtccacctaccctcgtagtacttcttatcgtctcgacctacgtccgttcgtttacgactaacggttaccggtaccgggtccctacgttccgttaccggttcgacggcggtacgtaggtcggtacgttcgggtacgggactagggtacttaccgtaccttccgtaccgactacgtaccgacggccgaccgtcccgtaggacctacggtaccgtaaggtaacgttacgtttaggtaccgtaaccttaaacgttttacttaacggttactaaaacgttaaacgttactaaccggtaccgttccccgtacccccgtttacgtaccccggttaccggaacccgggtaaacgtaccgtaaccggtacggtaacggtaacggtaacgttaacgaacccgg

SEQ ID NO: 126678 - DNA, 586 bp, Homo sapiens
  misc_feature: GYAE6OF01ARL8G.12.49.E05.1.454.CMB.1.raw
  modified_base (435)..(435): a, c, t, g, unknown or other
  misc_feature (435)..(435): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtctccactcctcctgtctgcatctgtaggagacagacgtccaccatctacgttcggccgggcgagtcgagggctattagtcttaatttttcgcctggtatcagcaagaacgaggaactccactacctctagactctatcgctagctacgtccgtcttacgactagtcgacgggtccctagtccgtcggtcgacggtcggtcgtaggtggtacgtcggtagggactaggtacgttcaccttctaccactactcacgcacgtcngcacgcgtaagaacgtgttcgtacgtactaactttacgttactacgtaaactaaacgtactaaccgtacgtacccgtaccccttagtacccggttaccggaaccgtaacggtaaccgtacggtacggtaggaacgttacgtaaggtaaccg

SEQ ID NO: 126679 - DNA, 668 bp, Homo sapiens
  misc_feature: GYAE6OF01A76NV.12.49.E05.1.454.CMB.1.raw
  modified_base (237)..(237): a, c, t, g, unknown or other
  misc_feature (237)..(237): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (475)..(475): a, c, t, g, unknown or other
  misc_feature (475)..(475): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctccagataccagatgtgacatcgagatgacccagtctccatcctcctgtctgacattctgaggagacagacgtccaaccatcctacttcggacccggggngacggtcaaggggcctagttaaggtctaattttttacgccttggtaatccaaggcaaggaaaccgagggtaacttacccactaaccgtcctagtactactactgctgctactccgtgttagacctaagtcgacgggtccctatcgtcggttcacggngtacnggtcgtacgtcgtagggtacngggtaactttcgaccgtttacacctaaccgattacaaccggttcaacggttcccncgtaacgtaccgtaaccgtaaggaacgttacgttacggttacgttaacttaaccgtttaacgttaaccttacggttaaactaaaagttaacggtaaaccgttaccgtcccgttaccccttaacgtaaccggttaccggaaccggtaaacggacccgtacggtaagtacggtaacggttaacgtacggtaaccg

SEQ ID NO: 126680 - DNA, 586 bp, Homo sapiens
  misc_feature: GYAE6OF01E1WG6.12.49.E05.1.454.CMB.1.raw
  modified_base (438)..(438): a, c, t, g, unknown or other
  misc_feature (438)..(438): n is a, c, g, or t
tcagatacgacgtacacgaccggtgctcgatttagagcgactagcaacacacaaagggggcagaagtctctctcagtcaggacacagcatggacatgagggtccccgctcagctcctggggctcctgctactctggctccgaggtgccagatgtgacatccagctgacccagtctccatcctccctgtctgcatctgtagcagacagagtcaccatcacttggccgggacaagtcagaccatcagcagctatttaattggtatcagcagaaaccaggaaacgcccctaaggtcctagatctatgctgcatcctagtttgacgaaaggtcgggtcccagtcaaggttcagtggcgtaggtgggtcgtagggactaggtactttccacgttcctacctaaccattaccaggcctagtctcgaccctaaccgtagaaggtnttaccgtagacctaactttattacctacgtacaaacgacgtaacgttaacctaccgtttaccccctcccgttaaccgttcgggaccgggaaacggggtaccgtaaagggtacgaacgaacgtaaccgaaagtaccgtgtcgggtaccg

SEQ ID NO: 126681 - DNA, 876 bp, Homo sapiens
  misc_feature: GYAE6OF01DZ3P6.12.49.E05.1.454.CMB.1.raw
tcagatacgacgtacacgaccggtgctcgatttagagcgactagcaacacacaaaggggggcagaagtctctctcagtcaggacacagcatggacatggacgggtccctgctcagctccgtgggactcctgctgctcgtggcctccagactaccagatgtagacatcgagatcgaccctagtcctccactccctcctgtctgctatcgtggtaaggacgacaggactccaccgtactccgtacgttcgggcccggggacgacggtcggagggtactagttacgtaacttttaacgtttttacgaccgttaggtactacgacggtaaccggaaaacggaaaaccgggtaaacgggtaaaccgttaccccaacccgtacccgttccgtaacgtacgtttaccgttaacgtccgtaccgtacgtaccttaccgtttccgttaccgtttacggaaccgttaaacggttacccgggtaaccgggttcccctaacggtttcccggttacgggttaccggaccgggtacggtacggtacgggttacggttacggtccgggtaacgggaacgttacgggttaccgttaccgtaccccttaccgtaaccgaacccgttacgtacccggaacggtcccgtaccgttccggtacgaccggtaccgtaaccgtaaggtaacgttacggtttacgttaacctaaccgttttaaacgtttacgtttaacgttaacggtaaaaccttaaacggttaaaccttaccccggtaaccggttacccccgttaccccgtttaacccggtaaccccgggtaaccggaaccccgggtaaacgggaccccgttaacgggtacggtaaaccgggttaacgttaaccgtacgggtaaccgg

SEQ ID NO: 126682 - DNA, 684 bp, Homo sapiens
  misc_feature: GYAE6OF01ATNPM.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtctccatccctccctgtctgcatctgtaggagacagagtcaccatcacgttggccgggcgagtcgagggcattagtacttaattttttagccgttggtatcagacaagaaaccgagggtaacttccaccacctctgatctatgctgctacgtccgtctttagactaacgtccgtacggggtcccctagttccgtcggttacgacggtccggtacgtaggtcggtacgttcggtacgggacgtaggtacgttacctacccttccgtaccgaaccctagtccgacgtccgacgtccctcggaccgtacgtaccgtaggtaacgtagtttcggttacgtacctttaaacgtttaacttaaccgttacgtaaacctaaaacggttacttaaaccgtaccggttacccccgtaccccccgtttaccgtaacccccggtttaccgggaaccccgggtaaacgggtaacccgtaaccggtaccggtaagggtaacgttaacggttaacggtaacccgg

SEQ ID NO: 126683 - DNA, 741 bp, Homo sapiens
  misc_feature: GYAE6OF01C3C50.12.49.E05.1.454.CMB.1.raw
  modified_base (586)..(586): a, c, t, g, unknown or other
  misc_feature (586)..(586): n is a, c, g, or t
tcagatacgacgtacacgaccggtgctcgatttagagcgactagcaacacacgaaagggggcagaagtctctctcagtcaggacacagcatggacatgagggtccctgctcagcctccgtgggactcctgctgctcgtcggcctccagactaccagatgtgacagtcgagactacgacccagtcctccacttccctccctgtcctcgtactacgtcgtaggtaaggacaacgaagtacgtaccaaccactaccgtacgttcggaccggggacgtacggtacggacgggtactaagtttaacgttaaccgttttaagttttttacgccgttaggtactacgaacggaaccgaaacggtaaaccgaagggttaacctacccaacccgtacctaccgtagtacttacttacgtcgtcctacgtacgtaccgttccgttacgttacgaacgtaacgtccggtacgggtaccctacgttcccgttggtacgacggtcggacgttaggtacggtacgtaggtacgaacgttaggtctcctacgtccacctacctatcgacgccacgtacctcggactaacggtcgtaaggtnttaacggttccgttaacgttacttaaacgttttccaacgtttacgaaccttaaagttaactaaacgttaacttcccgtaacccgttacgttacgttaacggttaccggaaccggaacgggttacacgggttaccggaatacccgtaagtaaaccg

SEQ ID NO: 126684 - DNA, 832 bp, Homo sapiens
  misc_feature: GYAE6OF01AX3J1.12.49.E05.1.454.CMB.1.raw
  modified_base (209)..(209): a, c, t, g, unknown or other
  misc_feature (209)..(209): n is a, c, g, or t
  modified_base (241)..(241): a, c, t, g, unknown or other
  misc_feature (241)..(241): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggcctcccagataccagatgtgacatcgagatcgacccagtcctccactccctcctgtctgctatctggtagganacagacgtccactatctacgttcggccggganacgtcagaccatcacgctagtacttaatttaacgttggtatacacgtaacgaaacggaaacccggaacgggtaaacccgtaccccggttaacggtacccgtagtaccttaccgtagttcgtacgttaccgaccttacgtttacccgttaaggtttaccggtacggtaaacggggttccggggtacccctaagttaaccggttaacgggttacgtagggttcgggacgttacggggttcgggttaccgggtacgggtacgtacggtttacctttacccgtaacctttcccgtaaaccgaccgtaattacccggaacggtaccttaccgggttacctaaccgggtaaccgttaacccggtaagttaaccgtttacgtttacccggtaacgtttaacccctttaaagtttttacttaaacccggttaattaaccgtaacggttaaaccgttaccttaaacccggttacccgtttaacccccgttacccgggtaccgggtttaccggggaacccggggttaagggaaccccgggtaaagggtacccgtaaacgggtaccttaaacccgggtaaaccggttacggtcgggtaccgg

SEQ ID NO: 126685 - DNA, 710 bp, Homo sapiens
  misc_feature: GYAE6OF01CS7EN.12.49.E05.1.454.CMB.1.raw
  modified_base (231)..(231): a, c, t, g, unknown or other
  misc_feature (231)..(231): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctggtaggagacagactcaccatcacttcggccgggngagtcagggcattagctaattttttagcctggtatcagcagaaccagggaattccacacctcctgatctatgctcgcactccgtctttagactaacgtcgtacgggggttcccctagttccgttaccgggttacctacgggtaccgggtacgtaacgggtagggtacgttccggtacggggtacgtaacggtacggtttaccacctttccgtaacctaacccgtattacccaaggtcctaacggtccctacgtacccgacggtacccgtaggtaaacgtacgtttacggtttacgtaccgttaaacttttaacgtttaaccgtacgttaaacgtaaaacgtttaacttaaaaccgttacgttaaccccggttccccccctttaacgttaacccccggtttacccgggtaacccggtaaacggggtaccctaaccgggtaaccggttagggtaacgtaaccggttaaggtaaaccccggg

SEQ ID NO: 126686 - DNA, 834 bp, Homo sapiens
  misc_feature: GYAE6OF01B3HJV.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatccctcctgtctgcatctgtaggagacagagtcaccatcacttgccgggcgagtcgagggcattagctaatttttagcctggtatcagacaaggaaaccgagggtaaacgttccaacacctctgactctactgctgctatccgtctttcgactaaagtccgtacggggtacccctagttccgttcggttaccgacggtccggtacgtaggttacgggtacttccggtagggggtaacctaagggttaaccggtttacccgtaacccgttaccttacccgtaacccctaacgtacccgtaacggtaccgaaccggtcccgtaacgggcccgtaacccggtacccggttaaggaaaccgggttagtttacgggtttaacccggtaacccttttaaaaccgtttttaaacgttttaaaccgtaacgttttaaaaacccgtaaaaaaggtttaacccgttaaaaacccgttaacccgggtttacccccccgttaaccccccccggtttttaacccgttaaaccccccccggggttttacccgggggtaaaacccccggttaaaacccggggggtaaaccccgttaaaccgggttaaaccccgggttaaccgggggtaaaacggtttaaaccggttttaaacccgggggtaaaaccccggg

SEQ ID NO: 126687 - DNA, 514 bp, Homo sapiens
  misc_feature: GYAE6OF01CLU3S.12.49.E05.1.454.CMB.1.raw
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
  modified_base (434)..(434): a, c, t, g, unknown or other
  misc_feature (434)..(434): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagcaccatcattgccggcagtcaggcattagcaattttttagctggtatcagcagaaaccagggaaatccacacctctgatctatnctgcatccgtcttgcaatcaaggggtcccatctcgttnagnggcagtggatcgtgggacagagttcacttcncaccatcaagcagcctgcagcctagaanattgtanctaacttattactagtaacgaaaagtactaaacngttccgtacccccgttacacccgtttcgggacccgaaagggaccctaccggtactacggggaatagttaacgaaaccggg

SEQ ID NO: 126688 - DNA, 759 bp, Homo sapiens
  misc_feature: GYAE6OF01B85M9.12.49.E05.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtcctccatccctccctgtctgcatcgtgtagganacagacgtccaccatcacgttgccgggngagtcgaggctaagttagtacttaattttttacgccttaggtactcgaagacgtaaacggaaaccgaagggtaacgttacccaactaccctaccgtagacttctaagtcgtctagcctacgtccgttcttacgactaacgtccggtaacgggttccctaagttccgtacggttacgacggtcggacgtagggtcgtacgttcggtacgggactacgtacgttaccacttccgtaaccgaacctacgacgtaacgaccgtacgtcctacggacctaacggtcccgtaaggaacgttacgttacggtttaaccgtaactttaaactttaacgtttaacccgttaagttaaaaccggttaaaaaacgtttaaccgttaaaacccgttaaccccgggtttacccccgttaaccccccgtttacggttaaacccccggttacccgggtaaacccggaaaaccgggttaacccgtaaccggtaaacggttaacggggtaaacttaaacgggtttaaccggtaaaaccggg

SEQ ID NO: 126689 - DNA, 809 bp, Homo sapiens
  misc_feature: GYAE6OF01CURJJ.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggcctcccagataccagatgtgacatcgagatcgaaccccagtcctccacttccctcctgtcctgctatcgtggtaggagaactagatccacctatccacgttggccgggagagtcgagggtcagttagtcttaaagttttttagccgttaggtactacgagaccgaaacggaaaaccgaaggggtaaacttcccaaccgtacccgttaccctaggtacttaccgttaagtcgacctagacctacgtacccgtcttttacgacttaacgtaccggtaccggggttaccctacgttccggttaccggttaccgaacgggccggtaacgtacggggtagtacgttaccgggtaacggggtactaacgggttaccgtttaccaaccgtttccctaaccgtaaccctaagtacccgaacgtccgtaaccgtcccgttccgaactaaccggtaaccgtaggtaaaaccgtgtttacggtttaacgaacctttaaacgttttaacgttaaaccggttaactaaaccgttaaaaaacgtttacgttaaaccgtacccggttaccccgtttacccccccgttaaccgttaaccccggttacccgggaaaccccgggtaaacggaacccgtaaaccgggtaacggttaacgggtaaacggtaagttaacccgggtaaaacccgg

SEQ ID NO: 126690 - DNA, 647 bp, Homo sapiens
  misc_feature: GYAE6OF01EOCNH.12.49.E05.1.454.CMB.1.raw
  modified_base (204)..(204): a, c, t, g, unknown or other
  misc_feature (204)..(204): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatccctcctgtctgctatctgtagganacagacgtccaccatcacgttcggccgggcgagtcgagggtctagttagacttaatttttacgccgttaggtactcgaaggtacaaacggaaaaccggtaagggtaaacgttcccaaccgtacccttccgtagtacttctatcgtcctgactacgtccgttcttgactacgtccggtacgggtcctacgttccgtcggttacgacggtcggacgtaggtacggtacttacggtagggactaggtacgtttccctacttccaccaacgtactcgaacgcgaccgtcctaggccgtacgtaccgtaggaagtacgttcgttacgtaccttaaactttagttaacctaagtaaactaaaagttactaaaccgtaccgttacccgtaccccttacgtacccggttacggaaccgtaacggacctacgacgtagaatacgtacgaacg

SEQ ID NO: 126691 - DNA, 677 bp, Homo sapiens
  misc_feature: GYAE6OF01B5088.12.49.E05.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (231)..(231): a, c, t, g, unknown or other
  misc_feature (231)..(231): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtagganacagngtaccaccatcacttggccgggngagtcgagggcattagcttaagtttttacgcctggtatcagacaacgaaacgaaggggtaaacttcccgaacctacctcctgtaacttctatcgtctgactacgttccgtctttacgactaacgtccggaacggggtacccctagtttccgtaccgggttcgacgggtcggtaccgtaggtcgggtaagttccggtagggaacctaggtacgttacccgtacttccgtacaaccgtatccgacgtaccacgtcccgtgaccgacgtcccgtaaggtaacgtagtttaggtaccgtaacttaaccgtttaagtttaactacgttaaacttaaaagtaccttaaaaccgtccgttaccccttaccccgtttaccgtaaccccggttccggaacccggtaaacgggaccctacggtaacgtagggtaaactaaggttacggtaaaccgg

SEQ ID NO: 126692 - DNA, 731 bp, Homo sapiens
  misc_feature: GYAE6OF01DRRR1.12.49.E05.1.454.CMB.1.raw
  modified_base (559)..(559): a, c, t, g, unknown or other
  misc_feature (559)..(559): n is a, c, g, or t
tcagatacgacgtacacgaccggtgctcgatttagagcgactagcaacacacgaaagggggcagaagtctctctcagtcaggacacagcatcgacatgagggtccctgctcagctcctgggactcctgctgctctgctccagatacagatgtgactatcgagtatcgacccagtctccactcctccctgtctagctatctggtaggagacagagtaccacctatctacgttggcccggggagagtccggagggtctaagttacgtatttaacgttttttacgccgttaggtactcgaaggtacgaaacggtaaacccggtaaggggtaaaccttaccaaccgtaccctaccgttagacttacttacgtgtacccggtactacctacgtttccggttcctttagaaccgttaaacgggttccggtaccgggtttaccctacgtttccggttacccgggttagaccgggcggtacggttacggtagggtacgttcgggttaccgggaaagtaacggttccgttaactaaccctcgttaaccaaccgattacgacggtaccncgtcgtacgcaacgtactaaggtactcgttacggtacctaactttaacttacgttacggattaaaaaccggtaaacttaccgtaacgttacccggtacccgttccccttaacgtaccggtaacggaccgaaaccgggttcgagtaccgtagggaacttagtaacggtaccgg

SEQ ID NO: 126693 - DNA, 655 bp, Homo sapiens
  misc_feature: GYAE6OF01A23JH.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttggccggcgagtcgagggcattagactaatttttagcctggtatcagtcagaaaccgagggtaaacgtccacacctcctgatctatcgctgctacgtccgtcgttgactaagtccgacggggttacccagttccgtcggttacgacggcggacgtaggtggtacgtcgtacgggacgtaggtacggtttacacccgttactaccaaccgtacttaccgagtccaacggtccctacggaccgtacggtccgtacggtaagtacgttggttaccgtaaccttaaacgttttacttaacgttacgtaaacgtaaaaacgttactaaaccggtacgttaccccgttaccccctttaccgtaccccggtttaaccggacccgtaaacggggtaacgtaacccgtacggttagggtaacgtaacggttaacgtaaacccgg

SEQ ID NO: 126694 - DNA, 673 bp, Homo sapiens
  misc_feature: GYAE6OF01DEKN0.12.49.E05.1.454.CMB.1.raw
  modified_base (382)..(382): a, c, t, g, unknown or other
  misc_feature (382)..(382): n is a, c, g, or t
  modified_base (493)..(493): a, c, t, g, unknown or other
  misc_feature (493)..(493): n is a, c, g, or t
tcagatacgacgtacacgaccggtgctcgatttagagcgactagcaacacacgaaagggggcagaagtctctctcagtcaggacacagcatggacatgagggtccctgctcagctccgtgggactcctgctgctcgtggcctcccagactaccagatgtgacatcgagatcgaccagtcctccactccctcctgtctagcacttcgtaggtaacggacaacagtacgtaccacctataccgtaccgttcggacccggggagtacggtacgaacgggactaagttacggactaagtactttaaagttttaagttcggtatacgaacgaacgaaaccgaaaaccgaggaaaccctcccgtaacgtcctagacttcagtcgtctnaccgtattcgtaagttacggaagtaacggtcggacctagacgtacgtcgaggtcgagtcgggttgtcggtaggactacgtacttcgtaccgtctacaacctcgtacgtacncgtacgtcgtaccgacgtaacgagtaatcgttactctaaccgttacttacgttactaagtaactaactaagtaacttaaagtaccttacccgtaccgttaacgttaccgtttacggaaccggtaacggtaacgacggttacggtaacgtaacgttaacaacggtaaagtaccggttacgg

SEQ ID NO: 126695 - DNA, 540 bp, Homo sapiens
  misc_feature: GYAE6OF01D2YWA.12.49.E05.1.454.CMB.1.raw
  modified_base (228)..(228): a, c, t, g, unknown or other
  misc_feature (228)..(228): n is a, c, g, or t
  modified_base (356)..(356): a, c, t, g, unknown or other
  misc_feature (356)..(356): n is a, c, g, or t
  modified_base (473)..(473): a, c, t, g, unknown or other
  misc_feature (473)..(473): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggngagtcaggcatagctaatttttagctggtatcagcagaaaccaggaaagttccacacctcctgatctatgctgcatccgctttgcaatcagggtcccatctcgttcagcgcagtgatcgtgggacagngttcactctacaccatcagccagcctgcacgcctgaaagtcttagttacgactaaactttacttaacgtacgttaacaaaaagttactaaacgtaccggttcgtaccccccctttanaccccggtttaccggaacccgtaaagggaacctacggtaacgtaggaagtagttaacggtaaaaccg

SEQ ID NO: 126696 - DNA, 909 bp, Homo sapiens
  misc_feature: GYAE6OF01B9BRL.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctccgtgggactcctgctgctctggcctcccagactaccagatgtagacatacggagactcgaccctagtcctcctacttccctcccgttgttccgtgacctagttacgttagggtaacgggaagtaacgaggtaaccgttaccaacctacgtttccgtaaccggttcgggggacccggggacggtacggtaccgggtaacgggtaccttaacggtttaacgttaaccgtttttaacggtttttttaccggcccggtttaaggttaccgtaaccgaacggttaaccgaaaaccggggtaaaaacccggttaaacgggggttaaaaccctttaccccaaaccctttaacccccggttcgttaacggtaccgtttacttaacgttcggtcccgtacggtacccttacgtttcccgttcgtttacgaacccgtaaacggtcccggttaacccgggttacccgtacgttccggtttccgggtacgaccggggtacggtacggttacgggtacggttccgtaaccgggtaggggtaaccttacgggttacttacccgtaccttccgtacccgtaacttcgtaacgccggtacctaccgttacccgtacgtaaaccttaacgggtaagttaaccgtttagttaaccggttacttaaaccgtttaaccgtttactaaaccggttaacgttaaacctaaaggttccctaaacgttcccgttaccccctaccgttaccgacccggtaacggaccgggtaaccaacggtaccgtaggaacggtacttaacggtaacggcgtaaccgg

SEQ ID NO: 126697 - DNA, 736 bp, Homo sapiens
  misc_feature: GYAE6OF01DVP8C.12.49.E05.1.454.CMB.1.raw
  modified_base (179)..(179): a, c, t, g, unknown or other
  misc_feature (179)..(179): n is a, c, g, or t
  modified_base (528)..(528): a, c, t, g, unknown or other
  misc_feature (528)..(528): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggcctccagactaccagatgtgacatcgagatcgaccctagtccnccactccctcctgtctgcatcgtaggtaggacacaggactccaaccattccacggttcggcccggggagtacggtaccgagggtactaattacggtacttaacgttttttacggcccgttaggtataccgaacggaccgaaaacggaaaacccggaagggggttaaaaccttaccccgaactaccccgttaccgtacgtacttacctagtcgtacgtcgaccttacgtcccggttctttacgacctaaacgtaccggtacgggtacccctagttccgttccggttcgacggtcggtacgtaggtcgtacgtccgtagggactacgtacgtcctacctcgtacctaccancgacgtaccgaccgtctacgccacgttaccggagtaacgttgttacggttacgtaacctttaaattaccttaccgttaataaaccgttaaaagtaacttacccgtaacggttacccccgtacccgttaccggttaacccggtccggaaaccggaccggaacggttaaccgtacggtaacggttaacggaacgttaaccgggtaaaccg

SEQ ID NO: 126698 - DNA, 783 bp, Homo sapiens
  misc_feature: GYAE6OF01BTVXW.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagtatcgacccagttcctccactcctcctgtctgctatctaggtacggagtacagtacgtaccacctattccacgttcgggcccgggtacgtacggtacgacgggtactaagttacgtactttaagtttttacgccttaggtactacgtacggtacaaacggaaaccggtaagggttaaaccttccccgaactacccgttacctagtactacgttagttcgaccttgaccgtacgttccgttacgttacgacgtaacgtaccggtaccgggtacccttacgttccgttaccggttacgacgggtccggacgtacggtacggttacgttcgggtacgggaattacggttacgttaccacccttaccgtaaccaccgtactaccgggtagaccgtcggccccgttacggacggtaacccgtcggttaacggtaaacgtttgtttaaccgggtccttaaacgtttaccccgtttaagttacccgtaagttaaaccttaaaacggttaacgtaaccgtacccgtttacccccgtacccctttaccggtaaccccgggttacccggaaacgggtaaacccggtcctaaacccgggttaggtaccgaacgttaaacgtacggtaaccg

SEQ ID NO: 126699 - DNA, 836 bp, Homo sapiens
  misc_feature: GYAE6OF01CJTIX.12.49.E05.1.454.CMB.1.raw
  modified_base (213)..(213): a, c, t, g, unknown or other
  misc_feature (213)..(213): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtcctccactccctccctgtctcgctactcgtggtaagganacagtaccgtaccacctactcaccgtcggccggcgacgtcgaggtactagttacgtacttaagtttttacgccgttaggtacttacgacgaccgaacggtaaaaccgaacgggttaaccgttaccctaacccgttacccgttaccgtagtaccttaccgttacgtacggtacctacgaccttaccggtttcccgttacctttacggaaccgttaacgtcccgggtaacccggggttaccccttaccgttacccggttacccgggttaccgtacgggtaccgggttacggtagggttacggtaccggttacgggtacgggtacgtacgggttaacggttaccctacccgttaccgtaacccaaccgttactaccgtaacggacccgtaccggtaccgtaccgacgtacggtaacccgttaggtaacgttacggttacttaccggttaaccctttaacgttttaaacttaccgggttaattaaaaccgttaacgttaacgttaaacgtaccccggtttaacccgtcccccgtttaaccgtttaccccggtaaccgggaaccgggttaaacccggacgttaaccgggtacgttaacgggtaaccggtaagttaacccggtaaacgg

SEQ ID NO: 126700 - DNA, 673 bp, Homo sapiens
  misc_feature: GYAE6OF01EF0N2.12.49.E05.1.454.CMB.1.raw
  modified_base (232)..(232): a, c, t, g, unknown or other
  misc_feature (232)..(232): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtctccatccctccctgtctgcatctgtaggagacagagtcaccatcacgttggccgggngagtacgagggactattagtacttaattttttacgccgttagtatcagacaagaaaccgagggtaaacgttccacacctctgatctatgctgctatccgtctttacgactaacgtcggtaacggggtccctaacttccggtccggttacgacggtccggcgtaacgtgggtacgtcggtacgggactagtacgttacctacgttcctacctaacccgtatacccgtagccgtaacggcccttaggaccgtacgtaccgtaacggtaagtaacgtttacggttacgtaaacctttaaccgttttaacttaacggttaacgttaaacgtaaaaaccggttaaacttaaccggttaacgtaccccgttacccccttaccgtaacccgttccgggaccgtaaacgggaccgtaacggtacgtaggaagttacgtagggtaaaccg

SEQ ID NO: 126701 - DNA, 721 bp, Homo sapiens
  misc_feature: GYAE6OF01COOCC.12.49.E05.1.454.CMB.1.raw
  modified_base (187)..(187): a, c, t, g, unknown or other
  misc_feature (187)..(187): n is a, c, g, or t
  modified_base (478)..(478): a, c, t, g, unknown or other
  misc_feature (478)..(478): n is a, c, g, or t
  modified_base (532)..(532): a, c, t, g, unknown or other
  misc_feature (532)..(532): n is a, c, g, or t
  modified_base (549)..(549): a, c, t, g, unknown or other
  misc_feature (549)..(549): n is a, c, g, or t
tcagatacgacgtacacgaccggtgctcgatttagagcgactagcaacacacgaaagggggcagaagtctctctcagtcaggacacagcatggacatgagggtccctgctcagctccgtggactcctgctgctctggcctcccagactaccagtatcgtagacagtgagattcgaccctgtcctccncttcccctccgtgtctcgacatgtaggaggagacaggttaactcaaccgtatccgtacgttcggggccgggacgtagtaccggaagggtcctaagtttacggtactttaagttttttacgaccgttggttactacgaacgaccgaaacggaaacggtaacgggtaaccttcccaaccttaaccgtcctatacttacctatcgtaccgttacggctaaccggttccttaggtttacaaccgtaacggtccggtaacgggtacctacggtccgtttacggtcaccgggttcgngttaggacgtacgttcgacgggtaagacgttaccttcaaccttccgactaacgngaccacggactcgcgtnacccgttagtaccaaggttataaccgggtttctaactaaccgtttaaatttactacggttaactaaaagtaccgtttaacaccggtcccttccccgtacccgtttacgacccggttagaacccgggaacttccggaaacgtttcaagggtaccttaagggttaccccgtaag

SEQ ID NO: 126702 - DNA, 698 bp, Homo sapiens
  misc_feature: GYAE6OF01ALLTF.12.49.E05.1.454.CMB.1.raw
  modified_base (465)..(465): a, c, t, g, unknown or other
  misc_feature (465)..(465): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtctccactccctccctgtctgcatcgtagtaggagacagcgtcaccatcacgttggccgggcgagtcgaggctagttagtacttaattttttagccttggtactcagactaacggaaaccgagggtaacgttaccaacacccttactagtactcgtaactgtcgtcgactacgtccgttctttacgactaacgtacggtaccgggttccctagttccgttcggttcacggtcggcgtaggtcggtactcggtaggactagtcgttacacctcgtacctacacgtacaccgcncgtcctcgacgtacgaccgtaagtaacgtacttacggttacgtaacttaaaccttttacgtttaactaacgttaaaacttaaacggttaaccgttaaaccgtacccggtttacccccgtaccccccggtttaccaaacccccgggttacgggaaaccccggttaaacgggaaccgtaacccgggttacggtaaacgggttaaacggttaaccgggttaaacgtaaacccgggg

SEQ ID NO: 126703 - DNA, 834 bp, Homo sapiens
  misc_feature: GYAE6OF01ERRLH.12.49.E05.1.454.CMB.1.raw
  modified_base (125)..(125): a, c, t, g, unknown or other
  misc_feature (125)..(125): n is a, c, g, or t
  modified_base (163)..(163): a, c, t, g, unknown or other
  misc_feature (163)..(163): n is a, c, g, or t
tcagatacgacgtacacgaccggtgctcgatttagagcgactagcaacacacaaaggggggcagaagtctctctcagtcaggacacagcatggacatgagggtcctgctcagctcctgggactcngctgctccggctccagactaccagatgtgacagtcganagtcgaccctagtcctaccacttcccgtcctgtctcgactagttcgtagggacgacgacgacggtacaccaccgtactccgtacggttccgggaccggggacggtacggtacggacgggtacttaacgttacgttaacttttaacgtttttcgaccgttaaggttactaccgaacggaaaccggtaaaaccgggtaaaaccggtaacggggttaaacccttacccgtaaccccgtccgtttaccgtacgtactttacgtagtcgtctacgtaccttccgttccgttacgttacgaaccgtacgtacccggtacggtactcgttcggtcggtacgacggcggtacggtgtacggtcgttaggggacgtacgtacggttacgtacctaccgttcgtaaccactacggtaccgaccgtaccggtcgtcccgtcgaccgtaagtcccgggtaaagcggtttaccgttaacggtaaccgtttaaccttaacggttttaaccgttaaagtaaaccgttaaagtaaaccgttaccgttaacccggttacccgttacccccgtttacccggtaaccgtaaccccggggtaaccgtaaacccggggaaccggttaaccggttacggtaacggggtttacgttaaaccggttaaacccgggttaacggacggtttaccggg

SEQ ID NO: 126704 - DNA, 663 bp, Homo sapiens
  misc_feature: GYAE6OF01C8UFX.12.49.E05.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (328)..(328): a, c, t, g, unknown or other
  misc_feature (328)..(328): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtctccatcctcctgtcngcatctgtagganacagagtcaccattcacgttcgccgggngagtcgaggctattagcttaatttttacgcctggtatcagacaagaaaccgaaggaacgttccactacctctagactctatcgctcgcacgtccgtntttcgactaagtccgtacgggtcctagtccgttacggtcgacggcggtcgtaggtggtacgttcggtacgggtactaggttacgttaccgtaacccttcgtacctaacccgtacgttaccacgtacccacgtccgttcggaccgtacgtaccgtaggtaagtacgtttacggttactaaccttaaacttttaacttaacgttacgtaaaacgttaaaacgttaactaaaccgtaccgttaccccgtacccccgtttaccgtaccccgttaccgggaacccggtaaacgggaaccctaaccggtaacgtagggaaacctagttaacggtaaaccgg

SEQ ID NO: 126705 - DNA, 756 bp, Homo sapiens
  misc_feature: GYAE6OF01A1FDY.12.49.E05.1.454.CMB.1.raw
  modified_base (422)..(422): a, c, t, g, unknown or other
  misc_feature (422)..(422): n is a, c, g, or t
  modified_base (577)..(577): a, c, t, g, unknown or other
  misc_feature (577)..(577): n is a, c, g, or t
tcagatacgacgtacacgaccggtgctcgatttagagcgactagcaacacacgaaagggggcagaagtctctctcagtcaggacacagcatggacatgagggtccctgctcagctcctgggactcctgctgctcgtggcctacccagactaccagatgtagacagtacgagactcgacccagttccacctactccccgtcccgtaggtctacgacctattccgtaggtaggacgtaccgtaggacctaccaacctattaccgtacggttccgggaccggggtacgtaacggtcgacgggtacgttaacgttagtactttaagtttttacggcgttagtactacgagaacgtaaacggaaacggtaacggtaaccgttacccaaccgttaccgtactacgttactaccgttacgtaggtaccncgggttacctacgttccgttagtttacgaaccgtacggtaccgtaaccggtccgttaactccggtttacggtaccgcgggtacgacggttaggtacgttaccgtagggtacgtactagggttactaccgtaccgtcctaacgacctagtacccgngtacctacgccgtacaacccgtatcgaccgtaattacgggtactaacggttaccgttaattacgttaacgtactaaacggttaaatacgttacccggtacttacccgtccccgttagaacccggttacgaacccggaacgtaccgtaggtaacgtacgaacggttaccgtaaggtaccg

SEQ ID NO: 126706 - DNA, 792 bp, Homo sapiens
  misc_feature: GYAE6OF01DW533.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggcctcccagataccagatgtgacatcgagatcgacccagtctccatcctccctgtctgctatcgtagtacggagactagacgtccaccatcctacttgggccgggtagacgtcgacgggtactaagtttaagacctttaaagttttttacgccgttacggtaatacgaacggaacgtaaacggtaaaaacccggtaaggggtaaacctttacccaactacccgttccctagacttacgtatcgtactcgactcgtccgttactttacgacgtaacgtccggtaccgggtccctaagtttccggtaccgggttcgaacgggtcggtacgtagggttacgggtacttaccgggtacggaacggtaaacgggtttacttccgtaaccgttccctaaccaaaccgtactaaccgcgtacccgacgtaccgtcggaacgtacggtacccgtaaggtaacgtcggttacgttaaccggtaaccttaaacgttttaacggttaacttaaccggtaaacgttaaaaacgttaaccgtaaaccgttacccgtccccccggtttaaaccccccgttaccttaccccgggttaaccgggaaccccgggtaaaacggttaacccggaaacgtaccgggtaagtaacggttaaacctccgggtaaaaccg

SEQ ID NO: 126707 - DNA, 840 bp, Homo sapiens
  misc_feature: GYAE6OF01ADHLW.12.49.E05.1.454.CMB.1.raw
tcagatacgacgtacacgaccggtgctcgatttagagcgactagcaacacgacaaagggggcagaagtctctctcagtcaggacacagcatggacatgagggtccctgcctcagctcctgggactctgctgctctggctcccagataccagactgtgacatcgagatgacccagtcctccatccctcctgtctgcatctggtaggagacagacgtccaacctatccacgttcggccgggcgtaggtcgaggggtctagttacgtactttaagttttttacgccgttggtactacgtagaccgaacggtaaaacccggtaaggggtaaaccgtttaccccaaccgtacccgttaccgttacggtaacttaccgttaacgttcggtccgtttaccggacccgttaaccgttttccccggttaccgtttttacggaacccgttaaacggttaccccgggtaaccggggggtttaccccctaacggtttcccggtttacccggggtttaccgaccggggtaccgggtaccggtaacggggttcgggtaacgttcgggtacggggtaacgtaacgggttaccgtttaccacccgtttacccgtacccgtaacccgtacgtccgaacggtccgtaccggtcccgttacggaccgtacggtacccgttagggaacgttacgttacggttacgttaaccttaacgtttacttaaccgttaagttaaccgttaaaacggttctaaaccggttaccgtaccccggttacccccttacggttaccccggttaccggaaccggtaacggtaccgtacggtaccgtaaggtaaccgttacgtacggtaaccgg

SEQ ID NO: 126708 - DNA, 884 bp, Homo sapiens
  misc_feature: GYAE6OF01AVMP1.12.49.E05.1.454.CMB.1.raw
  modified_base (156)..(156): a, c, t, g, unknown or other
  misc_feature (156)..(156): n is a, c, g, or t
tcagatacgacgtacacgaccggtgctcgatttagagcgactagcaacacacaaaggggcagaagtctctctcagtcaggacacagcatggacatgagggtcctgctcagctcctgggactctgctgctctggctccagataccagactgtgaacntcggagactcgaccctagtctccacttcctcctgtctgctacttcgtggtaggactacgagtctacctaacgatcgaacgttcggccggggacgtacgtcgacgggtactagttacgtacgtttaactttttacggccgttaggtacttcgaacgtacgaaacgtaaaccgtagggtaaacgtttacccaccgtaccctaccgtaggtaacttacgtaacgttcggacctttacggaccttaccgttaccggttaccgtttacgtaacgttaacccggttaacccggtacggggtttaacccccgttaacggtttcccggtttacgggttaaaccgtccgggttacccgggtaaaccggttacgggtttacccgggttaacgttaccgggtttacggggtaaacccgtcggggtttaaccgttttaccgggttaacccctttaaccggtaacccgtaaacccggttttaacgtacggaccgggttaaccgtacccggttacccggttaccgaaccggttaaccgtaccgttaacgaacgggtttaaccgtttacgggttacccttaaacgtttaaaccgtttacgtaacgggtttacttaaaccgggtaaaaacttaccggtaaaccgtttaaccgttcccggttacccctttacgtacccggtacccggtaacgaaaccgggtacttaaccgggacttaacgggacgtaaacgttccggtaaacggg

SEQ ID NO: 126709 - DNA, 842 bp, Homo sapiens
  misc_feature: GYAE6OF01EYO13.12.49.E05.1.454.CMB.1.raw
  modified_base (630)..(630): a, c, t, g, unknown or other
  misc_feature (630)..(630): n is a, c, g, or t
  modified_base (819)..(819): a, c, t, g, unknown or other
  misc_feature (819)..(819): n is a, c, g, or t
tcagatacgacgtacacgaccggtgctcgatttagagcgactagcaacacacgaaagggggcagaagtctctctcagtcaggacacagcatggacatggacgggtccctgcctcagtcctccgtgggacctccgtgcctgtccttcgtcggacctcccaagaactacccgaagtcttgcgaactagtccgaagtactaccggaaccctagttccctaccctacgttccccttccccgttgtcctacgtactacgttacggttaggtaagggtaaccaactacggaacctaccacctaacgtccgttaacggttccgggaccgggtacgtaacgtccggtaacggtacctaagtttaaccggtacttttaacgtttaccgacgttaggtaactccgaagaaccgtaagaaaccgtacggtaaacctcccgaacttccgtacgtagttactaactcgtatccgacggtacctaccggttactaacgttacgtaaccacggttaccggggaccctttaccgtaaccgtccccggttaggtaccggaacgtaccggtacgttaaaccgggtggtaaccgtagggtaaccccgggtaattaccgggtacttaccctaccgttacccgtaacccgntttaaaccgcgttaccgaaccgtcgacgttaccgtaacgaccggtttaccgaaatttcgggtaacttccgggttaaataaccgttaaaccgtttagttaacgaactaaaacggttaacgtacctccttaccggttaaccccaccgttacccggtaacggtacggaaacttacccggacttacgggttanaataacggtaggtactaaacggg

SEQ ID NO: 126710 - DNA, 673 bp, Homo sapiens
  misc_feature: GYAE6OF01DMFS7.12.49.E05.1.454.CMB.1.raw
  modified_base (404)..(404): a, c, t, g, unknown or other
  misc_feature (404)..(404): n is a, c, g, or t
  modified_base (502)..(502): a, c, t, g, unknown or other
  misc_feature (502)..(502): n is a, c, g, or t
  modified_base (523)..(523): a, c, t, g, unknown or other
  misc_feature (523)..(523): n is a, c, g, or t
  modified_base (533)..(533): a, c, t, g, unknown or other
  misc_feature (533)..(533): n is a, c, g, or t
tcagatacgacgtacacgaccggtgctcgatttagagcgactagcaacacacgaaagggggcagaagtctctctcagtcaggacacagcatggacatgagggtccctgctcagctcctgggactctgctgctctggctccagataccagatgtgacagtcgagatcgaccctagtcctaccactcctccctgtcctgcctattcgtagtaggaacgacagtacgtccaaccattccgacgtttgggcccggggacgtacggtcgacgggtcgtaatttactactttaagtttttttacgcccgttaggttactacgacggaccgtaaacggaaaaccgtaaggggtaaaaccttccgaacctaacccgtcctagtacttactagtcgcgtcgcctacgtccgtntttagaccttaagcgtacgggtcccagttccgtcggtcacggcggtcaggtgtacgtcgtagggactaggtactctactcacctacgatcgagcctcnctgcacgtacctagtaacgtnttacggttanacgttaactttattaaccgtagttaaactaaaacgttacgtaaccgcccgttacccttacccccggtacttaccggttaccggaaacccgggacgaccgttaaaccggtacgaggggttacttaacgtaccgtaaccggg

SEQ ID NO: 126711 - DNA, 852 bp, Homo sapiens
  misc_feature: GYAE6OF01EM8U0.12.49.E05.1.454.CMB.1.raw
  modified_base (571)..(571): a, c, t, g, unknown or other
  misc_feature (571)..(571): n is a, c, g, or t
  modified_base (578)..(578): a, c, t, g, unknown or other
  misc_feature (578)..(578): n is a, c, g, or t
tcagatacgacgtacacgaccggtgctcgatttagagcgactagcaacacacgaaagggggcagaagtctctctcagtcaggacacagcatggacatgagggtccctgctcagctcctgggacctcctgctgctctcgcctccagactaccagatgtacgactagtcgagtactaccgaccctagttcctacctactccccttccctagttcgtacgtacctagttcgttacggtaagggacgaaccgtagacgttaccaacctacgtccgtacggttccgggccgggacgtaggtacgacgggtactagttacgtacttttaagttttacgccgttaggtacgtcaacgacaaacggaaccggtaagggtaacctccaacctacccgttactacgtaacttcgtactcggtactacgtactaccgtttccgttacgttacgtaaccgttaaccggttacccgggtaccgggtttaccctaccgtttaccggtttaccgtacggtaaccggtcggtaaccgtgggttcggtaacgtcgggtagtaacgtagttcttaccgtacttaccacncgtaacncgacgtaaccgtcgtaccgtacgaccgtacggtacttaaggtaaccttaggttaccgttaaccgtaaccgttttaacgtttaaaccgttaacgttaaaacgttaaaccggtaaaaccgtttaaaccgttacccggttaacccgttaccccccggttttaccccgttaaccccggttaaccgggttaaaccccgggaaacccgggttaaagggtaaccccggtaaggttaacccgtaaggggttaacccgttaaacgtaaggggtaaaccccggg

SEQ ID NO: 126712 - DNA, 733 bp, Homo sapiens
  misc_feature: GYAE6OF01AZH28.12.49.E05.1.454.CMB.1.raw
tcagatacgacgtacacgaccggtgctcgatttagagcgactagcaacacacaaagggggcagaagtctctctcagtcaggacacagcatggacatgaggtccctgctcagctcctgggacctcctgctgctctggcctccagactaccagtatgtcgactagtcgagatcgaccctagtcctaccacttccctcccttgtcctgacctattcgtaggtaggactacgacgacgtccacctatccgtacgttcggacccggtacgtaacgtcggaggtacttaacgttacgtacgtttaagtttttacggccgttaggtactacgacgtaccgaacggtaaaccggaacggtaaccgtacccgtaggtacctagacgttactagtacgtcgtacgacttacgttccgttaggttacgacggttaacggtacggtaccctaggtaccgtagggttacgtagggtcgtacggtagggttcggtacgtaggtacgtacttacgttaccgtcgttacctacgtaactacgtacacgtaccgtacgttacgtaccgtaaccgtaacgtacggtacttcgttaccgtaacgttaacctaacgtttacgttaccgtaacgtaacttaacgtacgttaacctaccggttaccccttacccggttccgtacggtaccgtagtaacggtacggtaccggtaggtaccgacgtaaccgtaacgaaccggtcttcggcgttaacc

SEQ ID NO: 126713 - DNA, 768 bp, Homo sapiens
  misc_feature: GYAE6OF01BXGFH.12.49.E05.1.454.CMB.1.raw
  modified_base (204)..(204): a, c, t, g, unknown or other
  misc_feature (204)..(204): n is a, c, g, or t
tcagatacgacgtacacgaccggtgctcgatttagagcgactagcaacacgacaaaggggcagaagtctctctcagtcaggacacagcatggacatgagggtcctgctcagctctgggactcctgactgctctggactcccagataccagatgtgacatcgagatgacccagtctcatcccgtcctgtctagcatctgtagganactagacgtcaccatcacttggaccggtcgagtcgagggctattacgtacttaattttttacgccttaggtaactccgaacgtacgaaggaaaccgtaggggtaaactttacccaacgtacccttaccgtacggtaacttaccttaacgtcggtacctaggtacctaacgtttccggtactttacggacctaaacgttcggtaaccggggttccctaacgttaccggtttccggggtactaccggtaccggtaccgtaggttacgggacgttaccggttaggggaacctacgggttaacttccgtaccgttaccgttaccaaccgtacggttacccaacgggtccacgggtacccgtacgtaaccgaccggtaccgtaggtaaacgttacgttacggttaccgaaacccgttttaacgtttaactttaacggaccgttaaacgtaaaacgtcttaaaccgtaccggttaacccgttcccccgtttaacgtaacccggttccgaacggtaaacccgggacgaacccgtaacgggttaaccgtaacgtaaacgtttccggaaaccg

SEQ ID NO: 126714 - DNA, 876 bp, Homo sapiens
  misc_feature: GYAE6OF01A0PWI.12.49.E05.1.454.CMB.1.raw
  modified_base (679)..(679): a, c, t, g, unknown or other
  misc_feature (679)..(679): n is a, c, g, or t
  modified_base (701)..(701): a, c, t, g, unknown or other
  misc_feature (701)..(701): n is a, c, g, or t
tcagatacgacgtacacgaccggtgctcgatttagagcgactagcaacacacaaagggggcagaagtctctctcagtcaggacacagcatggacatgacgggtccctgctcagcctcccgtgggacctccgtaaaagctgcctcgtcggcctcccgagactaccgagactgtgacagtcgagtatccgaccctattccctcctaccttcccttccccgttgtcctcgtactaccgttcgtaggtaacggacgtacgagtaccgtacctaaccctagtacgtccgggttcggggaacccggggtacctaacgggttaccgaacggggtttacccgttaagtttaacgggtttaacccttttttaaaaggtttttttccggacccggtttagggtaaccttacggtaacgggaaaccggtaaaaccggtaaaaaccggggtaaccgggtttaaaacctacccccttaaccgttaaacccggttcctttaaaggtacccttttaaccgtagaccggttaactccggttaaccttccgtttaaccgttacgtttacaaccggtaacgtaccgggttcccggtaaaccttcgttaccgttcgggtaacgtccggtacgttcgtagggtcgttacgtacgcggtaaccgtagtacttccgtaacctcggtaaccatccgacgtcncaccggtcgactacgtccgacnggtttaacccgaggtttaccaccggttaacttacgttaactaccgttaagaaccggtttaaacacggtccctttaaaccggccccttaccccggtaacccttaacggtaccccgggagttaacgtaccccgggtaacttacgtaaacccggtagaaacccggtttgaaacccggg

SEQ ID NO: 126715 - DNA, 868 bp, Homo sapiens
  misc_feature: GYAE6OF01EB4CM.12.49.E05.1.454.CMB.1.raw
tcagatacgacgtacacgaccggtgctcgatttagagcgactagcaacacacgaaagggggcagaagtctctctcagtcaggacacagcatggacatggacgggtccctgctcagctccgtggactcctgctgctctggcctaccagactaccgagattggtcgaaccagtcggtagacgtaccgacccctagttcctaccctacttccccttcccgttgtcctgctagttcgtaggtaacggaagtacaaggtaccgtacctaaccgtatccgtacggtttccggggccgggtacgacggtaccgtacgggtaactttacgtaacgttaacgttttaacgtttttcggaccggtttagtactaccgtaacgaaccgtaaaccgggtaaaaccgtacgggtaaaccgttaccccgaaccttacccgtacgttacgtacttaacgtacgttacggccttacggtccgttaaccgtttccgtacgtttaccgtaacggtacgttacccggggtaaccggttaccccttaggtttacccggtacgggttacgacgggtccgtaaggttaccggtacggttaacgtccgggttaacgggtaccgtttacggtaccggtttaccctaaccggttacccgtaacccggaacgtttacccgtaaccgcgggttaaacctccgggttaccgaccgtacccgtacgttaacggtaacgttacgggttactacggtaacgtttaaccgttactttacggttactaaggtaacgtaacgtaacggtccgtaaaccgttcccttacccggtaacggtcccgtaacgggacctacgggtaaccctacggtaaccttagggaaacttcgtaaccgtaccggg

SEQ ID NO: 126716 - DNA, 670 bp, Homo sapiens
  misc_feature: GYAE6OF01CULXX.12.49.E05.1.454.CMB.1.raw
  modified_base (223)..(223): a, c, t, g, unknown or other
  misc_feature (223)..(223): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
  modified_base (479)..(479): a, c, t, g, unknown or other
  misc_feature (479)..(479): n is a, c, g, or t
tcagatacgacgtacacgaccggtgctcgatttagagcgactagcaacacacgaaagggggcagaagtctctctcagtcaggacacagcatggacatgagggtccctgctcagctcctgggacctcctgctgctcgtggcctcccagactaccagatgtgacagtcggagactcgacccgagtcctccacttccctccctgtcctcgctatcgtaggtagganacgagacgtaccaccatctacgttcggccgggtagacgtcgaggactagttacgactttaagtttttacgccgttaggtactcagaccaacggaaaaccgtagggtaaacctccaactccctctagtatctagcgtctagctacgtcgtcttacgactagtcggacggtcctacgtcgttcggcacggcgtataggtcgtntaccggtaggactagtacgtacccncgttccacaacgtctaccggactacgtacncctacggcctacgaccgtaaggtaacgtgttaccggttactaacgtttaatttacgttaaccgttagtaaccgttaaaacgtaccgtaaaccgttccgtacccccgtttaaacccccgttgtaacccccggtccgggaaccgtaaacggtccgtaacggtaccgtaggtaaacgtaccggttaacggacgg

SEQ ID NO: 126717 - DNA, 836 bp, Homo sapiens
  misc_feature: GYAE6OF01C74XG.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctccgtgggactcctgctgctctcggctccagataccagtatgtagacatcgagactcgaccctagtcctcctacctcctcctacgtctacgctactcgtaggtaaggaacgacgacggtactacctaacctactaccgtacgttccggggccggggtacggtacggtacggacgggtacttaacgtttacgttaacgttttaacgtttttacgtaccgttaggttaactaccgtaaggtaaccgaaaccggtaaaaaccggtaacggggtaaacccgtacctaacccttacccgttccgttaacggtacttacgttaacgtacgtaccgtacgtaccgttcgtccgtttacgtttacgtaccgtaacgtaccggtaccgggttacctcggtaccgttacgggtaccggaacgggtcggtacgtacgggtacggtacggttacgggtacggaaccgttacggtaccggttacccgtaacccttaccggttaaccccaacggttaccgtacccgtaacggccctaaccggtcccgttaacggtacccgtacggttaacgtaggtaacgtttacggtccgttaacgttaacttaacgtttacgttaacgtaggtaaacctaagttaacgtacccgtaccgtccccgttaacccgttacccgttaccggtaccggtacgaaaccgccggttaacggtaagttacggtaacgtaagtaaccggtacgg

SEQ ID NO: 126718 - DNA, 856 bp, Homo sapiens
  misc_feature: GYAE6OF01BKP7T.12.49.E05.1.454.CMB.1.raw
  modified_base (644)..(644): a, c, t, g, unknown or other
  misc_feature (644)..(644): n is a, c, g, or t
tcagatacgacgtacacgaccggtgctcgatttagagcgactagcaacacacgaaagggggcagaagtctctctcagtcaggacatagcatggacatggacgggtccctgctcagctccgtgggacctcctggctcgctctcggcctacccgagactacccaggacttggtacgacatcggagtactacggaccctagtcctacctaccgttcccctcctcgtacgtcgacctagtccgtagggtaacggacgacgacgacgtacccactactaccgtacgttcgggccgggtaggtacgtacgggtacggtactaacgtttacgttacgttttaactttacggtccgttagtaccgtacgtaacgaaccggtaaaccggtaaaccggtaaacgggtaaccctacccgaccttaccctacggtaactacctcgtacgtacgccgtacgtacctacgtttccgtacgttaccgtaacgtaaccggttaccggtaccgggttacccttacggtttcccgtacgggttaacggccgggtacggacggttaggtcgggtaccgtcgggtaacgggtacttaccgggtacgtacgttcccctacggtaccacgttaacgcgtacgtcggacccttccggacgttaacgngtaacctggaaacgtttccgttcgtaaacgtaccttttaaaccgtacgtttaaacgtaacgttaaacgttaaacgttacccggtaaactccccgggtttaaccccgtacccgttaacccggttacccggaacccggggtaaacccggtaacggtaaccccgggtggttaaacccggggaagtttaacccgggttagtaaaacgggtcccggg

SEQ ID NO: 126719 - DNA, 743 bp, Homo sapiens
  misc_feature: GYAE6OF01B4VUA.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggcctcccagactaccagatgtgacatcgagatcgacccagtctccactccctccctgtctcgcacttctaggtaggagactaagacgtaccaaccctaattccgtaaccggtttggaccccgggggtacggtaacggttaccgaacggggtacctaagtttaacggtactttaaacgtttttttaacggcccgttagggttactacgacgtacaaacggtaaaccgaacgggtaacgttacccaacctacccgttccgttagtaacttcttaacgtgtacctcgacttacttcccggttactttacggactaacgtaccggtaccgggtacccctacgttaccgttccgttacgaacggtccggactaggtacgcgttacggtacgggaactacgggtacttaccgacgtactaccgacctagtaccgagcacgtccgagtacctacgacctagtaacgtagttcgtacgtaactaactttacgtaacgttacgtaaactaaacgtaacgttacctaccgttacccgtaccccttacgaacccggttacccggaaccggtaaacgtacccgacggtaacggtaacggtaactaacgtaaggtaacccg

SEQ ID NO: 126720 - DNA, 690 bp, Homo sapiens
  misc_feature: GYAE6OF01COXJR.12.49.E05.1.454.CMB.1.raw
tcagatacgacgtacacgaccggtgctcgatttagagcgactagcaacacacgaaagggggcagaagtctctctcagtcaggacacagcatggacatgagggtccctgctcagtctcctgggactctgctgctctggctccagactaccagatgtgacagtcgagactcgaccctagtctaccacttcctcctgtctgctatcgtaggtaggacgacgagacgtaccacctactccgtacgttcgggccgggtacgtacggtacgacggtctattacggtactttaagttttttacgcgttaggtactcgaacgacgtaacggaaccgtaagggtaaccctaccaaccgtacccttccgtagtacttaccgttacgtcgtaccgttacgtaccgaccgttccgtttacgttacgaccctaacggttaccggtaccggggttaccctcggttaccggttaccggtcggaccggttccggaacgtagggtacggtcgttaccggtacggacgttacggtacttaccgacccttacaccaactacgtacgacgaccgcgtaccgcgacgcgtagaagtacgtacttgtacttactaacttacgttaacgtaataacgtaagtaccaaaccgttcgtaccctaccgttccgtacggtccgaacgtaacgcgaacgtagagtagtcgtaacgtag

SEQ ID NO: 126721 - DNA, 860 bp, Homo sapiens
  misc_feature: GYAE6OF01BAIRG.12.49.E05.1.454.CMB.1.raw
  modified_base (216)..(216): a, c, t, g, unknown or other
  misc_feature (216)..(216): n is a, c, g, or t
tcagatacgacgtacacgaccggtgctcgatttagagcgactagcaacacacaaagggggcagaaggtctctctcagtcaggacacagcatggacatgagggtccctgctcagcctcctgggactcctgctcgctctggctcccagactacagatgtagacatcgagatcgacccagtcctcctactccctcctggtctgactattcgtgacgganacgaacgacgtaccacctactacctacggttcggccgggacgagtacgaaggacgtactaagtttacgtaacgtttaagttttttacgaccgttacggttacgtacgaacgtaacgtaaacggaaaaccggtaaacggggtaaaaccgtttacccgtaaccgttaaccctttacccgttaggttaacgttaccgttaacgtacggtaccgttaggtaaccgttaccgttaccgttttaccggtttacgaaccgtttaaccggttaccgggtaaccggggtttaccctaccggtttacccggttcccggggtttacggaccggtaccgggtaccgttacgggttaccggtaacggttccggtaccggggtaacgtacggttacccgttcccgtaaccttaccgtacccaacgtaccgtctaaccgccgtaccgtacccgttacgccctaacgtaccgtaaggtaacgttggttacggtaccgttaattaaccgtttttacgtaaccgtaagttaaacccgttaaagttacccgttaaacggtaccctttacccccggtaaccccttaccggttaccccggtaaccggggaacccgtaaccgggtaccgtaacggtaaccggttcggaaacggttacggtaaacgg

SEQ ID NO: 126722 - DNA, 846 bp, Homo sapiens
  misc_feature: GYAE6OF01CDXHI.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtctccactccctccctgtcctgactacttccgtaggtaaggacgacgaaggtaccgtacctaacctactcctaccggtttcggacccggggtacgtacggtccggagggtaccttaagttacgtactttaagttttttacggccgttaggttactacgtaacgacgtaaacggaaaccgtaacgggtaacccgttcctaacctacccgttaccgtagtaccttacgtactacgtccgtacgtaccgtaccgttccggtacgtttaccgaaccgttaaccggttaccggtacccggggttaccctagttcccggtttaaccgggttacgggaacgggttccgtaagggtcggttacgtcggggtacggtaacgtacggttaccgtaccctaccgtacccgtacctaaccgtccgtaacgacggtaaccctcgggtacccctaggaccggttaacccgacgttaaacgggtactttaacggttcggtttaaccggtaacccttttaaacggttttacctttaacggtaacgtttaaaaccttaaacggtaacctttacccggaacccgttaccccccgttacccgttaaaccccggtaccggtaacccggtaaaccggaacccggtaccgtacggttaacggtacggtaagttaaccgtacggtaacggttacgg

SEQ ID NO: 126723 - DNA, 954 bp, Homo sapiens
  misc_feature: GYAE6OF01BNU47.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagcctcctgggactcctgctgctctggcctcccagataccagatgtgacatcgagatcgaccccagtcctcctactccccttcccgttgtcctagcctagttccgttaggtaaggacgaaccgaggtacgttacccaacctatccctaccggttccggacccggggtacgacggttaccgacggggtaccttaagtttaccggtaacgttttaaacgtttttttacgacccgtttagggttaacgtacccgaacggtaacccgaaaaccggtaaaaacccgggtaaaccgggggttaaaaccgtttaccccgtaaacccgtaccccgtaccgtttacggtaaccttacgtttaacgtccgtccgtacgtaccttaaccgttccgttaccgttttacgaaccgttaaacggttcccggtaaccggggttaaccccctacgtttcccggttaccgggtttaccgaaccgggccgggtaacgtacgggttcggtacggttacggtacgggtaccgtacgttaccgttacctaccccttaccgtaaccacccgtaacgtaccgtacgtaacccgtccggtacccgtaccgtaccggtacccggttaacccaggttaaacgttcggtttacggtttaaacccggtaaaccttttaaacgtttaaccctttacgttaaagtaaaaacccggtttaaaacgttaaacgtaaccccgtttacccggtttacccccgtacccccgttttaacccgtaaccccggggttacccgtaaaccccgggtaacggtaaacccggttaccggtaaacggtacgggttaacgttaaacgggtaacccgttaaaccccggg

SEQ ID NO: 126724 - DNA, 487 bp, Homo sapiens
  misc_feature: GYAE6OF02F90U5.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttagcctggtatcagcagaaaccagggaaagttccacacctcctgatctatgctgcatccgctttgcaatcagggtcccatctcggttcagcggcagtggatctgggacagagttcactctcaccatcagcagcctgcagcctgaagatgttgctaacttattactgtacaaagtataacagtacgtcccccttacaccttcggaccaagggaccacgacgtaggagtagttagaacgg

SEQ ID NO: 126725 - DNA, 492 bp, Homo sapiens
  misc_feature: GYAE6OF02F6EHX.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctcctgtctgcatctgtaggagacagagtcaccatcacttgccgggcgagtcagggcattagctaattttagcctggtatcagcagaaccagggaagttccacacctctgatctatgctgcatccgctttgcaatcgagggtcccatctcggttcagcggcagtggatcgtgggacaggagttcactctacaccatcagcagcctgcacgcctgaagatgttgactaactttattactagtacaaaagtatacagtaccgtccccttacaccttcggaccaagggaccacgacgtaggacgtattagaaccg

SEQ ID NO: 126726 - DNA, 498 bp, Homo sapiens
  misc_feature: GYAE6OF02HCGOP.12.49.E05.1.454.CMB.1.raw
  modified_base (382)..(382): a, c, t, g, unknown or other
  misc_feature (382)..(382): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttagcctggtatcagcagaaccagggaagttccacacctcctgatctatgctgcatccgctttgcaatcagggtccatctcgttcagcggcagtggatcgtgggacagagtcactctcaccatcagcacgcctncagcctagaagtatgttagctaattattactagtactaactagtttatactttaccgtcgttacttttcggccttacgggtaaccacgtaagtagattaactacgtaaacgtaacg

SEQ ID NO: 126727 - DNA, 511 bp, Homo sapiens
  misc_feature: GYAE6OF02H5GGX.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaatttttagccttggtatcagcagaaaccagggaaagttccacacctcctgatctatgctgcatccgtctttgctaatcgagggtcccatctcggttcagcggcagtgatcgtgggacagtagttcactctacaccatcagcagcctgcagcctagaagatgttgactaacttattactagtaacaaagtataacagttaccgtcccccttacacccgttaccggaccaagggacctaccggacgttagggagtacgttagaaccg

SEQ ID NO: 126728 - DNA, 635 bp, Homo sapiens
  misc_feature: GYAE6OF02FYTFE.12.49.E05.1.454.CMB.1.raw
  modified_base (234)..(234): a, c, t, g, unknown or other
  misc_feature (234)..(234): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggcctccagataccagatgtgacatcgagatcgacccagtctccatccctcctgtctgcatctgtaggagacagacgtcaccatctacgttcggccgggngagtcgagggctagttagactttaatttttacgccgttaggtactcgagacaacgaaaccgaagggtaaacgttccaactaccctcctagactctagtcgctcgactacgtccgtctttgactaactcggacggggtcccagttccgtcggttacacggtcggacgtaggtggtactcggtagggacaggtacgttcacttctaccacctatcgagcacgtcctcgcgacgtccgtagaagtagttgttacgaacttaaacttttacgttaaccgtagttaaacctaaaagttactaaccgtacggttacccgttacccccctttacgtaccccggttaccggaaccgtaaacgggacctaaccggtaccggtaggtaacgttacgttaaccggtaaccgg

SEQ ID NO: 126729 - DNA, 483 bp, Homo sapiens
  misc_feature: GYAE6OF02GYVWQ.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccggcgagtcagggcattagcaatttttagcctggtatcagcagaaaccagggaaagttccacacctcctgatctatgctgcatccgctttgcaatcagggtcccatctcggttcagcggcagtggatcgtgggacagtagttcactctcaccatcagcagcctgcagctgaagatgtgctaacttattactgtacaaagtatacagtcgtccccttcacccttcggaccaagggaccacgtacgtggagtacttagaacg

SEQ ID NO: 126730 - DNA, 512 bp, Homo sapiens
  misc_feature: GYAE6OF02HLS4L.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttagcctggtatcagcagaaaccagggaaagttccacacctcctgatctatgctgcatccgctttgcaatcaggggtcccatctcggttcagcggcagtggatcgtgggacagagttcactctcaccatcagcagcctgcagcctagaagtatgttgactaactttattactgtaacaaaagtatacgtagtaccgcccccttactacccgttccggaccgtaagggacctacggacgtcgggaacgtacgttaagtaaccgg

SEQ ID NO: 126731 - DNA, 513 bp, Homo sapiens
  misc_feature: GYAE6OF02F3TWW.12.49.E05.1.454.CMB.1.raw
  modified_base (310)..(310): a, c, t, g, unknown or other
  misc_feature (310)..(310): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttagcctggtatcagcagaaaccaggaaagttccacaacctcctgatctatgctgcatccnctttgcaatcaggggtcccagtctcggttcagcggcagtggatcgtgggacagtagttcatctcaccatcagcagctcgcngcctgaagntgtgacaactttattaactgtaactaaaagttataacaacgttcgtacccccttcaacccgttccggaacccgaacgggaccaccggtacctaggacgtagttacgtaaccgg

SEQ ID NO: 126732 - DNA, 484 bp, Homo sapiens
  misc_feature: GYAE6OF02HXTPX.12.49.E05.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (441)..(441): a, c, t, g, unknown or other
  misc_feature (441)..(441): n is a, c, g, or t
tcagatacgacgtacacgaccggtgctcgatttagagcgactagcaacacacaaagggggcagaagtctctctcagtcaggacacagcatggacatgagggtccctgctcagctcctgggactctgctgctctggctcccagataccagatgtgacatcgagatgacccagtctccatcctccctgtctgcatctgtagganacagagtcaccatcacttgccggngagtcagggcattagcaatttttagcctggtatcagcagaaacagggaaattccacacctccngatctatgctgcatccgctttgcaatcgagggtcccatctcggttcagcggcagtggatcgtgggacagagttcactntcacntcagcagcctgcagcctgaagatgttagctaacttattactgtaacaaagtatacagtccgccccttanacccgttcgaccgaacgggacacgactgggaatagttagaacg

SEQ ID NO: 126733 - DNA, 499 bp, Homo sapiens
  misc_feature: GYAE6OF02FRQIW.12.49.E05.1.454.CMB.1.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaatttttagcctggtatcagcagaaaccagggaaagttccacacctcctgatctatgctgcatccgctctgcaatcacgggtccatctcggttcagcggcagtggatcgtgggacaggagttcactctcaccatcagcagccctgccagcctgaagtntgttnactacttattactgtaacaaagtataacagtcctaccccttcaccgttccggaccgaacgggactaaccggacgtggtacgtagttaacgg

SEQ ID NO: 126734 - DNA, 503 bp, Homo sapiens
  misc_feature: GYAE6OF02GDRAB.12.49.E05.1.454.CMB.1.raw
  modified_base (230)..(230): a, c, t, g, unknown or other
  misc_feature (230)..(230): n is a, c, g, or t
  modified_base (431)..(431): a, c, t, g, unknown or other
  misc_feature (431)..(431): n is a, c, g, or t
  modified_base (456)..(456): a, c, t, g, unknown or other
  misc_feature (456)..(456): n is a, c, g, or t
tcagatacgacgtacacgaccggtgctcgatttagagcgactagcaacacacaaagggggtcagaagtctctctcagtcaggacacagcatggacatgagggtccctgctcagctcctgggactcctgctgctctggctcccagataccagatgtagacatcgagatgacccagtctccatcctcctgtctgcatctggtaggagacagagtcaccatcacttgccgggngagtcagggcattagctaatttttagcctggtatcagcagaaaccagggaaagttccacacctctgatctatgctgcatccgctttgctaatcgacgggtcccagtctacggttcagtcggcagtgatcgtagggacagtagtacactctacaccatcagcagcctgcagcctgaagatgtagactaactttatactgtanaaagtatacgagtccgtccccttanacccgttccgaccaacgggaccacggactaggactagttagaaccgg

SEQ ID NO: 126735 - DNA, 495 bp, Homo sapiens
  misc_feature: GYAE6OF02HBSTL.12.49.E05.1.454.CMB.1.raw
  modified_base (343)..(343): a, c, t, g, unknown or other
  misc_feature (343)..(343): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttagcctggtatcagcagaaaccaggaaagttccacacctcctgatctatgctgcatccgctttgcaatcaggggtcccatctcggttcagcgnagtgatctgggacagagttcactctcaccatcagtcagcctgcagcctgaagatgttgactaacttattactagtacaaaagtataacagtacgtcccccttacacccttcggaccctaagggaccaacggactagggatagttagaaccgg

SEQ ID NO: 126736 - DNA, 568 bp, Homo sapiens
  misc_feature: GYAE6OF02H1CLS.12.49.E05.1.454.CMB.1.raw
tcagatacgacgtacacgaccggtgctcgatttagagcgactagcaacacacaaagggggcagaagtctctctcagtcaggacacagcatggacatgagggtccccgctcagctcctggggctcctgctactctggctccgaggtgccagatgtgacatccagctgacccagtctccatcctccctgtctgcatctgtaggagacaaagtcacatcacttgccgggctaaacgagagtattgccacgtaatttaaattggtatacaaacaaaaagcaggacaaagtccccaaagcctcctgatttatgctgccaccagtctgcaaggttcgggttcccgtctaaggtttcacgtggccgtggatcgagggacagtaatttactctcacatcagtacgtactacagtcctagaacgtattattcgacttaacttatttactgtacagctaagacgttaccgccgaccttaccactacctaaccgtttccggacccgtaacgggaccaccggacccgtacgaagtaacgttacggaaccgtaacgtggtacggcctacggaccacctacg

SEQ ID NO: 126737 - DNA, 539 bp, Homo sapiens
  misc_feature: GYAE6OF02FZQKF.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttagcctggtatcagcaagaaaccagggaaagttccacacctcctgactctatgctgcatccgtcttgcaatcgacgggtcccagtcgtcgttcagcggcgagtggatcgtagggacaggtagttcactcctcacatcagcagcctgcagcctagaacgatgttagactaactttattactgttaacaaaagttactaacgtacggttccgtaccccccgtttactacccgttaccggaacccgtaacgggtacctaacggtaccgtagggaacgtagttacggtaaccg

SEQ ID NO: 126738 - DNA, 567 bp, Homo sapiens
  misc_feature: GYAE6OF02IGHV0.12.49.E05.1.454.CMB.1.raw
  modified_base (231)..(231): a, c, t, g, unknown or other
  misc_feature (231)..(231): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatccctccctgtctgcatctgtaggagacagagtccaccgatcacttgccgggngagtcagggcattagctaattttagctggtatcagcagaaaccagggaaacgttccaacacctctgatctatgctgcactccgctttgcaatcgacgggtcccatctcggtcagcgcgagtggatcgtgggactagtagttccacttcctaccaccactcacgccacgcgtcgacacgaccctagaagtcttggtactacttaactttattacgtagttaactaaaagttactaacgtacgttcccgtacccccttaccgtaacccgttacccgggaaccgtaaccgggaccgtaaccggtaaccgtacggggtaacgtagttaaccggtaaccgg

SEQ ID NO: 126739 - DNA, 514 bp, Homo sapiens
  misc_feature: GYAE6OF02HKQSX.12.49.E05.1.454.CMB.1.raw
  modified_base (229)..(229): a, c, t, g, unknown or other
  misc_feature (229)..(229): n is a, c, g, or t
  modified_base (354)..(354): a, c, t, g, unknown or other
  misc_feature (354)..(354): n is a, c, g, or t
  modified_base (409)..(409): a, c, t, g, unknown or other
  misc_feature (409)..(409): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacgttgccgggngagtcagggcattagctaattttagctggtatcagcagaacagggaaagtccacacctctgatctatgctgcactccgtctttgcaatcgacgggtccctatctcggtcagcggcagtcgatcgngggacaggtatcactctcaccatcagcacgcctgcacgcctagaacgattcgtanacgtaactttattacgtacgtaactaaaagtactaacacgttaccgtccccttactacccgttaccgaccgtaacggacgacgacgtaggacgtagtagtaaccg

SEQ ID NO: 126740 - DNA, 556 bp, Homo sapiens
  misc_feature: GYAE6OF02HJEIJ.12.49.E05.1.454.CMB.1.raw
  modified_base (229)..(229): a, c, t, g, unknown or other
  misc_feature (229)..(229): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtccaccatcacttgccgggngagtcagggcattagctaattttagcctggtatcagcagaaccagggaacgttccacacctcctgatctatcgctgcatccgtctttgcaatcgagggtcccatctcgtcagcgcagtgatcgnggacagtatcactctcacatcagcngacctgacacgtccctaggaacgtagttcgttacgtacctaacgtttactttacgtacgttaaacctaaagttaactaaccgtacgttacccgtcccccttaccgtacccggttacccggaccgtaacgggacccgtaaccggaaccggttacgggaacgttagttaacggtaaccgg

SEQ ID NO: 126741 - DNA, 574 bp, Homo sapiens
  misc_feature: GYAE6OF02IP36U.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaatttttagcctggtatcagcagaaaccgagggaaagttccacacctcctgatctatgctgcatccgtctttgactaatcgacgggtcccatctcggttcagcgcagtgatcgtggacagagttcactctacacatcagcacgcctgaccagccgtagaacgtagttgttacgaccttaactttaactttaacgtacgttaaactaaaagttaactaacgtacggttacccgtacccccctttaccgtaacccgtttacccgggaacccggtaaacggggaaccctaaccggtaaccggtacgggtaacgtaacgttaacggtaaccgg

SEQ ID NO: 126742 - DNA, 662 bp, Homo sapiens
  misc_feature: GYAE6OF02GJD44.12.49.E05.1.454.CMB.1.raw
  modified_base (226)..(226): a, c, t, g, unknown or other
  misc_feature (226)..(226): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctcctgtctgcatctgtaggagacagagtcaccatcacttgccggngagtcaggcattagctaattttagctggtatcagcagaaacaggaagttccacacctctgatctatgctgctacgtccgtctttcgactaacgtcgaccgggtaccctacgttcgtacggttacgaacgtccgggacgtaggttacggaacgttcggtagggtaacgtaggtacgttaccgaccttactaccaacgtactacgacgacgaacgtccctcgacgtacgtaccgtagtaacgtacgttcgtttacgaacctttaaacgtttacgttaacgttaacgttaaaacgtaaaacgttaacgttaaccgtaccggttaaccccgttaaccccgtttaccttaaccccgggtttacccggaaaccggtaaaccgggtaaacccgtaccggtaaccggttaacggaacggttaacggtttaacggtaaaacccgg

SEQ ID NO: 126743 - DNA, 649 bp, Homo sapiens
  misc_feature: GYAE6OF02H2ZZI.12.49.E05.1.454.CMB.1.raw
  modified_base (229)..(229): a, c, t, g, unknown or other
  misc_feature (229)..(229): n is a, c, g, or t
tcagatacgacgtacacgaccggtgctcgatttagagcgactagcaacacacaaagggggcagaagtctctctcagtcaggacacagcatggacatgagggtccctgctcagctcctggggctcctgctactctggctccgaggtgccagatgtgacatccagatgacccagcctccatccctccctgtctgcatctgtagcagacagagtcaccatcacttgccgggnaagtcagaccatcagcagctaatttaaattggtatcagcagaaaccgaagggaaacgcccgtaagtcctagactctatggctgctatcccagtttgactaaaggtcggggtcccaagtcaaaggttcagtggcaggtgggtctgggacagtactttcgactctcaccatcagctagtctagacctaaacctggaaacgtacttacgtacgtacttaaactttaacgtttaaccgttacgttaaccaaacgtaaagtaaacgtttaaacccgtaccggttttaaccccctccccgttaaaccgtttttacccgggggaccggggttaaaaccggggtaaaccccggtaaaacggggttaggggtaaaccgggtaaaccgttaaccggtaaaaaccgggtaaccggttaggttaacccgggg

SEQ ID NO: 126744 - DNA, 607 bp, Homo sapiens
  misc_feature: GYAE6OF02HIKAS.12.49.E05.1.454.CMB.1.raw
  modified_base (225)..(225): a, c, t, g, unknown or other
  misc_feature (225)..(225): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctcatcctcctgtctgcatctgtagagacagagtcaccatcacttggccggngagtcagggcagttagcttaattttagccttggtatcagcaaggaaccaggaacgttaccacgtacctcctgatctatcgctgcactccgtctttcgactaactccggacggggtccccagttccgtacgggttcacgcggtcgacggtggtaacgtccgtggggactaggtacgttcctaaccgtctaccgtaacctataccgagccaacgtcctacgcgtacgccttagaaagtcgttagtacgtactaactttaacttactagtaacctaagttacgtttactttaccgtttaacccgttcggtttaacgttttcccgggtaacccgtcgggtaacccacggttaacgtacggtaactaacgtaccgaaacgttaccgg

SEQ ID NO: 126745 - DNA, 628 bp, Homo sapiens
  misc_feature: GYAE6OF02IFLM0.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcacctatcacttcggccgggcgagtcagggcattagactattttagcctaggtatcagcaagaaccgagggaacgttccactacctccgtagactacctatcgtctagctactccgtctttgactagtcgacggggtaccctagtcgttcggtctacggccggtactaggtggtactcgtagggactaggtacgttccaagttcctaccgacctatcgaaggtccaaccggtctacgcacggtccctaaggtaactagttcgtacggtaaccttaaacgtttaacgttacgtacgtaaacgttaaaacgttacttaaccgacggttttacccgtaaccccctttcgaccccgttaccggtaaccgaaaccgggtaccaaccggtacggttaggacgttaaccgttaggtaaaccccgg

SEQ ID NO: 126746 - DNA, 565 bp, Homo sapiens
  misc_feature: GYAE6OF02I4JVS.12.49.E05.1.454.CMB.1.raw
  modified_base (278)..(278): a, c, t, g, unknown or other
  misc_feature (278)..(278): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtagcagacagagtcaccatcacttgccggcaagtcagaccatcagcagctattaaattggtatcagcagaaaccagggaancccctaaggtcctagatctatgctgcatcctagtttcgacgaaaggttcgggtacccagtacgtaaggtttcaggtggacgtaggttgggtacgtgggactaggagttcactctacacctatcagcagcctgccagtcctagaacgtacttagttacgactaacctttattaaccgtagttaacgaaaacgttactaacgtacgtaccgtcccccttagaccccgtttacggaacccgtaacgggaaccctacggtacctagggtaacgtacgttacggtaacccgg

SEQ ID NO: 126747 - DNA, 547 bp, Homo sapiens
  misc_feature: GYAE6OF02G7WVO.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttcgccgggcgagtcagggcattagctaatttttagcctggtatcagcagaaaccgaggaaacgttccacacctctgatctatgctgcactccgtactttcgactaagtccgacggggtccctagttccgtcggttcaggcggcagtgagttcgtagggacaggtacgtctactctacaccgtatcgagcagtcctgcacgcctagaacgtattgtagactaacttattaacgtagtaactaaagtactacacgtccgtacccctacgttaacccgtcggtacccgaacgggtaccaccggtagtaggaacgttagtacggtaaccgg

SEQ ID NO: 126748 - DNA, 545 bp, Homo sapiens
  misc_feature: GYAE6OF02F9CUB.12.49.E05.1.454.CMB.1.raw
tcagatacgacgtacacgaccggtgctcgatttagagcgactagcaacacacaaagggggcagaagtctctctcagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccaagggaaacgccccctaaacgtcctgatctatggtgcatccactttgctataggtgggtccatcaaggttcagcggcaggtggtactcgtgggacaagattcactctacacatcaccagcctagcagcctagaactatttgactaacttattacctgttacaaacgttaggtttactaactttacccttcgttattttccgggcccttaggggtaaccctactaaggtacgtaattactaccgtaaaacgtacgtacggttacggcttacgg

SEQ ID NO: 126749 - DNA, 683 bp, Homo sapiens
  misc_feature: GYAE6OF02FGADJ.12.49.E05.1.454.CMB.1.raw
tcagatacgacgtacacgaccggtgctcgatttagagcgactagcaacacacaaaggggcagaagtctctctcagtcaggacacagcatggacatgagggtccctgctcagctcctgggactcctgctgctctgctccagataccagatgtgacatcgagatcgacccagtctccatcctcctgtctgctatccgttgacggagaccagactccactatccaccgttcgcccgggagacgtcgaagggtctaacgttacgactttaagtttttacggcccgttaggtactcgaactaccgtaaacgaaaccgtaagggtaaacctttccgaacctacccgtacttaggtacctctaagtcgctacgcctacgtccgtactttacgacctaacgtccggtaaccgggtccctacgttccgtacggtacgtacggcgtacgtaggtacgacgtcggtacgggactagtaccgttaccacgttcccacgtacctagaccgacgttacgaccgttccgacgtacgaccgtaccgaaggtactagttcgtaactacgttaaacttacgtaacttaacgtaactaaaccgttacctacgaccgtcccgttaaccccgtacgtacccggttacggaaccgaacggttacccgacggtaaccggtcgtaacgttaacggtacgtaacccgg

SEQ ID NO: 126750 - DNA, 547 bp, Homo sapiens
  misc_feature: GYAE6OF02F2BY3.12.49.E05.1.454.CMB.1.raw
  modified_base (303)..(303): a, c, t, g, unknown or other
  misc_feature (303)..(303): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaatttttagcctggtatcagcaagaaaccagggaaagttccacacctcctgatctatnctgcatccgtctttgctaatcgacggggtcccctaagtcctcggttcacggcggcgaggtggatcgtgggacagagttcacttctcaccatcagcagcctgcagcctagaagacgtgtcgacgtaactttaacttactgtaacgtaaaagttactaacgacgttacccgtccccttccgtaacccgttccggaacccggtaagggacctacggaaccgttgggaacgttacgttaggtaaccgg

SEQ ID NO: 126751 - DNA, 538 bp, Homo sapiens
  misc_feature: GYAE6OF02FLU87.12.49.E05.1.454.CMB.1.raw
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaatttttagcctggtatcagcagaaaccagggaaagttccacacctcctgatctatgctgcatccgctttgcaatcgagggtcccatctcgttcagcgcagtgatcgngggacagagttcactcgcacancgagccagtcctgacctaacctgaaacgntttacgngtacctaactttattaaccttgtacaaacgtagaacgttacaaccgtttaccctaccctaacgttttcgggaccgggtacgggaaccgtaagggtcggaaggacgtaccgtaaacggtacgtacggg

SEQ ID NO: 126752 - DNA, 806 bp, Homo sapiens
  misc_feature: GYAE6OF02HXLRB.12.49.E05.1.454.CMB.1.raw
tcagatacgacgtacacgaccggtgctcgatttagagcgactagcaacacacaaaggggcagaagtctctctcagtcaggacacagcatggacatgagggtccctgctcagctcctgggactcctgctgctctggctcccagataccagatgtgacatcgagatgacccagtcctcacttccctcctgtctgcattctgtaggagacagagtcaccatcacttcggccggcgtagtaccgagggctaagttaggtacttaatttttacgtccttaggtactcgagtacaacgaaacgtaacgggtaaacgttaccaaccgtacccttaccgtcggtaacttcttaaacgttcgtaccgttacgaccgtaaccttcccggtccttaccgtacgtaccctaaagttacccggaacccggggtttacccaacgttttcccggtttaacccgggtttccggaacggtacccgggtaccgttaacggggttaccgtaaccgggttaccggttacgggggtaaaacggttaccgggttaacggtttaacccgttaaccgttaacccgtttacccgaacccgttaaacgttacggaaacccgggtcctaaccggtccgtacgaccgttaccgaccgtaagtaaacggttacttcggttacgtaaccttaaaccgtttttaataacgttaccgtttaaacgaaacttaacgttaaccgtaccgttcccgttaaccccctttacgtacccgtttaaccggaccggtttaaacgggacctaccgggtaacgttacggtaacggtagttaaaccggg

SEQ ID NO: 126753 - DNA, 660 bp, Homo sapiens
  misc_feature: GYAE6OF02HKJC4.12.49.E05.1.454.CMB.1.raw
  modified_base (455)..(455): a, c, t, g, unknown or other
  misc_feature (455)..(455): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatccctccctgtctgcatctgtaggagacagacgtccaccatcacgttggccggcgagtcgagggtcagttagctaagtttttagcctggtatcagcaagaaaccgaggaaacgttccacacctcctgatctatgctcgctactccgtctttgactacgtcgtacggggtaccctactccgttacggttcgtacgccgggtagtaagggttcggtacgttacgtacggggtaacgaagggttacgttccaacgttcctaccaacctagtacacgtacncgtaccttcggcgtaccgtccgtaagtaacgtagttacggttcgaaccgttaactttttacgtaacgttcgttaaaaccgtaaaagttaacttaacgtacgttaccccggttaccccctttacttaaccccggttccgggtaacccgaaaccggggttaccaaccggtaccgtaagggtaacgttaacggttacgtaaacccggg

SEQ ID NO: 126754 - DNA, 611 bp, Homo sapiens
  misc_feature: GYAE6OF02H0ATJ.12.49.E05.1.454.CMB.1.raw
tcagatacgacgtacacgaccggtgctcgatttagagcgactagcaacacacaaaggggggcagaagtctctctcagtcaggacacagcatggacatgagggtccctgctcagctcctgggactcctgctgctctggctcccagataccagatgtgacatcgagatgacccagtcctccatcctccctgtctgcatctgtaggagacagagtccaccatcacttggccgggagagtacgagggcagttagactaatttttacgccttaggtatcagacaagaaaccgaagggtaaagttaccactaccgtcctagtatctatgtctcgactacgtccgtcttacggctaagtcgacggggtcccacgttccgtacggttcgacggcggtctaggtcggtatcgtagggacagttacgttactactcctaccactactcagtcacgtcgtcgacgacgccgtagaacgtagttacgtagtaacctaactttacgttaactaggtaaacttaaaggtacttaacgtacgttacccgtacccctttaccgtacccgttacggaacccgtaacgggtaccacggtaccgtaacgggtaatacgttaaggaaccgg

SEQ ID NO: 126755 - DNA, 631 bp, Homo sapiens
  misc_feature: GYAE6OF02FR9GD.12.49.E05.1.454.CMB.1.raw
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgacccagtctccacttcctccctgtctgcatctggtaggagacagacgtcaccatctacgtcggccgggcgagtcgagggctaagttacgtacttaaagttttttgcccgttaggttacttacagacaaaggaaaccgaagggtaaacgttacccgaactacctccgtagtactactaatcgtctggactacttccgtactttacgactaatccggtacgggtacccagttccgtacgggttcacggtcggacgtacggtacggtactccggtagggtaacaggtacgtacctacctccgtacacctacgtcaggcctaacncgacncgacgtctagagtntcgttactactaactttattacttacgtaagaaacttacgtatccggtaccgtccccgttactaacccggtaccgtaaccggtaacggtacctaacggtaccgaaggtacgtattacggtacgg

SEQ ID NO: 126756 - DNA, 649 bp, Homo sapiens
  misc_feature: GYAE6OF02JM3MN.12.49.E05.1.454.CMB.1.raw
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (513)..(513): a, c, t, g, unknown or other
  misc_feature (513)..(513): n is a, c, g, or t
tcagatacgacgtacacgaccggtgctcgatttagagcgactagcaacacacaaaggggcagaagtctctctcagtcaggacacagcatggacatgagggtccctgctcagctcctgggactcctgctgctctggctcccagataccagatgtgacatcgagatgacccagtctccatcctccctgtctgcatctgtacggagacagacgtcaaccagtctaccgttggccccgggngagtcgaggcattagntaagttttacgcctggtatcagtcaagaacaggtaacgttaccgacaccgttacctagtactacctagtagtcgtacgtcacttccggtctttacgactaagtccgtacggggttaccctacgtccgttcggttacgacggtccggcgtacggtacgggtacttccggtacgggaaccgtaggtaccggttacacgttccgtaccgacctactcgtaacgtcctacgtacccgtcgacgtaccgtccttaaggaacggtntttacggtaccgtaacgttaacctttaagttaccgttacgtaacgtaaacgttactaacgtacgttacccgtccccttagtacccgttaccggaccgtaaggacctaacgtccgtaggtaagtactaacgtaccgg

SEQ ID NO: 126757 - DNA, 781 bp, Homo sapiens
  misc_feature: GYAE6OF02GB67I.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggacctcctgctgctctggcctcccagataccagatgtgacatcgagatgacccagtctccactccctccctgtctgctatcgtgtaggagacgagacgtccaacctatccgtaccgttcggcccggggacgtaacgtccgaggggtacctaagttagtaacctttaaagtttttacgccgttaggttataccaaggtaccaaacggaaaacccggtaagggtaaaacgttaccccgtaacctacccgttacccgtagtaacttaccgttaatcgtacgtcgtacctacttcccggtctttacgaaccgtaacgtaccggtaccgggttacccctagtttcccggttaccggtttacgacggtccgggtacgtacggtcggtacgttcggacgggtacggtaaggttacgttacctacctaccgtccctaacgtaactccgaacgtccgtacggtccctcggaccgtacgaccggttaagaacgttcgttacggttaacgttacctttaaaccttacgttaaccgtaacgttaaacgtaaacgttaaccgtaacccgttacgttacccccgttaccccgtttaaccgacccggttacccgggaaccggtaaccggtacccgtaaccggtacggtacggtaaacggtttacgtacgtaacccgg

SEQ ID NO: 126758 - DNA, 659 bp, Homo sapiens
  misc_feature: GYAE6OF02I2OBH.12.49.E05.1.454.CMB.1.raw
  modified_base (204)..(204): a, c, t, g, unknown or other
  misc_feature (204)..(204): n is a, c, g, or t
tcagatacgacgtacacgaccggtgctcgatttagagcgactagcaacacacaaaggggggcagaagtctctctcagtcaggacacagcatggacatgagggtccctgctcagctcctgggactcctgctgctctggctcccagataccagatgtgacatcgagatgacccagtctccatcctccctgtctgcatctgtagganacagagtcaccatcacgttggcccgggcgagtcgagggctaattacgacttaatttttacgccgttggtatcagtcaagaaaccgaggaacgttccaccgacctcctgtactctatgctgactatccgtctttagactaatccgtacggggttaccccacgttccgttaccgggtttccgacgggccgggtaccgtacgggtggacgttcggtacggggtaacgtaaggtaccgttacctaccgttactacccaaccgtactaccgacgccgaaccggtcccgttacgacgtaccgtccgtaagaacgttagttacgttacggtaaccttaaacgtttgtttaaccttacgtaaactaaagttaactaccgtacgtcccgttccccttaaccgtacccgttaccgaccggaacgggtaccacggtaccgttaggtacgtacgttacggtaaccgg

SEQ ID NO: 126759 - DNA, 558 bp, Homo sapiens
  misc_feature: GYAE6OF02FZY3D.12.49.E05.1.454.CMB.1.raw
  modified_base (364)..(364): a, c, t, g, unknown or other
  misc_feature (364)..(364): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagacgtcaccatccacgttggccgggcgagtcagggcattagctaatttttagctggtatcagcaagaaccgagggaaattccacacctctgtatctatcgtctgcatccgtctttgctaatcgaggggtcccattctcgttcagcggcagtcgatcgnggacagagttcactctacacctatccagtcacgtccgtagcgacgtccgtagaaggtattggttactacctaactttacttaacgtacgtaataaaacgttacaactacggtacccgtcccctttacctacccggttccggaccgtaaacgggaccgtaacggtacgtacgggagtaacgttcggtaaacccgg

SEQ ID NO: 126760 - DNA, 502 bp, Homo sapiens
  misc_feature: GYAE6OF02HAV9D.12.49.E05.1.454.CMB.1.raw
  modified_base (228)..(228): a, c, t, g, unknown or other
  misc_feature (228)..(228): n is a, c, g, or t
  modified_base (341)..(341): a, c, t, g, unknown or other
  misc_feature (341)..(341): n is a, c, g, or t
  modified_base (406)..(406): a, c, t, g, unknown or other
  misc_feature (406)..(406): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggngagtcagggcattagcaatttttagcctggtatcagcagaaaccagggaaagttccacacctcctgatctatgctgcatccgctttgcatcagggtcccatctcgtcagcgcngtggatcgtgggacagtagttcacgtctcaccatcacgcacgcctgcacgcctgaagtatgttanctaactttattacttatactaaagtactaatacgtacgtccccttctacccttaccggaccgtaacgggacctacggactggatacgtagtaaccg

SEQ ID NO: 126761 - DNA, 818 bp, Homo sapiens
  misc_feature: GYAE6OF02H9IOB.12.49.E05.1.454.CMB.1.raw
  modified_base (208)..(208): a, c, t, g, unknown or other
  misc_feature (208)..(208): n is a, c, g, or t
tcagatacgacgtacacgaccggtgctcgatttagagcgactagcaacacacaaagggggcagaagtctctctcagtcaggacacagcatggacatgagggtccctgctcagctcctgggactctgctgctctggctcccagactaccagatggtgacatcgagatgacccagtctccatcctcctgtctagctatctaggtacgganacagacgtcacctattcacgttcggaccgggcgtagtaccgagggggacctaagtttaacggtacgtttaaacgtttttttaacggcccggtttagggttacgtaccgtaaacgggtaccaaacggtaaaaaccccgtaaggggggttaaaaaccttttcccggaaccctaacccgtttccgttacggtaactttaccgttaacgtacggtccgttcgtaccgtaacgttccgttaccgttttacggaccgttaaacgttccgggtaaccggggtacccctacggttaccggttaccgggtttacacggggtccggtacgttacgggttacgggacttacggtacggggtacgtaacggtagttaccgtaccttctaccgtaactacgtaccagtacgacgtccgttaggccgtaacgtcccgtaagtaacgttacggttacggttactaaaccgttacgttttaacgttaaccgttaggttaaactaaacgttacttaaccgtaccggttacccgtcccccgtttaacgtaccggtaacccgggtaaccgaacccggggtacttaacggtaccggttacgggtaacgttaaccggttacggtaaaccgg

SEQ ID NO: 126762 - DNA, 778 bp, Homo sapiens
  misc_feature: GYAE6OF02HSTAC.12.49.E05.1.454.CMB.1.raw
tcagatacgacgtacacgaccggtgctcgatttagagcgactagcaacacacaaaggggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagactaatttttagcctggtatctagacaagaaaccgagggtaaacgttccacacctcctgatctatgctgctactccgtctttacgactaaagtcggacggggttaccccaacgttccgttccggttacgacggcgggtacctagggtttacggaacgttcggtacggggtaacgtaacggtacggtttaccacgttacctacctaacccgtaactaccgtaacggaccgtacggtccgttacgaccgtaacggtacccgttacgggtaaacgtaaggtttacggtttacgtaacccgttaaaaccgttttaaaccgttttaaaccgttaacggttaaaaccgttaaaaaacggtttaaacgttaaaacccgttaaccggaaccccggttttttttttttttaacccccctaccccggttaaccccggtttaaccccggggttaaccccggtaaaaccgggggtaaacccgttaacccgggtaaacccggttaacggggtaaaacggttaacggtttaaaccgggtaaaaccggg

SEQ ID NO: 126763 - DNA, 721 bp, Homo sapiens
  misc_feature: GYAE6OF02F7L25.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttagcctggtatcagcagaaaccaggaagttccacacctctgatctatgctgctactccgtctttgactaacgttcgaacgggggtcccctaagttccgttaccgggtttaccgaacggtccggggaccgtaggtacgggtacgttccgttacgggggaacctaaggtacggttttaccctaaccgttccgtacccaacccgtaacttacccgaacggtcccgaacggtccctacggcccgtaacggtacccgttaggaaaaccggtattagggtttaccgtaaccttaaacgtttttaacgtttaaccgttacgtaaccttaaaccgaaggttaacgttaaacccgtaacccggtttttaacccccctaaccccgtttaacccggttttaccggggaacccgggttaacgggggtaacccgtaacggggttacggggaacgtaaccgttaaccggaaaacggttaaccggg

SEQ ID NO: 126764 - DNA, 752 bp, Homo sapiens
  misc_feature: GYAE6OF02H9LY8.12.49.E05.1.454.CMB.1.raw
tcagatacgacgtacacgaccggtgctcgatttagagcgactagcaacacacaaaggggcagaagtctctctcagtcaggacacagcatggacatgagggtccctgctcagctccgtgggactcctgctgctctggctcccagataccagatgtgacatcgagatcgacccagtctccatcctccctgtctgcatcgtgtaggagacagacgtcaccatccgacttcggccgggcgagtcgagggctagttagtacttaatttttacgccgttggtattcgaagacgaacggaaaacccgtaaggggtaaaaccgttacccaaccgtaccctaccgtacgtacttacttacgtcgtactcgtacctacgttcccgtacgtttacgacgtaacgtaccggtaccgggtcccctacgttccgttacgggttacgacgggtaccgggtacgtacgggttacgggtacgtttacggtacggggtaacgttaacggttaacggtttaccctaccgttaccgtacccgtaaccctagtaccgacgtccgtacgcccgttacgtaccgaccggtaccgttaaggtaacgttacgttacgtacgttaacttaaacgtttaacgttaaccgttaacgttaaaactaaaacgtaccttaaccgtccgttaacccgtccccttaaccgtacccggttaacccggaacccgtaacggtaccgtaaccggtacggtaacggtaacgttaacggtaacgtaaccgg

SEQ ID NO: 126765 - DNA, 846 bp, Homo sapiens
  misc_feature: GYAE6OF02GYOI1.12.49.E05.1.454.CMB.1.raw
  modified_base (211)..(211): a, c, t, g, unknown or other
  misc_feature (211)..(211): n is a, c, g, or t
tcagatacgacgtacacgaccggtgctcgatttagagcgactagcaacacacgaaagggggcagaagtctctctcagtcaggacacagcatggacatgagggtccctgctcagctcctggactcctgctgctctggcctcccagactaccagatgtgacatcgagatcgacccagtcctccatccctcctgtctgctatcgtaggtagganacgtagacgtccacctatctacgttcggaccgggacgtacgtcgagggtactaagttacgtactttaagtttttacgcgttaggtactcgaacgtacgaaacggtaaaccggaacgggtaaacctaccccaacctacccgtacgtacgtacttacgttacgtacgtcgtcgaccgtaccgttccgttcgtttacgacgttaacgtccggtacccgggttaccctacgtttccggttaccgggttaccgacggtaccggggtacgtaaccgggtacgggttaaccgtccggggttaaccggggtaacgttaaccggggttaccgtttaccccgtaacccggtttacccgtaaccccggtaacccgtaacggttacccggtaacgttaacccggtttacgggttccttaaccggaaaccgtttaacccggtaagggtaaccgtttaacggtttaccctacggttaaaccttttaaccgtttacctttacgtaaccgtaaacgtaacgtaaacgttaacccgtttaaccgttaccccgtttacccgttacccgggttaaccggtttaccggggaacggtaaccgggtaccgtagggtaaccgtaacggtaacctaaccgggttaacgtaccgttcggg

SEQ ID NO: 126766 - DNA, 472 bp, Homo sapiens
  misc_feature: GYAE6OF02IXP6U.12.49.E05.1.454.CMB.1.raw
  modified_base (145)..(145): a, c, t, g, unknown or other
  misc_feature (145)..(145): n is a, c, g, or t
  modified_base (416)..(472): a, c, t, g, unknown or other
  misc_feature (416)..(472): n is a, c, g, or t
tcagatacgacgtacacgaccggtgctcgatttagagcgactagcaacacacaaaaggggggcagaagtctctctcagtcaggacacagcatggacatgagggtccctgctcagctcctgggactcctgctgctctggctcccanactaccagatgtgacatcgagatcgacccagtcctccatccctcctgtctagcattctaggtaggacgactagacgtccaacctatccaacgttcgggcccggggacgtacgtcggaacgggtctaagtttaagtaccttttaagttttttaccgccgtttaggttaactaccgtaacgaaccgaaaacgggtaaaacccggtaagggggttaaaacccttaccccgaaacccgttaaccccttccgttaaggtaaccttacgtaacgttnnnnnnnnnnnnnnnnnnnnnnnnnnnnnnnnnnnnnnnnnnnnnnnnnnnnnnnnn

SEQ ID NO: 126767 - DNA, 672 bp, Homo sapiens
  misc_feature: GYAE6OF02INJOV.12.49.E05.1.454.CMB.1.raw
  modified_base (159)..(159): a, c, t, g, unknown or other
  misc_feature (159)..(159): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagatacgacgtacacgaccggtgctcgatttagagcgactagcaacacacaaaagggggcagaagtctctctcagtcaggacacagcatggacatgagggtccctgctcagctcctgggactcctgctgctctggctcccagataccagatgtgacntcgagatgacccagtctccatccctccctgtctgcatctgtagganacagactcaccntcacttgccgggcgagtcagggcattagactaattttaacgccttgtatacagtcaaggaaaccaagggtaaagttccaacacctccgtgactctatgctgctatccgtctttcgactaagtcgacggggttcccattccgtcggttaccaagtccggacgaggtcggactcggtcgggaacgaggtaacgttccacttctaccgtaactaactccgaaggaccacgtcccgtggtaccctaccggtacgtacggtaaagtactttacggtacgtaacctaacgttttaacttaactaacggttaaaccgtaaaaacggtttactaaaccggtaacgttcccggtaacccccttttaccgtaaacccggttaccccgggaacccggtaaaacggggtaacccctaacgggtaacccgttaagggaaccggttacgttaaaccggtaaacccgggg

SEQ ID NO: 126768 - DNA, 679 bp, Homo sapiens
  misc_feature: GYAE6OF02JDJY1.12.49.E05.1.454.CMB.1.raw
tcagatacgacgtacacgaccggtgctcgatttagagcgactagcaacacgacaaagggggcagaagtctctctcagtcaggacacagcatggacatgagggtccctgctcagctcctgggactcctgctgctctggctcccagataccagatgtgacatcgagatgacccagtcctccatcctcctgtctgcatctgtaggagacagagtccacctagtccacgttggcccgggagagtcgagggcagttagctaatttttcgccctggttactcaagcaacgtaaaccgaagggtaacgttaccacctaaccgtcctggtactcttactcgcttgcctacttcccggtcttttacgactaacgtccgtacggggttcccctagttccgttacgggttcctacgggcggtccgtaaggtcgtacgtttccggtagggtaccgtaaggtcggttacctaaccttcgtaccactaacgtcgacgactaccggtccttcggaccctacgtacccgtaggtaacgtaacgtttcgttaccggaacctttaacgtttaactttaccgtacggtttaaccaaggtacgtaacgttaactacccggtttacctacccgttaacggttccgtacgttacggtaacggtaacccggtaaggtacgtaacgtacgtaccgtaaacggg

SEQ ID NO: 126769 - DNA, 748 bp, Homo sapiens
  misc_feature: GYAE6OF02GVZ4A.12.49.E05.1.454.CMB.1.raw
tcagatacgacgtacacgaccggtgctcgatttagagcgactagcaacacacaaaagggggcagaagtctctctcagtcaggacacagcatggacatgagggtccctgctcagctcctgggactcctgctgctctggctcccagataccagatgtgacatcgagatgacccagtctccactcctccctgtctgcatctagtagagacagacgtcaccatcacttcggccgggcgagtcgagggctagttagacttaatttttacgccgttaggtactcgacgacgaacggtaaaccgagggtaaacttcccaacctacccttccgtcgtactacttaacgtgtcgtcgtacctaccgttcccgttctttacgaccgtaacgttaccggtaccggggttacccctacgttccggtttaccgggtttaccgaacggtcccggtacggtagggttacggtacggtaccgtaggggtaacctaagggttaccgttacctacccttacctacccgtaaccgaaccttccgaacgtaccgacgtcccgtacgaccgtcgtaccgtaaggtaacgtacgtttcggtaaccgtaacctttaacgtttaacttaaccgttaagttaaaccgtaaaagttaacgtaacgttacccgttaccccgttaccccctttaaccgtaacccgggttaccggtaccggtaaacgggtacccgttaccggaacgttacgggaaggtttaccggtacggtaaccgg

SEQ ID NO: 126770 - DNA, 847 bp, Homo sapiens
  misc_feature: GYAE6OF02JHZRI.12.49.E05.1.454.CMB.1.raw
  modified_base (175)..(175): a, c, t, g, unknown or other
  misc_feature (175)..(175): n is a, c, g, or t
  modified_base (219)..(219): a, c, t, g, unknown or other
  misc_feature (219)..(219): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctcgtgcctcccagataccagtatgtgacatcgagactcgacccngtcctccattccctcctgtctcgacattcgtaggtaggagtacnggacgtccacctatccgtacgttcggccggacgagtacgagggtctagttacggtcttaacgttttttacggacccgttggttactccaaggtaccgaaacggtaaaccggtaacggggtaaaacgtttcccccgaaccgtaaccccgtttaccgtacgtaaccgtttacgttaacgttacgacgttaccggtaccttaaccggttcccggtttactttaccggtaacccgtaacgttccgggtaacccgggggtttacccctaaccgtttccggttaccgtttaccggacgggacccgggtacgtacggtttacgggtccgttaccgggtagggacccgttagggtaaaccgtttccggtaacccttccgttaacccgtaaccggttaccgaacccggtacgtaacgtcccggtaccgttaccgcccgttaacgacgttaacgggagtttaaccggtaggttcccttaaacgtacgttttaacgttccgtaaacggttaactaaaacggtttaacgtacgttaaccccggcctttaaccccccgttacgttaccccggtaaccggtacccgtaaaggtacccccggtagttaacccgggaggtaaccgttacgggtacctaaacggg

SEQ ID NO: 126771 - DNA, 832 bp, Homo sapiens
  misc_feature: GYAE6OF02I51TM.12.49.E05.1.454.CMB.1.raw
  modified_base (181)..(181): a, c, t, g, unknown or other
  misc_feature (181)..(181): n is a, c, g, or t
  modified_base (639)..(639): a, c, t, g, unknown or other
  misc_feature (639)..(639): n is a, c, g, or t
tcagatacgacgtacacgaccggtgctcgatttagagcgactagcaacacacaaagggggcagaagtctctctcagtcaggacacagcaatggacatgagggtccctgctcagctcctgggactctgctgctctgctccagataccagatgtgacagtcgagatcgaccctagtcctaccntccctcctgtctcgctactcgtaggtaaggagacctaggacgttaccaacccattaccgtacgttcggggccccgggtagtacggttcggaagggtacctagttacgtacttttaaagttttcgccgtttaggttactacgaacggtacaaacggtaaaccggtaaacgggtaaaccggttcccctaaaccgtacccgttaccgttacggtacttacgttaacggtcgtccgttacggtcccgtacctttccggtactttaaccgaccgttaacggttaccgggtaacccggggtttccctaacggttccgtttacgggttaccgaaccgggtttaccggaaccggttccgggttaggttacgtaccggggttagggaacccttagggtacccgtttaccgccctttaccgtaccgttaaccgaacggtaccctacggtaacccgcgtttaccccggngggtaaaccctcggtaacccggtaagtaacggttaacgttccgttaacggtaaccttacgtttaacttaccgtaaaggttaaacgtaacttaacggtacgttaccgtcccgttaacccttccggttaaccccgtaaccggtaccgtaaacggaccgtacctaacgggaacgtacttaccgggtattaaccggg

SEQ ID NO: 126772 - DNA, 527 bp, Homo sapiens
  misc_feature: GYAE6OF02GAX0K.12.49.E05.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
tcagatacgacgtacacgaccggtgctcgatttagagcgactagcaacacacaaacgggggcagaagtctctctcagtcaggacacagcatggacatgagggtccctgctcagctcctgggacctcctgctgctctggctcccgagataccagatcgtgacatcgagatgacccagtctccatccctcctgtctgacntctgtagganacagagtcacctatccacgttggccggngagtcgaggctagttacgacttaagtttttacgccttggtactcagacaacgaaaccgagggtaacttccactacctctgactctatgctgcactcgtcttgacagtcgacgggtcccatcgtcgtcagcgnagtgactcgtaggactagacgtcnctctacaccatcgagcacgctnctagcctagatcgtgtacgacttaacgttntaccgtataactaatactacncgttccctaccccttcgtaccgttcgaccgaacgacgacgtagtacggaatacgtagtaacg

SEQ ID NO: 126773 - DNA, 709 bp, Homo sapiens
  misc_feature: GYAE6OF02HW02X.12.49.E05.1.454.CMB.1.raw
  modified_base (211)..(211): a, c, t, g, unknown or other
  misc_feature (211)..(211): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagatacgacgtacacgaccggtgctcgatttagagcgactagcaacacacaaagggggcagaagtctctctcagtcaggacacagcatggacatgagggtccctgctcagctcctgggactctgctgctcgtggctcccagataccagactgtgacatcgagactgacccagtctaccactccctcctgtacctgctatcgtgtagganacagtagtaccacataccacgttacggccgggacgtagtccgagggctaagttacgtacttaatttttacgccgttaggtacttacgacgtaacaacgtaaaaccgtaagggtaaacgttaccaaccgtaccctacgtagtacctacgttactcggtctacgccgtaacgtccgtactcgtacgacgtaactcggaccggtctacgtcgtcggtacncgggngtacgtagtacgtacgtcgtagggacgtagtacgttacctacgtcctacctaaccgtacgaccgtaacgcttacgccgttaacggccgtaaccgacgttaagtaacggttacgtttacggttaggtaaccctttaaacttttacggtaaaccttaagtaaaccgtttaaaggtacttaaccggtaccgttacccggtttaccccctaccgggttaacccgttaccggaacccgttaacggacgtaaccggtagtacgggtacgttaagtaacccgg

SEQ ID NO: 126774 - DNA, 738 bp, Homo sapiens
  misc_feature: GYAE6OF02JEUV4.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatcgaccctagtctccatcctcctgtcctgcatctggtagagacagacgtcaccatcacgttgccgggacgagtcgagggcattagactattttcgctggtatcagtacaacggaaaccagggtaaacgttcccactacctacgtcgtactctactacgctacgactacgttcccgtacgtttacggacctaacgttaccggtaaccgggggttccctaacgttcccggttaccgggttaccgacgggtccgggtacgtacgggttacggtacgttaccgggtacggggtaaccgtacgggttaaccggttaccctacgttacccggttaccctaaaccgtactaccgacggttacccaacggtcccgtaacggccgtaacggcccgttaaggaacgtacgttacgttaccgtaacttaaccgtttacgttaacctacggttaaaacaaacgttaacgttacgtaccgttacccgttaccccctttaccgtaaccggtttacccggaaccggttaaacgggaccccgttaacggtaccgttaacgggaacgttaaccggttaaccggtaaaccgg

SEQ ID NO: 126775 - DNA, 794 bp, Homo sapiens
  misc_feature: GYAE6OF02HN6Q3.12.49.E05.1.454.CMB.1.raw
  modified_base (117)..(117): a, c, t, g, unknown or other
  misc_feature (117)..(117): n is a, c, g, or t
  modified_base (134)..(134): a, c, t, g, unknown or other
  misc_feature (134)..(134): n is a, c, g, or t
tcagatacgacgtacacgaccggtgctcgatttagagcgactagcaacacacaaagggggcagaagtctctctcagtcaggacacagcatggacatgagggtccctgctcagctccngggactcctgctgctcnggctcccaagtataccagatgtgacagtcgagtatcgacccagtcctccacttccctccgtgtttcgacgccagttccgtaggtaagggaacgtaccgaaggtacgtacccaacctaacgttccgacgtttacgggccggggacgtagtacggagggtactaagttacgtactttaagttttacgacgttaggtacttacgaacggacgtaaccggaaaaccggacgggttaaaacgtacccgaaccttaccctacgtactaacgtttacgtaacgcgttacctagccgtaacgttccgtacgtttacgaccgtaacgtacgggtaccgggtacctacgttaccgtacgttacgtcggaacgtccgtagtgggtacgtaacgttccggtagggtaacctagggttactaccggtacctaccgttaccgaaccgtacgcgtaaccggtaacgacccgtacgttaccgaccgtacggttacgaaaggtccgttaaggttacgttaccgtaacgttaaccgtttaaccgtttaagaaccggttaaactaaaccggttaacttaacgtaccccggttccgtaaccccgttccgtaaccccgggtttaccgaaaccgggttaccgggacccgttaggtaccgtaaacgggttgtaacggtaacgg

SEQ ID NO: 126776 - DNA, 792 bp, Homo sapiens
  misc_feature: GYAE6OF02ICVEK.12.49.E05.1.454.CMB.1.raw
  modified_base (197)..(197): a, c, t, g, unknown or other
  misc_feature (197)..(197): n is a, c, g, or t
  modified_base (363)..(363): a, c, t, g, unknown or other
  misc_feature (363)..(363): n is a, c, g, or t
tcagatacgacgtacacgaccggtgctcgatttagagcgactagcaacacacaaagggggcagaagtctctctcagtcaggacacagcatggacatgagggtccctgctcagctcctgggacctctgctgctctcggcctcccagactaccagatgtgacatcgagatcgacccagtcctccactccctcctcgtcncgcatcgtggtagacacgagtacgtccaccatacacgttcggccgggcgacgtcgaagggctaattaggtaccttaagtttttacggccttagggttactacgacgtacaaacggaaaccggaagggtaaacgttacccaacctaccttcctagtacttacgttancgtacgtacgacctaccgttcccgtcgttttacgaaccgttaacggtacccgggttaaccggggtacccccttagtttacccggtttaccgggtttaccgaccggggtaccggtacggttaacgggttcggttaccgttacgggtacggggtaaaccgttaacgggtaaccgggtttccttaacccggttccttaccgaacccgtaccgtaaccgacggtaccaccgttccgttaccgccgtaccggtacgtaacgagtttacggttcggttaccgtacttttaacctttaagttaaccgttacggttaaaactaaagttaaccgtacgtaccgttccccggttacccccgttttacgaacccggttaccggaaccggtaacgtaacccggtaccgtacggttaggaacggtttaacgtggtaaacccg

SEQ ID NO: 126777 - DNA, 795 bp, Homo sapiens
  misc_feature: GYAE6OF02HSW1F.12.49.E05.1.454.CMB.1.raw
  modified_base (231)..(231): a, c, t, g, unknown or other
  misc_feature (231)..(231): n is a, c, g, or t
tcagatacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatccctccctgtctgcatctggtagagacagacgtcaccatccacgttgccggngagtccagggcattagtactaagtttttagccttaggtatctagacaacgaaaccgtaaggaaacgttaccaaccgtaccttacctacggtattaccgtagtacgtcgtacgtacgtaccttacccgttaccgtttaccggacgtaaacgttccggtaaaccggggggtttacccctaacgtttccggttccggggtttaaccgaacgggtccgggtacggtagggtacgggtaacgttccgggttacggggaacgtaaccgggttacggtttacccgtaaccttccgtaacaaccccgttaataccggacgtaccgtaacgtacccggttagacccgtacggtacccgttaagtaacggtaacgttacggttacggttaaccttaaaccgttttaactttaacccgttacgttaaaaccttaaaacgttaaacgttaaccgttaacgggtttaccccgtaacccccttttacccggtaaccccgtttaacccggggaacccgtaaacggggacccggaacggttaaccggtaccgggtaagttacggtttaacggtaaaccgg

SEQ ID NO: 126778 - DNA, 807 bp, Homo sapiens
  misc_feature: GYAE6OF02H32P8.12.49.E05.1.454.CMB.1.raw
  modified_base (116)..(116): a, c, t, g, unknown or other
  misc_feature (116)..(116): n is a, c, g, or t
tcagatacgacgtacacgaccggtgctcgatttagagcgactagcaacacacaaagggggcagaagtctctctcagtcaggacacagcatggacatgagggtccctgctcagctcnggactctgctgctctcggccccagactaccgagtagtgtgaacagtcgaagatacgaccctagtcctcctaccttccccttcccgttagtcctcggtacctacgtcgttagggtacggaacgtacgtagtacgtacctaaccgacttacctacggttcgggcccggggtacggtacggtaccggacgggtaccttaaagttacgtactttttaaacgttttcggaccgttggttaactcggtaagacgtaaacgtaaaccgggtaacggtaaccttacccgaaccctaccgttacgtaacgtaacctttgtacgtcgcgttccggacctaccgtttccgttacgtttaccgaaccggttaacggtccggttaacccggggtaccttacggttaccgttccggttaccggaccggtacgtaccggtaggttaccgtacgttagggtacggaacgtacgtttacggtacttaccgtactaccgtacctacgcgtaaccgctaccgtccgttacgaccgtacgagtacggtacgttagttacgtaccgttaacttacgttacgttaacgtaacgtaaacttaaacgtaccgtaacgttccgtaccccttacccggttccgttacccggtaaccggtaccgaaccggtacgtaaccgtacggtaacgttaggtaacgtacccggtacgttaacgg

SEQ ID NO: 126779 - DNA, 702 bp, Homo sapiens
  misc_feature: GYAE6OF02I9845.12.49.E05.1.454.CMB.1.raw
  modified_base (218)..(218): a, c, t, g, unknown or other
  misc_feature (218)..(218): n is a, c, g, or t
  modified_base (506)..(506): a, c, t, g, unknown or other
  misc_feature (506)..(506): n is a, c, g, or t
tcagatacgacgtacacgaccggtgctcgatttagagcgactagcaacacacaaaggggcagaagtctctctcagtcaggacacagcatggacatgagggtccccgctcagctcctgggctcctgctactctggctccgaggtgccagatgtcgacatccagatcgacccagtctccatccctcctgtctgcatctgtagcagacagacgtccaaccnttccgacgttacggcccgggtacaaagtccaacgacctactacagacacgtccttaaatttaaagttggtatccgtagaccaagaaaccgacgggaaacctacccggttaacggtccgtacgtacgtactacgttcgtctcgacctaagttccgtacgtttacggaacttaacggggtccggttacccgaagtacgtaaacggtttacggagtacgggtaccgtaggttacgggttcgtacgggacgtacggttactttccgtacgtccttacgacctacgtcaccgntacgtctacgcaaccgtagttacgacttcgtactacctacgtttaacttacggtactaacctataaacggtagtaaaccgttacgttaccccgttcttaccggtttaaccggtaccgggacggttaaacccgtaggggtttaacgacggttaacctaaccggtaaaccggttaacggttcgttaccggtaacccgg

SEQ ID NO: 126780 - DNA, 780 bp, Homo sapiens
  misc_feature: GYAE6OF02H6Z53.12.49.E05.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
tcagatacgacgtacacgaccggtgctcgatttagagcgactagcaacacacaaaggggcagaagtctctctcagtcaggacacagcatggacatgagggtccctgctcagctcctgggacctcctgctgtctcgtcgcctcccagactaccagatgtgacatcgagtactgacccatctccatcccctcgtagttcngactgtcnggtaaggagactaggataccactactcacgttcgggaccgggcgtagtaccgagggaccttaacgttacgttacgttaatttttaccggcgtttaggaacttccgaaagtaccgaaaccggtaaaccggtaaacgggttaacgtacccgaaaccttcccgtacggtattaccgtacgttacgtaccggtaacgttctacctaaccgggttccttaccgtttagttaaaccgtaacgggttacccgtaaccgggtttccccgttaacgtcggttcccggtagttaccccgggacgggtaaccggtggtacgggtttaaaccgtcccggggttaggaaccggttacggggttaaccttaccgtcccggttaccgtcctaaccggtattaccgacgacgtcgtcgactcgactactacgtaagcgttatacctacgtaccgtttaacgtctaaccggtaaattaaaccgacgttacgtacccgtttacccgtaccccgttgtaacccggttaccggtaaccgtccggggaaccttaccggtaacggtacccggtaaaggtacccttaggttaacccg

SEQ ID NO: 126781 - DNA, 925 bp, Homo sapiens
  misc_feature: GYAE6OF02G1NVK.12.49.E05.1.454.CMB.1.raw
  modified_base (150)..(150): a, c, t, g, unknown or other
  misc_feature (150)..(150): n is a, c, g, or t
  modified_base (189)..(189): a, c, t, g, unknown or other
  misc_feature (189)..(189): n is a, c, g, or t
  modified_base (211)..(211): a, c, t, g, unknown or other
  misc_feature (211)..(211): n is a, c, g, or t
  modified_base (696)..(696): a, c, t, g, unknown or other
  misc_feature (696)..(696): n is a, c, g, or t
tcagatacgacgtacacgaccggtgctcgatttagagcgactagcaacacacaaagggggcagaagtctctctcagtcaggacacagcatggacatgaggtccctgctcagctcctgggactctgctgctctggctcccagactaccagntgtgacatcgagatcgacctagtcctacgatccctcctntctgactattcgtaggtacganacgacgtctaccaaccatctacgttcgggaccgggcgtaggtccgaagggtacaacgtttagttaaccgttttaagttttccgacccgttttaggaccgttacgtaaacggcgtaaaaccggaaaaccgggtaacggggttaaaaaccctccccgtaaccgttaccccgacgttaacggcctttaaccgtacgttcgtaccgttaaccgttactcccggttaaccgtttcgtttaaccgaacgtttaaaccgggtacccgggtaaccgggtttaccccgttaaccggtttccgggttaaccggggttaactaccggggtaccgggtacgtaaaccggttcgggaaccgtttacggggtaacggtaacaaaccggggttttcttaacccgcccgtttaacgtaccctaacggtacgtccggaaacgttaccggtaccgtcccgtaacgggtcccttaccggggttaccaaaggttaaccggggttnttaacccgggttttacgaaacctttttaacgggtttttaacctaaaggggtttaaaacccttttaaacgggaaaaaccttacttttaccccggggtacgttaaaccccccgtttcccggttaacccggttaaccccgggggttaaaccgaaccccgaagggggtttaaccccgttacggaaccgggttttaaacggacccggttttaaaacgttaccggggaaacccgg

SEQ ID NO: 126782 - DNA, 642 bp, Homo sapiens
  misc_feature: GYAE6OF02GNKYW.12.49.E05.1.454.CMB.1.raw
  modified_base (159)..(159): a, c, t, g, unknown or other
  misc_feature (159)..(159): n is a, c, g, or t
tcagatacgacgtacacgaccggtgctcgatttagagcgactagcaacacacaaagggggcagaagtctctctcagtcaggacacagcatggacatggagggtccctgctcagctcctgggactcctgctgctctggctcccagataccagatgtgacntcgagatgacccagtctccatccctcctgtctgcatctggtaggagacagacgtcaccatctacgtggccgggcgacggtcgacgggactattagtacttaagttttacgccgttaggtatcgagaccgaacggaaaaccgtaagggtaaacgttaccaacctacccgtccgttagtacttctagtcgtctacgacctacgtccgtctttacgactaacgtccggtaccggggttccctagttccgttacgggttacacgggccggtacgtaggtacggtcgtacggtacgggactaggtacgttaccacgttccactaccactcagacctacgcgtcgacgacgtacgtagaacgtagtcgttacgtacttaacgttacttaacgtacgtaaacgtaaagtacttacgtacggtccctacccgttaccgtaccggtaccggacgtacggtaaccacgacgttaggacgttacgtagtaaccg

SEQ ID NO: 126783 - DNA, 591 bp, Homo sapiens
  misc_feature: GYAE6OF02FGEMC.12.49.E05.1.454.CMB.1.raw
  modified_base (335)..(335): a, c, t, g, unknown or other
  misc_feature (335)..(335): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
tcagatacgacgtacacgaccggtgctcgatttagagcgactagcaacacacaaaagggggcagaagtctctctcagtcaggacacagcatggacatgagggtccctgctcagctcctgggactcctgctgctctggctcccagataccagatgtgacatcgagatgaccccagtctccatcctcctgtctgcatcctgtagagacagatcaccactcacttgccgggcgacgtcagggctattacgcttaacttttttagcccttggtacttccgagcaagaaaaccacgggtaaaagttcccaactaccctcctggaacttctaatgctcggnacttccggactttcgctaatccgtaggggtccccaattctcggtttaccaagccgggcagtcggattcgtagggacaagtagttcactcacaacnctanacgcaacgccctancngcccttagaacggattcgtttagaccttaactttacgtaactacggtaacaaaagtataaccagtcccgtcccccgttcaaccccggttcgaccggtaaacgggaccaaccggtacgtagggacgacgtttaaccgaacgg

SEQ ID NO: 126784 - DNA, 773 bp, Homo sapiens
  misc_feature: GYAE6OF02F4EN6.12.49.E05.1.454.CMB.1.raw
tcagatacgacgtacacgaccggtgctcgatttagagcgactagcaacacacaaagggggcagaagtctctctcagtcaggacacagcatggacatgagggtccctgctcagctcctgggactcctgctgctctggcctcccagataccagatgtgacatacgagatcgacccagtctccatccctcctgtctgctatcttggtaggacgtacagacgttccaccatccaagttcggaccggggtacgacggtccgagggtacctaagttacgtactttaagtttttacgccgttaggtactactacggacgtaacgaaaccggaacgggtaaaccgttacccaaccgtacccgtaccgtacggtaccttacgtaacttcggtccttcgtaccgtacttcccggtacttttacggaccttaaaccggtccggtaaccgggggttacccctaacgtttccggttaccgggttacgaccgggtaccgggtacggtacgggtacgggttacgttaccgggtaacggggtaccctaaggtaccggttaacctccggttaccaccgttaccgactaccggtaacgcgaacccgtcgtacggcctaacgtcgtaccgaaggtattcggtaactaaaccggtttaacttaacgtttaacgttaacgtaaagttaaaaccgttcgtaacgttcccgtaccggttaccccgttcgtaacccgttccggaaacggtaccggtaactaccggacgtaacgggtacgttaacgtacgttaaccgg

SEQ ID NO: 126785 - DNA, 528 bp, Homo sapiens
  misc_feature: GYAE6OF01C4DYP.35.81.H04.1.454.CMB.1.raw
  modified_base (363)..(363): a, c, t, g, unknown or other
  misc_feature (363)..(363): n is a, c, g, or t
  modified_base (522)..(522): a, c, t, g, unknown or other
  misc_feature (522)..(522): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcacccgcagcagtggcagcattacctccggctatgtgcagtggtaccagcagcgcccgggctcttcccccaccaccgtcatccgtgaagacactaaaaggccctcgtggggttcctgatcggttctctggctccatcgacacgtcctccaattcngcctccctaaccatctctggactgaagactgaggacgaggctgactactactgtctagttcttttggaggcaacgatctggtgggtgttcgggcgggggaccaagctgaccgtctaagtcgacgcccaaggctcgccccctcggtcactctcgttcccnccctcc

SEQ ID NO: 126786 - DNA, 542 bp, Homo sapiens
  misc_feature: GYAE6OF01DCA6M.35.81.H04.1.454.CMB.1.raw
  modified_base (218)..(218): a, c, t, g, unknown or other
  misc_feature (218)..(218): n is a, c, g, or t
  modified_base (349)..(349): a, c, t, g, unknown or other
  misc_feature (349)..(349): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgcacccgnagcagtggcagcattacctcggctatgtgcagtggtaccagcagcgcccgggctccttccccacaccgtcatccgtgaagacactaaaaggccctctggggttcctgatcggttctctgtctccatcgacncgtcctcaattctcgcctccctaacatctctggactgaagactgacgagagctgatactactgtcagttctttgagggactacgtatcgtggtgggttgttcgggcgggggaccaggctagaccgtacctaaggtccacgcccgaaggcctccggccccgtcggtccacctcgttcgttcccggcccttcccg

SEQ ID NO: 126787 - DNA, 566 bp, Homo sapiens
  misc_feature: GYAE6OF01CM1KJ.35.81.H04.1.454.CMB.1.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (457)..(457): a, c, t, g, unknown or other
  misc_feature (457)..(457): n is a, c, g, or t
  modified_base (556)..(556): a, c, t, g, unknown or other
  misc_feature (556)..(556): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcagccccatctgtgtcggagtctccgggaaancggttaccatctcctgcacccgnagcagtggcagcattacctcggctatgtgcagtggtaccagcagcgcccgggctccttcccccaccaccgtcatccgtgaacgacaactaaaacggccctacgtcggggttcctgactcggttctctggcctccatcgacacgtcctcaattctcgcctccctaacactctctgactgaagactgacggacgaggtctagacttactactcgtctagttcttttggacgggtacaacgtntcgtggtgggtgttcgggcggggacaggcgtcggtaccgtcgtagcgacggacccgaaggtcctccgtcccccgtcggtccaccgttctccgttccccncccgttcccg

SEQ ID NO: 126788 - DNA, 526 bp, Homo sapiens
  misc_feature: GYAE6OF01ETZWV.35.81.H04.1.454.CMB.1.raw
  modified_base (216)..(216): a, c, t, g, unknown or other
  misc_feature (216)..(216): n is a, c, g, or t
  modified_base (428)..(428): a, c, t, g, unknown or other
  misc_feature (428)..(428): n is a, c, g, or t
  modified_base (519)..(519): a, c, t, g, unknown or other
  misc_feature (519)..(519): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccggggaaagcggttaccatctcctgcacccgnagcagtggcagcattacctccggctatgtgcagtggtaccagcagcgcccgggctcttcccccaccaccgtcatccgtgaagacactaaaaggccctcgtggggttcctgatcggttctctggctcatcgacacgtcctccaattctgccctccctaaccatctctgactgaagctgacggacgaggctgactactactgtcagttctttgnggcaacgatcgtggtgggtgttcgggcggggacagcgtgaccgtctaagtcgacgaccgacggctcgccccgtcgtcactcgtcgttcccnccctccc

SEQ ID NO: 126789 - DNA, 628 bp, Homo sapiens
  misc_feature: GYAE6OF01B029F.35.81.H04.1.454.CMB.1.raw
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctccgggaaagacggttaccatctcctgcacccgcagcagtggcagcattacctccggctatgtgcagtggtaccagcagcgcccgggctccttcccccaccaccgtcactccgtgaagacaactaaaacggccctcgtcggggttcctgatcggtctcgtggctcatcgacacgtcctccaattctgccctaccctaacactctctggactgaacgcgtgaaggacgaggctagacctactactcgtctagttcgttttaggacggtcgaacgtagtcgtaggttggggttcggttcggggaccggggggtaccaacggccgttacgggtacccgttacccggttaaacgtaccgaccggtacccgtaacgggcccgttcccggccccccgttcgggttccctaacccgttcccgttcccgtttcccccggccccgttaccccgg

SEQ ID NO: 126790 - DNA, 551 bp, Homo sapiens
  misc_feature: GYAE6OF01EF63D.35.81.H04.1.454.CMB.1.raw
  modified_base (435)..(435): a, c, t, g, unknown or other
  misc_feature (435)..(435): n is a, c, g, or t
  modified_base (540)..(540): a, c, t, g, unknown or other
  misc_feature (540)..(540): n is a, c, g, or t
tcagtacagatcgtcacgaccggtgctcgatttagtagtgtagattcgcgggtgacggtggtgggggaagagcccgggcgctgctgggctccactacttctcaccctcctcgctcactgcacaggttcttgggccagtttcacgctgactcagccccactctgtgtcggagtctccggggaagacggtgaccatctcctgcacccgcagcagtggcagcattaccagcaactatgtgcagtggtaccaacagcgcccgggcagttcccccaatactctgatctataaaggtgatcaaagaccctcgtcggggtccctgatcggttctcgtgggtccatcgacagctcctccaactctcgccctccctcactatcctctggactcaagactaggaggacgaggctagactattactgtcagttcttatgatggtanactaagtatggtggttcttcgggacggacgggacaagcgtcgaccgtccgtaggtccacgcccgaagccctccgcccccgtggtccctacttcctaccttccccnccctcctaccg

SEQ ID NO: 126791 - DNA, 641 bp, Homo sapiens
  misc_feature: GYAE6OF01EWA7G.35.81.H04.1.454.CMB.1.raw
  modified_base (218)..(218): a, c, t, g, unknown or other
  misc_feature (218)..(218): n is a, c, g, or t
  modified_base (319)..(319): a, c, t, g, unknown or other
  misc_feature (319)..(319): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagttttatgctgactcagccccatctgtgtcggagtcgtccggggaagacggtgaccatctcctgccacccgnagcagtggcagcaattaccagcaaactatgtgctaggtcggtaaccaacaggccggcccgggctaccgttcccccaatacctctgatactaagtaaaggtnaatacaaacgtaccctcgtcgggtccctggtacgttcggttcctcgtcgggtaccagtcgacgtactcctcctacctaactcctccgtccctacccgtctacttactccgtcgtcggactacgaacgtacaggtacggacgacgtctacggtacttacttacgtgttatacgttacttagtaggtagttacggtaagtacgttaaagttgttacggtttcgtacggttcggggaccggtaacgggaccgtacgtacggtacgtacccggttcgtaacggaccgtaaccgtaccgtaaaccgtccgttcccgccccgttacgg

SEQ ID NO: 126792 - DNA, 520 bp, Homo sapiens
  misc_feature: GYAE6OF01DWY9I.35.81.H04.1.454.CMB.1.raw
  modified_base (216)..(216): a, c, t, g, unknown or other
  misc_feature (216)..(216): n is a, c, g, or t
  modified_base (489)..(489): a, c, t, g, unknown or other
  misc_feature (489)..(489): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagacggttaccatctcctgcacccgnagcagtggcagcattacctcggctatgtgcagtggtaccagcagcgcccgggctccttcccccaccaccgtcatccgtgaagacactaaaaggccctctggggttcctgatcggttctctggctccatcgacacgtcctccaattctgcctccctaaccatctctgactgaagactgaggacgaggctagactactactgtcagttcttttgaggcaacgatctgtgggtgttcgggcggggacagctgacgtcctagtcgacgccgaaggcncgcccctcggtcactctcgtcccgcctcccg

SEQ ID NO: 126793 - DNA, 737 bp, Homo sapiens
  misc_feature: GYAE6OF01ELYAJ.35.81.H04.1.454.CMB.1.raw
  modified_base (216)..(216): a, c, t, g, unknown or other
  misc_feature (216)..(216): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctaccgggaaagcggttaccatctctgccaccgnagcagtggcagctacttacctcggactatgtgctaggtcgtaccagcgaggccgcccgggtctcccttacccccgacctaccgtccacgtccggtagaaacgtaccaacgtaaaacggcccctaggttcggggttacctagtacgttccggttctcggttacggcctcctagtccgactaccgtcctaaccgtaactttccgtacgtacccctacccgtaacctctccttcgtacggtacttagaacgtacgtacggaacggacggacgtccgtacgtaaccgttacttacgtacgtcgtaagtttcgttttacggacgggtactaacggtcgttacgttgggttacggggttccgggttaccgggggtaccggggtaacctaaccgggtcgtaccgggtaacccgtttaccggtaaacgtaccggaccggtaccccggtaacggtcccgtaccccgttcccccggttacggttacccaacccgtttcccgttaccccgttcccccgtaccccgttacccg

SEQ ID NO: 126794 - DNA, 626 bp, Homo sapiens
  misc_feature: GYAE6OF01ADU74.35.81.H04.1.454.CMB.1.raw
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
tcagtacagatcgtcacgaccggtgctcgatttagtagtgtagattcgcgggggtagctcaggaggcagagcctggagcatctccactatggcctgggctccactacttctcaccctctcgctcactgcacaggttcttgggccagtttcacgctgactcagccccatctgtgtcggagtctccgggaaancggttaccatctctgcaccgnagcagtgcagcattaccgtcggctagtcgtgcagtggtaccagcagcgccgggctcttcccccacaccgtcatccgtagacgacactaaaaggccctacgtcgggttcctgacgttcggttctctggctccatcgacacgtcctaccgaattctcgccctccctaaacnctactctaggtaccttagaagtacctaggnggaaccgaggactcgtaactactacgtcgttacgagttcttttacggacggtccgaacgtagtccgtaggttcgggtagggtttccgggacgggggtaccaacggtcgtacggtacccgttaccgtaagtacccgaacgcccgtaaaggtcccgttaccggaccccccgttacgggtcctaacgtccctttacgttcccccctcccgttaccccg

SEQ ID NO: 126795 - DNA, 559 bp, Homo sapiens
  misc_feature: GYAE6OF01B3WRA.35.81.H04.1.454.CMB.1.raw
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgcacccgcagcagtggcagcattacctccggctatgtgcagtggtaccagcagcgcccgggctcttcccccaccaccgtcatccgtgaacgacactaaaaggccctcgtggggttcctgatcggttctctggctcatcgacacgtcctccaattctgccctccctaacatctctggactgaagactgaggacgaggctagactactactgtcagttcttttgagggtacaacgattcgtggtagggttggttcgggcgggggtaccaggctacggaccgtccgtaagtccgacgacccgaaggtcctcgtccccctcggtaccacgttcctcgttccccgcccttcccg

SEQ ID NO: 126796 - DNA, 530 bp, Homo sapiens
  misc_feature: GYAE6OF01BA8OO.35.81.H04.1.454.CMB.1.raw
  modified_base (192)..(192): a, c, t, g, unknown or other
  misc_feature (192)..(192): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaanacggttaccatctcctgcacccgcagcagtggcagcattacctccggctatgtgcagtggtaccagcagcgcccgggctcttcccccaccaccgtcatccgtgaagacactaaaacggccctcgtcggggttcctgatccgggttctcgtggctccatcgacacgtcctccaattctcgccctccctaaccatctctgactgaagactgaggacgaggctgactactactgtcagttctttgaggcaacgatctggtggtggttcggcgggggacagcgtgaccgtctaagtcacgcccaggctcgccccctcggtccactctcgtccccgccctccc

SEQ ID NO: 126797 - DNA, 620 bp, Homo sapiens
  misc_feature: GYAE6OF01BZAVV.35.81.H04.1.454.CMB.1.raw
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
  modified_base (465)..(465): a, c, t, g, unknown or other
  misc_feature (465)..(465): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctggctcacgccccatctgtgtcggagtctaccgggaaagccggttaccatctcctgccacccgcagcagtggcagcattaccctccggctatgtgcaggtggtaccagcagccgcccgggctccttcccccaccaccgtcactccgtagaagacactaaaacggccctacgtcgggttcctgtagttccggttctcgtggcctccatccgacacgtccnctaatctcgcctccctaacnctctctgtactgaancgtggagagagtcacgtactactctgtctagttcgtttaggacgggacaaacgtnttacggttggttggggtcgggtttccgggggacgggggtaacccaaggtcccggtacgtacccgttaccgtaagtaccgaccgacccgtaacggtccctccggtccccccttcggtcccttacccgttccttcccgttcccccgtcccgtacccg

SEQ ID NO: 126798 - DNA, 711 bp, Homo sapiens
  misc_feature: GYAE6OF01C649T.35.81.H04.1.454.CMB.1.raw
  modified_base (217)..(217): a, c, t, g, unknown or other
  misc_feature (217)..(217): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctaccgggaaagcggttaccatctcctgccacccgnagcagtggcagctattaccctccggctatgtgcagtcgtaccagcagccgccgggctccttcccccaccaccgtcactccgtagaacgacaactaaacggccctgtcggggttacctgtactcggttctcgtggcctcctatccgaccaccgtccctaccgtaacttctccgtccctacccctaacctacttccgtctcggtaccttagaacgtaccgtagggacgggacgtacgggtctacgtaaccttacgttaccttgtactacggtttcgttttaggaacgggtaccaaacggttcttacggttcggttcgggggttcgggttaccgggggtacccggggggtaaccggtacggtaccggtacggttaccccggttaccggttaaacggtcccggaacggacccgtaaacgggtcccgtccccgggttacccccctccgggttaccctacccgttcccgttacccggttcccccctaccccgttaccccg

SEQ ID NO: 126799 - DNA, 589 bp, Homo sapiens
  misc_feature: GYAE6OF01EUB5J.35.81.H04.1.454.CMB.1.raw
  modified_base (218)..(218): a, c, t, g, unknown or other
  misc_feature (218)..(218): n is a, c, g, or t
  modified_base (369)..(369): a, c, t, g, unknown or other
  misc_feature (369)..(369): n is a, c, g, or t
  modified_base (454)..(454): a, c, t, g, unknown or other
  misc_feature (454)..(454): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgccacccgnagcagtggcagcattacctccggctatgtgcagtggtaccagcagcgcccgggctcttcccccaccaccgtcatccgtgaagaccactaaaacggccctcgtggggttcctgtatcggttctctggctccatcgacacgtcctccaattcngtccctccctaaccatctctggactgaagactgacggacgacggctgacctactactgtactagttcgttttggacggcaacgtnttcgtggttggggtggttcggggcgggggaccaggtcgtacggtacccgtaccgtaacgtcgacgacccgtaacggccctccggccccccgttcggtcctaccttccgttcccgttcccccaccccgttaccccg

SEQ ID NO: 126800 - DNA, 677 bp, Homo sapiens
  misc_feature: GYAE6OF01EZ9UX.35.81.H04.1.454.CMB.1.raw
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcagccccatctgtgtcggagtctccgggaaagacggttaccatctcctgcacccgcagcagtggcagcattacctcggctatgtgcagtggtaccagcagccgcccggctccttcccccaccaccgtcactccgtgaacgaccacgtaaaacggccctcgtcgggttctgattcggttctcgtcggctccagtcgactacgtcctcctaacttcctcgtccctacccctaacctacttctcgtcggtactaggaaacgtacgtaggaacgggacgacggtctacgaacctactacgttgtacgtagtttcgttttaggacgggtaccaacggtatcgttagggttcggggttacggttccgggacgggttacgggggaacctaagggtccgtaccgggtacccggttaaccgtaacggtccgaaccgggtaccccgtaaacgggtccccgttacccggacccccccgttacgggtaccctacccgtttcccgttcccgttcccccctaacccccg

SEQ ID NO: 126801 - DNA, 692 bp, Homo sapiens
  misc_feature: GYAE6OF01CE36M.35.81.H04.1.454.CMB.1.raw
  modified_base (227)..(227): a, c, t, g, unknown or other
  misc_feature (227)..(227): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcacgccccatctgtggtcggagtccgtaccgggaaagtaccggttaccatctcctgaccacccgnagcagtcggcagctacttaccgtccggatagtcgtgcgtaggtcggaccaggcaggcccggcccggtccttccgtccccccacaccggtcctactccgtagaacgaacctaaaccgtaaaaccggtcccgtacggttccgggttcctagtacgttcggttctcgtcggtcctcctagtccgtactaccgttccctactaacttcctacgtaccctaccctaaactctctcgtacgtacagtaacgccgtagacggacgacggtctagtacctactacgtcgtaacgttcgtttcgtttaggacggtaacacgttatcggtgggttcggggtggttccgggggacgggaacctcggtacgtacggtacccgtacctaaggccggaaccgcccggtaagtccccgtcccggtccccctagggttaccctacgttaccccgttcccgtaccccctacccgttaccccg

SEQ ID NO: 126802 - DNA, 714 bp, Homo sapiens
  misc_feature: GYAE6OF01C2GJO.35.81.H04.1.454.CMB.1.raw
  modified_base (218)..(218): a, c, t, g, unknown or other
  misc_feature (218)..(218): n is a, c, g, or t
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
tcagtacagatcgtcacgaccggtgctcgatttagtagtgtagattcgcggggggtagctcaggaggcagagcctggagcatctccactatggcctgggctccactactctcaccctcctcgctcactgcacaggttcttgggccagtttcacgctgactcacgccccatctgtgtcggagtcgtaccgggaaagcggttaccatctcctgccaccgnagcaggtggcagctacttaccgtccggctatggtcgcaggtgtaccgagcgacgccggcccggctccttcccccaccnccgtcactccgtgaacacaacgtaaacgcctcgtcgggttccngtacgttcggttctcgtggtctccgactcgacgtaccgtcctacctaacttcctccgtacccttacccctaacctacttcctcgtacggacgtacgtaaacgtacgtagggaacggaaccggcgtacgttaccgtaacttaaccgttaaccgttcggtacccgttaaggtttccggttttacgggaacggggtaaccaacggtttaacttccgggttagggttcgggggtttacgggtttacccggggggaccgggggaactacgggtccgtaccggtaacccgtaccgtaacgtcgaccggacccgtacggtcccgttcccggccccggttcgtacctaccctccggtttcccgtcccccgtcccgttaccccg

SEQ ID NO: 126803 - DNA, 757 bp, Homo sapiens
  misc_feature: GYAE6OF01C3EA1.35.81.H04.1.454.CMB.1.raw
  modified_base (216)..(216): a, c, t, g, unknown or other
  misc_feature (216)..(216): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccactctgtgtcggagtctccgggaaagcggttaccatctcctgcaccgnagcaggtgcagctacttacctccggctatgtgcagtggtaccagcagccgcccggctccttccccaccaccgtcactccgtagaacgacaacgtaaaacggcccttacgtcggggttcctaggattcggttctacgtcggctccgaatccgactaccgttccctacctaacttctccgcccttaccctaaacctattcctacgtcggaacttacggaaacgtaaccgttaggaacgggtaaccggacgggtacttacggtaacccttaacgttacgttcggttacgtaacggtttccgtttttacgggaacgggtactaacggtaacgtttcggtttacggggttacggggttcgggttaccggggggacccggggggtaaccgtaacgggtccggttaccggtaacccggttaccggttaacggtacccgtaaccggtaccccgtaacgggtccccgttacccggtccccccggttaccggttacccgttaacccgtttcccggtttaccccggttccccccggtcccctttacccccgg

SEQ ID NO: 126804 - DNA, 916 bp, Homo sapiens
  misc_feature: GYAE6OF01D3V48.35.81.H04.1.454.CMB.1.raw
  modified_base (218)..(218): a, c, t, g, unknown or other
  misc_feature (218)..(218): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgccacccgnagcagtggcagcattacctccggctatgtgcaggtggtaccagcagccgcccgggctcctcccccaccaccgtcactccgtagaacgacaacgtaaacggccctcgtcgggttcctgacttcggttctcgtcggcctccatcgactacgtcctacctaactttctcgtccccttacccctaaacctacttcctcgttacgggaccttacggaaacggtaccgttagggaacggggtaaccggtacgggtaccgttacgtaaaccccgttaaccgttaaccgtttcggttaacccgtttaacgggtttttacccggtttttttacggggaaccgggggtaacccgtaaaccgggttaacgtttacccgggtttagggggtttaccggggggggttttaccggggttttacccggggggggggaaccccgggggggggtaaaccccgttaacggggttacccggttaacccggggttaaccccgggtttaacccccgggttaaaacggggttaccccggtaaaccccggggttaaccccccgggttaaaaccgggggttccccccgtttacccccgggggttacccccccccccggttttacgggggtttaacccccttaaacccccgggttttcccccggttttaacccccgggtttttaacccccccccgtaaccccccgtttttaaacccccccggg

SEQ ID NO: 126805 - DNA, 699 bp, Homo sapiens
  misc_feature: GYAE6OF01CYGX9.35.81.H04.1.454.CMB.1.raw
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgccacccgcagcagtggcagcattaccctccggctatggtgcagtggtaccagcagccgcccgggctccttcccccaccaccgtcactccgtagaacgacaacgtaaaacggcccttacgtcggggtttcctggtacttcggttcctcgtcggcctccgatccgacaccgttcctaccgtaacttccgtcgccccttaccctaaacctcttcctcgtggaaccttaggaacgtacgtaggacgggacggtacggtctacggtaccttaccgtacgtcgtactagtttacctttaagtacggtaattacgttaccgtacctacttccgttcggttcgggttccgtttaccgggggccggggggtaaccgtacgggtaccttacgggtaccccgttacgtaaacggttccgaaccggtaccccgaaacgggtcccgttaccccggtccccccgtttacggtccccgtaaccttcccgttcccggttaccccccg

SEQ ID NO: 126806 - DNA, 755 bp, Homo sapiens
  misc_feature: GYAE6OF01AGE7M.35.81.H04.1.454.CMB.1.raw
  modified_base (250)..(250): a, c, t, g, unknown or other
  misc_feature (250)..(250): n is a, c, g, or t
  modified_base (475)..(475): a, c, t, g, unknown or other
  misc_feature (475)..(475): n is a, c, g, or t
tcagtacagatcgtcacgaccggtgctcgatttagtagtgtagattcgcgggggtagctcaggaggctagagcctggagcatctccactatggcctgggctccactactctcaccctctcgctcactgcacaggttcttgggccagtttcacgtctgactcacgccccatctgtgtcggagtccgtaccgggaaagccggttaccattcctcctcgccgacccgcgagtccgagtggcagctacgttccnccgactagtgtgcgtaggtggtacccaggccaggcccgcccggggtccttcccgttacccccaccgtaccgtacctaacgttccggtagaacacctaaacgtaaaacggcccgttcgttcggggttccctggtacgttccggttctccgtcggtaaccctccgtacgtacccgtaccggtccttcccgtaacgttacttccgccgttacccctaccctaaacctntccgtcgtagtccgagacgtcgtacggaaggaccgtacggtacaccgtacttaactcgtctacgtcgtttcggttaggacgggtactaacggtcttccgggtgggttcgggttaccgggtccgggggtaacgggacccgtacgggttaccgtaccgggtacccgttaccggtaaccgttaccggtacccgggaccgtaacccggttccccgggttccccgtaacccccggttcggttacccgtacgtttcccgaccccgttacccccgtaccgttacccg

SEQ ID NO: 126807 - DNA, 758 bp, Homo sapiens
  misc_feature: GYAE6OF01CNTKK.35.81.H04.1.454.CMB.1.raw
tcagtacagatcgtcacgaccggtgctcgatttagtagtgtagattcgcgggggggtagctcaggaggcagagcctggagcatctccactatggcctgggctccactacttctcaccctcctcgctcactgcacaggttctttcgggcctagtttcacgctgactcacgccccactctgtgtcggagtcgtaccgggaaaggtacggttaccatctcctcgccacccgcacgcagtcggcagctacttacccgtccggctagtgtgccgtagtcggtaccagcgacggccggcccgggtccttccccttacccccgccgaccggtctacggtacccgtagaacgaacctaaacgtaaaccggccccttaggtcggggttacctgacgtttcggttactcgtcggccttccagtaccgacctacccgtcctacgtaacttccgtacccgtcccttaaccctaactactccgttactacgggtactaggtaaacgtcgtaaggacgggtaaccgaacggttcctaacggtaacctttaccgttaacggttcgttaaccgttaaggtttccggttttaacgggacgggtaaacctaacggttaacgttccggttaggggtcggggtttcggtaccgggggtaccggggaactacgggcgttaccggacgtaccgtacgtaccgacgtaccggtaacggtcccgtcccggtacccccgttggtaccttaccgttcccggttacctcccccgcccttacccgg

SEQ ID NO: 126808 - DNA, 547 bp, Homo sapiens
  misc_feature: GYAE6OF01EDBSG.35.81.H04.1.454.CMB.1.raw
  modified_base (193)..(193): a, c, t, g, unknown or other
  misc_feature (193)..(193): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (450)..(450): a, c, t, g, unknown or other
  misc_feature (450)..(450): n is a, c, g, or t
  modified_base (540)..(540): a, c, t, g, unknown or other
  misc_feature (540)..(540): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctccgggaaancggttaccatctcctgcacccgcagcagtggcagcattaccnccggntatgtgcagtggtaccagcagcgcccggctccttcccccacaccgtcatccgtgaagacactaaaacggcctcgtgggttccngtatcggttctcnggctcatcgacacgtcctcaatctcgcctaccctacctatctcgtggtacctgaacgactggacgacgaggctagtacctactactgtacagttccttttagacgggtcaacgntcgtaggtgggtagttcgggcgggggtacaagcgtgtaccgtccgtaagtcgacgacccgaggcgtacgcccctcggtcactctcgtccnccgtccc

SEQ ID NO: 126809 - DNA, 743 bp, Homo sapiens
  misc_feature: GYAE6OF01BY4WU.35.81.H04.1.454.CMB.1.raw
  modified_base (229)..(229): a, c, t, g, unknown or other
  misc_feature (229)..(229): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcacgccccactctgtgtcggatccgtaccggggaaagtaccggttaccattcctccgtgaccacccgnagcagtggacagctacttaccgtcggctagtgtcgcgtaggtacggtaccagaccgacggccggcccgggtccttaccccgttacccccgaccgtaccggttaccacgttccgtagaaaccgaccgtaaaccgtaaaaccggtcccgttacgtacgggggttacccttaggtacgtttccggttctccgtacgggtacctaccgtacgtaccggtacctaccgttaccctaccttaacttccgtaccgtacccttaaccctaaccttactccttacgtacggtactacggaacgtacgtacggaacgggacgacgggtactacggtaactacgttacgtcgttacgttacggtttacgttaggacggtactaacgtcgtacggttgggttcggggtcggtaccgggggacgggaccgagtccgtaccggtaccgttacgtaacgcgaccgtaccgacggtcccgtcccgtccccgtacgtcctccgtaccgttcccgtccccgtcccttacccg

SEQ ID NO: 126810 - DNA, 719 bp, Homo sapiens
  misc_feature: GYAE6OF01CY85T.35.81.H04.1.454.CMB.1.raw
  modified_base (237)..(237): a, c, t, g, unknown or other
  misc_feature (237)..(237): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctaccgggaaagacggttaccatctcctgccaccgcagcagtcggcagcattaccncggctatgtgcagtgtaccagcagccgccggctccttcccccacaccgtcactccgtgaacgacaactaaacggcccgtacgtcggggttcctggtactccggttctcgtggcctccactcgactaccgtcctacctaattcctacgcccttaccctaaccacttccgttcgtacggtaacctacggaacgtaacgtacggtaacgggaaccgtacgggtaccgttacgtaccgttaacgttacgttacggtaccgtacggtttcgttttacgggaacggtacgtaaacggtagttcggttgggtttacgggggttcgggttaccgggggaccggggggtaacccgtagggtaccgttaacggtacccggttaacccgttaacggtacccgaacgggtaccccgtaaacgggtcccgttcccggaccccccggttcggtacccgtaccttcccgttaccgttcccccgtacccttacccccg

SEQ ID NO: 126811 - DNA, 764 bp, Homo sapiens
  misc_feature: GYAE6OF01CH9O6.35.81.H04.1.454.CMB.1.raw
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgccccactctgtcgtcggagtccgtaccgggaaagtaccggttaccatcctcctcgccacccgcagcaggtcggcagctaacgttacccgtccggcttagtggtcgactaggtcggtaccacgcaggccggcccgggcctccttccccccaccaccgtcactccgtagaacaccaaacgtaaacgccctcgtcgggttcctgacttcggttctcgtcggtcctcacgtacgaactccggttccctaacctaacgttcctaccggtacccttaccccgtaaacctacttccttacgtacggaacctaggaaacgtaccgttcgggaaacgggaccggtacgggtacttacggtaaccttaacgtaaccgttggttaccgtacgtttcgtttacgggaacggtaactaacggtacgttcggttggggttcggggtttacgggtcccggggggtaccggggggaaccctagggtaccggtaccgggtaacccgtacccggttaagtaccggtaacccgggacccgaacgggtcccgttccccggtacccccgttcggtacccgtaccgttcccgttcccggttcccccggccctttaaccccgg

SEQ ID NO: 126812 - DNA, 579 bp, Homo sapiens
  misc_feature: GYAE6OF01A4377.35.81.H04.1.454.CMB.1.raw
  modified_base (351)..(351): a, c, t, g, unknown or other
  misc_feature (351)..(351): n is a, c, g, or t
  modified_base (383)..(383): a, c, t, g, unknown or other
  misc_feature (383)..(383): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgccacccgcagcagtggcagcattacctccggctatgtgcagtggtaccagcagcgcccggctcctcccccacaccgtcactccgtgaacgacaacgtaaaacggccctcgtcgggttcctgactcggttctctggctcntcgacacgtcctcaattctcgccctcctaacntctctgactgaacgctgaggacgagctgactactactgtctagttctttggaggtccaacggtctcgttggtcggggttcggttccggggacgggggaccaggtcgtcgtaccggtacctacggccgacggcccgaacggccctccggtcccccgtcggtacctaccttccgttccgttccccgcccgttaccccg

SEQ ID NO: 126813 - DNA, 725 bp, Homo sapiens
  misc_feature: GYAE6OF01CCA9S.35.81.H04.1.454.CMB.1.raw
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccactctgtgtcggagtctaccgggaaagtacggttaccatctcctgcacccgcagcagtgcagcattaccgtccggctatgtgcagtggtaccagcagccgcccgggctccttcccccaccgaccgtctacgtccgtagaacgacaacgtaaacggccctcgtcgggtcctgacttcggtctcgtcggtcctcactcgacgtaccgtccctactaacttcctcgtaccccttaccctaacctactccgtcgtacggactacgaacgtacgtaggacggacggacggactacgtactacgtacttgtactacggttcgttttacggacggtactaacgtacttcggttacgggttcggggttcgggttccgggggacggggggtaacccgtaacggtccgttaacgggtacccgttacccggtaacggtacccggtaacccgggtaccccgtaaaccgggtccccgttaccccggtaccccccggtttaccccgggttacccttaccccggttacccggttttcccccggttaccccccgttacccccgttacccccgg

SEQ ID NO: 126814 - DNA, 691 bp, Homo sapiens
  misc_feature: GYAE6OF01DEM2Q.35.81.H04.1.454.CMB.1.raw
  modified_base (207)..(207): a, c, t, g, unknown or other
  misc_feature (207)..(207): n is a, c, g, or t
  modified_base (386)..(386): a, c, t, g, unknown or other
  misc_feature (386)..(386): n is a, c, g, or t
tcagtacagatcgtcacgaccggtgctcgatttagtagtgtagattcgcgggtgacggtggtgggggaagagcccgggcgctgctgggctccactacttctcaccctcctcgctcactgcacaggttcttgggccagtttcacgctgactcagccccactctgtgtcggagtctccgggaaagacggttaccatctcctgcacccgnagcagtggcagctattaccgtccggctatcgtgcaggtggtaccagcaggccgcccgggctccttcccccacaccgtcactccgtagaagacactaaaacggccctacgtcggggttcctgacttcggttctcgtggctccatcgacaccgtcctcaacttctcgccctacctaaccgntactcgtcgactgaacgacgtggacggacggacgtctacgtacttatttacttgtactaggttcttagtcgtatactccgactaccttcgttggttcggtcgggtttaccgggggccgggggtacctacgggtccgttacgggtacccgttaccgttaacgttcgaaccggtccccgtaaagggccccgttccggtccccccggttcgggttacccttaaccggttccccgtttcccggtttccccccgtccccgtttaccccgttacccgaccgtttaacgttcccgttacgggttaacccggg

SEQ ID NO: 126815 - DNA, 822 bp, Homo sapiens
  misc_feature: GYAE6OF01EAAY9.35.81.H04.1.454.CMB.1.raw
tcagtacagatcgtcacgaccggtgctcgatttagtagtgtagattcgcgggggggtagctcaggaggcagagcctggagcatctccactatggcctgggctccactacttctccaccctcctcgctcactgcacgaggttcttgggccagtttcacgctgactcacgcccctatctgtggtcggtagtcgtaccgggaaagtaccggttaccatcgtcctcgccacccgcacgcgagtcggacagcctacttacccgtccggtacttaatcggtcgtacgtacggttacggtaaccaaaccgacggacccgggaccccgggtacctaaccgtttaaccccccaaacttaccttacgtacggtaactttaccgttaaagttaaaacgggtacgtaacgttaaccgtaaaaccggttaccccgttccggttacccggggtttacccttaggttaccgtttccggtttccgttccggttccgggtacctacgtaccgacgtacgtcccttacccgtaccctaaccgttcctacccgtccccttaccctacctacttaccttccgttcgtaccgtacctaaccgaacgtcggtaacggaacggaaccgtggtaccttacgttaacttagttccgtagttactacgtttacttagtacgttgtaaggtacgtgtaaacgtttgtcggttacggttacggtaccggggacgggtaacggaaccgttacgtacccggttacggtacccgttacggtaccggtacccgtaaccggaaccccgtaacggtccccgtacccccggtccccggttaccgtccgttacccccg

SEQ ID NO: 126816 - DNA, 628 bp, Homo sapiens
  misc_feature: GYAE6OF01DFSGP.35.81.H04.1.454.CMB.1.raw
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcaccgcagcagtgcagcattacctcggctatgtgcagtggtaccagcagcgcccgggctccttcccccaccaccgtcatccgtgaacgacaactaaaaggccctacgtcggggttcctgaattcggttctcgtggctccgatcgacaccgttcctaccgtaattcctcgtcccttaccctaaacctacttcctacgttcgggaacctacggaaacgtaccgtaggaacgggacgacggctacgacttactaactgtacagttcttttggacggtcaacgacttcgtaggttcgggtggtttacggggccgggggtaccaggtcgtcgtaccgtccgtaaggtccgacggacccgaaggtccgtaccggtcccccgtaccgggttccaccgtttcttcccggttcccctcccttaccccg

SEQ ID NO: 126817 - DNA, 632 bp, Homo sapiens
  misc_feature: GYAE6OF01BAYDI.35.81.H04.1.454.CMB.1.raw
  modified_base (236)..(236): a, c, t, g, unknown or other
  misc_feature (236)..(236): n is a, c, g, or t
  modified_base (620)..(620): a, c, t, g, unknown or other
  misc_feature (620)..(620): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagacggttaccatctcctgcacccgcagcagtggcagctattaccncggctatgtgcagtggtaccagcagcgcccggctccttcccccacaccgtcatccgtgaacgacaactaaacgcctcgtgggttcctgatcggttctctcggctccatcgacaccgtcctcctaattctcgtccctaccctaactactccgtcttacggacttaggaacgacgtacggacgggtaacgagggtctaggtacctaacgtactcgtctaagttcgttttggacgggtcaacgtacttcgtaggttcggggtcggtttaccggggaccgggggtaccaacgggtcgtacgggtacccgttaccgtaagtaccgtacggacccgaacggtccgtccgtcccccgttacgggtccctaccgttaccgtccgttcccccncccgttaccccg

SEQ ID NO: 126818 - DNA, 728 bp, Homo sapiens
  misc_feature: GYAE6OF01CL509.35.81.H04.1.454.CMB.1.raw
  modified_base (223)..(223): a, c, t, g, unknown or other
  misc_feature (223)..(223): n is a, c, g, or t
  modified_base (385)..(385): a, c, t, g, unknown or other
  misc_feature (385)..(385): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgccccatctgtgtcggagtcgtaccgggaaagtaccggttaccatcctcctgccacccgnagcagtggcagctacttaccgtccggctatgtgcagtggtaccagcaggccggcccgggtctcccttcccccaccaccgtcacgtccgtagaacgacaaccgtaaaacggccctcgtcgggttcctgtacgttcggttctcgtggtcctaccactacgaccnccgtacctactaacttctccgacccctaccctaacctacttcctacgttacggaacctagaaacgtacgtagggaacgggacggtacggacttacgaaccttactacgttcgttaccgtagtttacgttttaggaacgggtacctaaaggtcttacggttgggttacggggttcgggttccgggggaaccgggggtaacctacggtccgtaccggtacccgttaccggtaaggtacccggtaacggtaccccgaaacgggtcccgtaccccgggtaccccccgtacggttaccccgtaacccgttcccggttcccccggttcccccgtcccccgtttaccccg

SEQ ID NO: 126819 - DNA, 778 bp, Homo sapiens
  misc_feature: GYAE6OF01BFNDZ.35.81.H04.1.454.CMB.1.raw
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgtctgactcacgcccactctgtgtcggagtcgtacgggaaagtacggttacatcctccgtcgccgaccgcagcgaggtcggcacgactacttaccgtcggtctagtgtcgcgtagtcggtacacgcgacggccggccggtcctcccgttcccccaacgtaccgtacgtaccgtccgtacggaacgtaaccgaaacggtaaaccggtcccgttagggttaccgggttctaggtacgttccggttctccgtcggccttaccgtacgtccgaacctaccggtaccctaacgtaactttccgaccgtacccctacctaacgtcttaccgtcgtacggtaactacggaacggtacgagggaacggacggtacgtaccgtaactaaccgttactacggttgtacctttaggtttaccgtttagggaaccggttaccgtaagtcgtttacgggttacggggttcggggttacggggtaaccgggggtacgggtaaccgtagggttacccgtaccgggtaaccgttacgttaaccggtacccgtaacggtaacccggtacggtccccggttacccgtaccccggtacgttaccgtcccttacccgttaacccgttcccccgtaaccgtacccg

SEQ ID NO: 126820 - DNA, 897 bp, Homo sapiens
  misc_feature: GYAE6OF01BSOZF.35.81.H04.1.454.CMB.1.raw
  modified_base (219)..(219): a, c, t, g, unknown or other
  misc_feature (219)..(219): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgccccatctgtgtcggagtctccgggaaagccggttaccatcctcctgccacccgnagccaggtgccagcctaattacccgtccggacttagtcggtgccgtaggtcggtaccagcgacgccggcccgggtctccttacccccacctacccgtctactccggtagaacgaccaacgtaaaacggccctcggtcgggttacctggtacgttcggttcctcgtcggtcctcctagtccgtaccgtaccggttcctccctaaactttccgtacgtaccccttaacccctaacccgtacttacccgttcgttacggtaaccgttaggaaacgtacgtacggtaacgggaacggtaacggttccgaacgttaacccgtaccttaacggttcgttacggttaacgtttccgtttttaaggggaaccgggttaccgtaaaccggtcgtttaccgggtaggggtttaccggggggtttacggggttacccgggggggaacccggggggttaacccgtaaccgggttacccggtaaccggggttaaaccccggtttacccggtttaaaaccggggttaccccggtaaaccggggttacccccgggtaaaaccggggttccccgtttaccccccgggtacccccccggtttacccgggggtttaccccttaaaccccgggttttcccccgtttccccgggtttaacccccccccgttaccccccggttttaaaccccccccggg

SEQ ID NO: 126821 - DNA, 870 bp, Homo sapiens
  misc_feature: GYAE6OF01DIOVY.35.81.H04.1.454.CMB.1.raw
tcagtacagatcgtcacgaccggtgctcgatttagtagtgtagattcgcggggggtagctcaggaggcagagcctggagcatctccactatggcctggctcactacttctcaccctctcgctcactgcacaggttcttgggccagtttcacgctgactcacgccccactcgtgtgtcggagtctccggggaaagacggttaccatccgtcctcgcacccgcacgctagtcggacagtccaacttacccgtccggctagtcgtgtacgaggttacggtaccacggaccacggtccggtcccggtcgttaccccttccccccgacctacccggttactacttacccggtagtaacggtaacctaaacccggttaaaaccggtcccgtttaccggttcgggggtttaccctgggtaaccgtttcccggtttccgttaccgtacgggtacccttacccgtaacgtacccggtaaccgtacccgttaccccgttaccgtaaacctttcccggtaccgttaccccgttacccctaaacccgtacgttaccttacggtacggtaccgttaaccgaaccggtacgtacgggtaacgggaacgtacggtaccgtaggtaaccgttaaccgttacgttacggttaccgttaggttttacccgtttaggaccggtaacgtaacgtcgttacggttcgggttaggggttccgggttacggggtaccggggtaacccgtagggttacccgtacgggtaacccgttacggtaaccgtccggtaaaccggtacccggtacggttccccggtacccggttccccccggtacggtaccccgttaaccgttccccggttcccgtttaccccccgtccccgttacccgg

SEQ ID NO: 126822 - DNA, 686 bp, Homo sapiens
  misc_feature: GYAE6OF01A519K.35.81.H04.1.454.CMB.1.raw
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtgtcggagtctccgggaaagcggttaccatctcctgcacccgcagcagtggcagcattacctccggctatgtgcagtggtaccagcagcgcccgggctcttcccccaccaccgtcatccgtgaagacactaaaaggccctctgggttcctgactcggttctctggctccatcgacacgtccctaccaacttctcgcccttaccctaacctactccttcgtcggacctagaacgacgtaggagggacgaacggtcgtacgtaaccttacgttaactcgttacctacggtttcgtttttacggaacgggtacctaaaccggtaattccgttgggttaggggttcgggtttccgggggaccgggggggtaaccctaaagggccgttacggtaacccggttacccgtaaacggttccgaaccgggacccccgaaagggtcccgttcccggtcccccccgttcgggtaccctaacccgttcccgttccggtttcccccccggtccccgtttacccccg

SEQ ID NO: 126823 - DNA, 700 bp, Homo sapiens
  misc_feature: GYAE6OF01CSU2O.35.81.H04.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (691)..(691): a, c, t, g, unknown or other
  misc_feature (691)..(691): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcacgcccactctgtgtcggagtctccgggaaagcggttaccatcncctgcaccgcagcagtggcagctattaccnccggctagtgtgctaggtacgtaccagcaggccggaccggcctcccgttacccccacctaccgtcacgtccgtagaacgaaccgaaacgtaaaaccggtccctaggttcggggtttacctacgggtactttccgggttacctcggtacgtccgtacctagttaccggacctaacgttcctacccgtaaacttctaacgccccttaaccaaacctcgttacctcgtcggtaacgtacgtaacgacgtaggaacgggaacggtacggtacaacgtaaccgttaccttaagtcgttcgtaacggtttacgtttagggacgggtaacctacggttaacttccggttagggttgggggttccgggttacggggaccgggggtaaccaggaccggtcgacccgttacgtacgtacgaccgtacccgaggccttccggcctcgtccataccttccgtacccnccgttaccg

SEQ ID NO: 126824 - DNA, 755 bp, Homo sapiens
  misc_feature: GYAE6OF01AOXNY.35.81.H04.1.454.CMB.1.raw
  modified_base (502)..(502): a, c, t, g, unknown or other
  misc_feature (502)..(502): n is a, c, g, or t
  modified_base (619)..(619): a, c, t, g, unknown or other
  misc_feature (619)..(619): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctccactgcacaggttcttgggccagtttcacgctgactcacgccccactctgtgtcggagtcgtaccgggaaagaccggttaccatcctccgtcgccacccggcaacgctaaggtgcagcctacgttaccccgtccggctagtcggttcgacgtacgttcggtaaccaggccgacggccggcccgggtcctcccttacccccaccgtaacccgtccgtaaccgtccggtacgaaccgaacctaaaccgttaaaaccggtccccgttcggttcggggttacctacggactttccggttcctccgtcggcctaccgtacgtccgtaacgtacccgttaccctacgtaacttccgtaactcccccttaacccgtaaaccncgttcctcgtacggtaccgtaacggaacgtccgtaaggaccgggacggtacgaccttaccgtactaaccgtacgttcggtacttcgttaaccgtttcggacgggtaacctaacggtnttccgggtagggtcgggttaggggttaccggggacggggtaacctagtacccggtgtaccgtaccgtacgaccgaacgaccgtaacgccgacccggtccccgtacgtacctcttaccgtccctccccgtactcccg

SEQ ID NO: 126825 - DNA, 836 bp, Homo sapiens
  misc_feature: GYAE6OF01CBN65.35.81.H04.1.454.CMB.1.raw
  modified_base (219)..(219): a, c, t, g, unknown or other
  misc_feature (219)..(219): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggcctagtttcacgctgactcacgccccatctgtgtcggagtctacgggaaagcggttaccatcctcctgccacccgnacgcagtggcagctacttaccgccggattatgtgctaggtcggtaccagacacggccggacccgggtccttccccttcccccaccctaccgtcctacgttccggtaacgaacgtaacctaaaccgtaaaaccggtcccgttacggttaccggggtttcctacggtaccgttccggttaccttcggttccggtacctaccgtacgtaccgtaccgtacccgttccctacccttaacttccgtacccgtcccttaccctaaactcttacctcgtacggactacgtaacgtacgtacggaacgggtacgacggtacgtaacgtaaccgtttaacgttaccgttacgtaccgtttacgtttcggttttaacgggacgggttaaccctaacggttacgttacgggttacgggtttcggggggtttaccggggttaacccgggggaccggggggtaaccgtaacggttacccggttaaccggtaacccgggttacccgtaaacgggtacccggaaccggtaccccggtaaacgggttcccccggtaccccggtacccccggttcgggttaaccctacccggttaccccgttccccggttccccccgttaccccgttaccccgg

SEQ ID NO: 126826 - DNA, 658 bp, Homo sapiens
  misc_feature: GYAE6OF01B66KG.35.81.H04.1.454.CMB.1.raw
  modified_base (216)..(216): a, c, t, g, unknown or other
  misc_feature (216)..(216): n is a, c, g, or t
  modified_base (637)..(637): a, c, t, g, unknown or other
  misc_feature (637)..(637): n is a, c, g, or t
  modified_base (648)..(648): a, c, t, g, unknown or other
  misc_feature (648)..(648): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcacccgnagcagtggcagcattacccgcggctatgtgcaggtggtaccagcgacgtccggcccgggctcccgttccccccaccgtacccgtcactccggtagaacgaaccgaactaaacggcccttcgtcgggttcctaggtacgtccggttctcgtcggtctcgacgtacgtactaccgtccctactaacgttcctcgtacccctacctaaacctacgttccgtcgtacggtactagtaacgtacgtaggaacggacgtacggtctacgtaactacgttacgtgttaccgtagtttcgtttgacgggaactaacgtcgtcgtgggttcggggttcgggtacgggacggggacctgacggttaccgacgttcccgaagtccgacgtacccggacgtccggtcctccccggttcgtaccgtaccttccnccggttccccncccgttaccg

SEQ ID NO: 126827 - DNA, 911 bp, Homo sapiens
  misc_feature: GYAE6OF01B3WJP.35.81.H04.1.454.CMB.1.raw
  modified_base (133)..(133): a, c, t, g, unknown or other
  misc_feature (133)..(133): n is a, c, g, or t
  modified_base (241)..(241): a, c, t, g, unknown or other
  misc_feature (241)..(241): n is a, c, g, or t
  modified_base (281)..(281): a, c, t, g, unknown or other
  misc_feature (281)..(281): n is a, c, g, or t
tcagtacagatcgtcacgaccggtgctcgatttagtagtgtagattcgcggggggtagctcaggaggcagagcctggagcatctccactatggcctggctccactacttctcaccctcctcgctcactgcacnggttcttcgggcctagtttcacgctgactcacgccccactcgtgtcggtcggagtccgtaccgggaaacgtaccggtttaaccacttcctcccgtacgacccgacccncgacgccgtaggtcggccagacctacgttacccgtccggnttacgtcggtacgacgtacggttaccggaacacgaccgacgggtcccggccccgggttaccttccccccgttacccccccgaacccgtacccggttaccgtaacccggttccggtaaaggaaacccgtaaaccgtaaaaccggtaaacccggtcccgttacgggttcgggttaccctagtaccgtttcccggttctaccgtccgtcctaccgacgttacccgacctacccggttacctaccctactttcccgtacccgtacccctttaaaccccgtaatccgttcccgtttacggaacgtaaccgttaggaaaccgtacgggtaacggaacgggtaacggaccggtacttaacccgtaacgttaccttacggttccgttagtttacggtttaccgggtttaggaaccggttacctaacggtcgtttaccgggttggggttacgggtttccgggggtaaccggggtaccgggaaccgttagggtacccggtaaccggttaaccgtttacggaaccggtacccggtaacggtaccccgggtacgttcccccggcccccggttccccggttaccgttacccgtaccccgtttaccccgttaccccctccccccgggttaaccccttaacccgg

SEQ ID NO: 126828 - DNA, 669 bp, Homo sapiens
  misc_feature: GYAE6OF01CA4OL.35.81.H04.1.454.CMB.1.raw
  modified_base (154)..(154): a, c, t, g, unknown or other
  misc_feature (154)..(154): n is a, c, g, or t
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
tcagtacagatcgtcacgaccggtgctcgatttagtagtgtagattcgcggggggtagctcaggaggcagagcctggagcatctccacgtatggcctgggctccactacttctcaccctcctcgctcactgcacacggttctggcctaatttcncgctcgactcacgccccacgtctggtggtccggggtctccggggganaccggttaccctctcctgccacccgcaaacngtggccagcatccgaccaaacaactntcgtgctattcgtaccncgcacggccggcccgggcctaccgtccccatctacttcgtacttattttacgaagtatacgtacgaacgtccctcggtccggtccgttgttcgttctcgtcgctcacgtcgactcgttcctactacttctcctccctccctaccacctctctcgtcggactagaacgtacgtacggaacggtacgacggtcgttacgtacttattagttcgtacgtacgttactttagtacgtagtacggtaacgtacgttacgtagttcggttcggttcggtacggggtacgggtaacggtaccgtacggtccgtaccggtaccggttaccgtaacgtccgaccggacccgtacgtcccgtccccggtaccccgttccggtaccttcccgttcccgttacccg

SEQ ID NO: 126829 - DNA, 601 bp, Homo sapiens
  misc_feature: GYAE6OF01AW3NM.35.81.H04.1.454.CMB.1.raw
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcaccgcagcagtggcagcattacctccggctatgtgcagtcggtaccagcagccggcccgggctccgttccccccacctaccgtcactccgtagaacgacaactaaaacggccctcgtacggggttcctgacgttcggttctcgtggtcctccagtccgaccncgttcctacctaattctcgtcctccctaacnctctctagactgaagacnggaggacgaggctcgtatattattgtactagttcttatagatatcgactactcgtgtcggtcgttcgggaccgggggtacaggtcgtaccggtccgtacccgtaacgtccgtacggacccgtaacgggccgttacccggccccccgttccggtacccgtcctcccgttcccgttacccccc

SEQ ID NO: 126830 - DNA, 802 bp, Homo sapiens
  misc_feature: GYAE6OF01EMB49.35.81.H04.1.454.CMB.1.raw
  modified_base (482)..(482): a, c, t, g, unknown or other
  misc_feature (482)..(482): n is a, c, g, or t
tcagtacagatcgtcacgaccggtgctcgatttagtagtgtagattcgcgggggtagctcaggaggcagagcctggagcatctccactatggcctgggctccactacttctccaccctcctcgctcactgcacaggtttcttgggccagtttcacgctgactcacgccccatctgtgtcggagtcgtaccgggaaagacggttaccatcctcctgccaccgcagccgagtcgcagtcctacttacccgtccggtcttagtgtcgcgtaggtacggtaccacgccacggcccggcccgggtccttccccgttacccccacccaccccggtcctacgtccgtacggaaacgtaaccgaaaccgtaaaacggtccctacggttcgggtttcccgtaggtacgttaccggtttcctcgtcggtcctacccgtagtccgacctaccgtccctacctaacgttcctccgtacccctacccttaaaccnctttaccgtctaccgggtactacgtaaacgtacgtacggaacgggtacccggacggtacctacgtaacccgttaacgttcgttacgttaccgttacgttttacggtttacgggaacgggtacgtaacgttaacggtcggttggggttcggggttacggggttccgggggaccgggggtaacctacgggtcgtaaccgggtaaccgttaccggtaaaccgggtcgtaaccggtaccgggaacccggtccggtacccccggtcccccggttcggtacccgttacccgtttccggttccccgttcccccgttccccgtacccg

SEQ ID NO: 126831 - DNA, 678 bp, Homo sapiens
  misc_feature: GYAE6OF01A3IFD.35.81.H04.1.454.CMB.1.raw
  modified_base (219)..(219): a, c, t, g, unknown or other
  misc_feature (219)..(219): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtgtcggagtcctccgggaaagacggttaccatctcctgccacccgnagcagtggcagcacttacctccggctatggtgcagtgtaccagcagcgcccggctccttcccccaccaccgtcagtccgtgaagacactaaacggccctcgtggggttcctgactcggttactctggtctccattccgacctccgtcctcctaattcctcgccctacccgtaaccatctctcgactgaacgtctaggacggacgaggtctgaacttacctacgttgacgtacgttcgtttggacgggtaccaacggtcgttacggttggttacggggttcgggtttacgggggaccggggggtaaccctacgggtaccgttaccgggtaacccgtttaccgtaaggtcccgaaccgggtaccccgaagggtccccgttaccccgggccccccggtttaccgggtaccccttacccgttacccgtttacccggttcccccccgtaccccgttacccccgg

SEQ ID NO: 126832 - DNA, 895 bp, Homo sapiens
  misc_feature: GYAE6OF01BXBIR.35.81.H04.1.454.CMB.1.raw
  modified_base (403)..(403): a, c, t, g, unknown or other
  misc_feature (403)..(403): n is a, c, g, or t
tcagtacagatcgtcacgaccggtgctcgatttagtagtgtagattcgcggggggtagctcaggaggcagagcctggagcatctccactatggcctgggctccactacttctcacctcctcgctcactgcacaggtttcgttgggcctagtttcacgctgactcacgccccatctgtcgtcggacgttcgtaccggggaaagtaccggttaccagttcctccgtggcccaccgcacggcagtggcagcctacttacccgtccggctacgtgtcgcgtacggtcggtaccagacgacggtcccggcccgggtccttccccgtacccccaacctaccggtcctaacgtccggtaacggaacgtaaccgtaaacggtaaaccggtcccgtcggttacggggttccncggttacgttccggttctccggtcggtacctaccgacgtacgtaacccggttcctaccttaacctacgttccgtcctaccctacccgtaaactcgttccgtcgtaggaacctacgtaaggtacgtacggaacggggaaccgtacggttaaccgtacggttaaccttaaccgggttcgtacgttaccgtttacgggtttacgtttacggggaacgttaacccgtaaggttccggtttaagggttccgggggtttcgggtaccgggggttaccggggggtaccccgggtaaacgtaccgggttccggttaaaacccgggttaaacccgggtacccggttaaaaccgggttcccggtaaaccccggggttacccgaaaccccgggggtttccgttcccccccgggttacccccgggtttcctaacccccggggttttacccctacccggggtttttacccccccggtccccccggtttccccggttaaacccggg

SEQ ID NO: 126833 - DNA, 713 bp, Homo sapiens
  misc_feature: GYAE6OF01BABXL.35.81.H04.1.454.CMB.1.raw
  modified_base (415)..(415): a, c, t, g, unknown or other
  misc_feature (415)..(415): n is a, c, g, or t
  modified_base (456)..(456): a, c, t, g, unknown or other
  misc_feature (456)..(456): n is a, c, g, or t
tcagtacagatcgtcacgaccggtgctcgatttagtagtgtagattcgcgggtgacggtgggtgggggaagagcccgggcgctgctgggctccactacttctcaccctcctcgctcactgcacaggttcttgggccagtttcacgctgactcacgccccatctgtggtcggagtcgtaccggggaaagtaccggttaccatcctcctcgccacccgcagcaggtcggcagctacttacccgccggctagtgtgactaggtcggtaaccagccacggcccggccccgggtcctcccttccccccaccacccgtcactccgtagaacgaaccgtaactaaaaccggcccttcggtcggggttcctcgtacgttcggttctcgtcgtcctccatccgacaccgtcctacctaattccncctccctaccctaacctactcctcgtggtactagagtacgnggaggacgtcggctacgtaccgtacttactgtacttggttacgtttaggacggtacaacggtattcggttcgggttgggttcggggttaccggggaccgggggtacgacggtcgtaccggtacccgttacgtaaccgtcgaaccgacggaacccggtcctacccggtccccgtacggttccctaccgttccccgttacccgttccccctaccccttcccgacctaccgtacttacgttacgtccggtggtaccgggg

SEQ ID NO: 126834 - DNA, 787 bp, Homo sapiens
  misc_feature: GYAE6OF01BMPUQ.35.81.H04.1.454.CMB.1.raw
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcacgccccactctgtgtcggagtctaccgggaaagacgttaccatcctcctcgccacccgcagcgagtggcagctacttaccgtccggtctatgtgcgtaggtcgtaccagcacggccggacccggtccttccccttacccccacctaccccgtctaccgtccggtacgaacgtaaccgtaaaccgtaaacggtccccttggttcgggttcctaggtacttcggtctcgtcgcctcagtaccgactaccgtacctacctaattcctcgtaccccttaacccgtaacctacgttcccttacggtacggtaacgtacgtaaacgtacgtacgggaacgggtaaccggtacggtcttaacggttaacttaacgttttacgtttcggtaacgttacggtttacgtttaacgtacggttaacgttcgtaccgtaaccttaccgttcggtttacgggttacgggttcccgggttaccggggggcccgggggtaaccgtacgggtaccgttaccggtaaaccccgggtttaccgttaacggtacccggaacccggtaccccgaacgggttccccgtccccgtaccccggttcccggtaaccctttacccgttccccggtctttccccccccgg

SEQ ID NO: 126835 - DNA, 759 bp, Homo sapiens
  misc_feature: GYAE6OF01EGZTL.35.81.H04.1.454.CMB.1.raw
  modified_base (234)..(234): a, c, t, g, unknown or other
  misc_feature (234)..(234): n is a, c, g, or t
  modified_base (467)..(467): a, c, t, g, unknown or other
  misc_feature (467)..(467): n is a, c, g, or t
  modified_base (570)..(570): a, c, t, g, unknown or other
  misc_feature (570)..(570): n is a, c, g, or t
tcagtacagatcgtcacgaccggtgctcgatttagtagtgtagattcgcgggggtagctcaggaggcagagcctggagcatctccactatgcctggctccactacttctccaccctcctcgctcactgcactaggtttcgttgggcctagtttcacgtctgaactcaccgcccctacttcgtgttgtacggtagtccggtaccgggaaacgtaccggttacctagttccttccncgacccaccccgcgagaccgtaggcggaccacgtacctacctttaaccgtcccggtacttagtagttcgacgttaacggttccggtaacgacgaccgtacggcccgggtcccgggttccctttcccgttaaccccccaacccgtacccgtacacgttaccgtaaggaaacgtaaccgtaaaccgtaaccgtcccggttacggttcgggttaccaggttcgtttccgtccgttncggtccttacgtacgtaccgactaccgtccctaataccgttcgacctacccgtaacctaacctatcgttacgtacgtagtacgaatagtcggaagcgtacgtntacgtaactactacgtgtacttgttcttaggcgaactaacgtgttgtggttacgggttcgggtacgggacgggaacttacggccttaaccggaccgttaaacgtaccgaccgtaacgaccggtcgtcccggtacccgttccccgtaggttccccacgttcccgttaaccccgtccccgtaaccgtcccg

SEQ ID NO: 126836 - DNA, 752 bp, Homo sapiens
  misc_feature: GYAE6OF01BA3C4.35.81.H04.1.454.CMB.1.raw
  modified_base (134)..(134): a, c, t, g, unknown or other
  misc_feature (134)..(134): n is a, c, g, or t
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (475)..(475): a, c, t, g, unknown or other
  misc_feature (475)..(475): n is a, c, g, or t
  modified_base (667)..(667): a, c, t, g, unknown or other
  misc_feature (667)..(667): n is a, c, g, or t
tcagtacagatcgtcacgaccggtgctcgatttagtagtgtagattcgcgggggtagctcaggaggcagagcctggagcatctccactatcggcctgggctccactacttctccaccctcctcgctcactgcanaggttcgtggcctagtttcacgctcgactcacgcccatctgtcgtcggagtcgtacgggaacgtaccggttacactcgtccgtcgaccaccgnacgtcgtaggtcggacacgtctaacctaccgtcggattntcggtgacgtaggtacggtacacgcgacggccggcccggtcctacccccgtacccccgaccgacccgtacaccggtaccggtaacgaaacgtaaccgaaaccggttaaaccgtcccgtttacgggtcgggttcctacggtacggtttccggttactccggttacgccttaccgagtaccctaacgtccgtaccctacctaacgttcccnccgtaaccctacccgttaactaccgtctaccgttaagtaacctacggtaacgagtaacgggaacgacgggtcgacttaccgtaacttacgtacttacgtacgttcggtttagtaccggggattaaccgaagtccggtttaggttacggggttgggttccgggaacggggtacgaccgtacgtcgggtaaccncgggttaccttagacccggacgacgggacgtccgacccgttccggaaccctccgttacctccggttcccgtccccgtacgtcccg

SEQ ID NO: 126837 - DNA, 673 bp, Homo sapiens
  misc_feature: GYAE6OF01CLB6Q.35.81.H04.1.454.CMB.1.raw
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (277)..(277): a, c, t, g, unknown or other
  misc_feature (277)..(277): n is a, c, g, or t
tcagtacagatcgtcacgaccggtgctcgatttagtagtgtagattcgcgggtgacggtggtgggggaagagcccgggcgctgctgggctccactacttctcaccctcctcgctcactgcacaggttcttgggccagtttcacgctgactcagccccatctgtgtctgagtctaccgggaaatcggttaccatctcctgaccacccgcagcagtgcagcattaccncggntatgtncagtggaccagctacgccgccggctccttccccacaccgtnactccgtagaagacaacgtaaacggccctacgtcgggtcctgtacgtcgttactctcggactccatcgacacgtcctactaacttctcgtccctaccctaacacttcgtacgtacgtacctagaacgtacgtacgggacgggacgacggtctacggtaccttaacttacgtagttaccttacggtttaccgtttagggaacggtaaccgtaacgtagttacggttcgggtacggggttgggttaccgggggaccgggggtaaccgtaacggtccgtaacggtacccgttacgttacgaccgacggaaccggtacgtccgtacccgtccccgtcggtcctaccttccgttacccgttccccgtaccctcgtaccgtactactctcggtacgtacggg

SEQ ID NO: 126838 - DNA, 700 bp, Homo sapiens
  misc_feature: GYAE6OF01DL6UR.35.81.H04.1.454.CMB.1.raw
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
  modified_base (487)..(487): a, c, t, g, unknown or other
  misc_feature (487)..(487): n is a, c, g, or t
  modified_base (515)..(515): a, c, t, g, unknown or other
  misc_feature (515)..(515): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgcccctactctgtcgtcggagtccgtacggggaaagtccggttaccattcctcctcgccaccgcacgtcagtcggcagctacttaccgtcggactagttgtagcgtaggtcggtaaccagaccgacggtcccggcccggggtcctcccccgttaccccaccctacccggtcacgtttccggaaggaaaccgaccgtaaaaccgtaaaacggcccgttggttccgggttcctagtacgttccgttacgcgtcgtctccgatccgtactaccgtcctacctacgttcnccgtcctaccacgtntccttgacgtactagacgtacgnggacgagcgactcgactactagttcgtntatttcgttagacggcctagtattcggtaggttcggggttcgggtaccggggtcggggtaacctacggtgttacccggaaccttccggtaacgtaccggtaaccggacccggaacggtccctcccggtacccccgttcggtccctaaccggttccctttacccggtccccctcccgggttacccc

SEQ ID NO: 126839 - DNA, 663 bp, Homo sapiens
  misc_feature: GYAE6OF01DHTSZ.35.81.H04.1.454.CMB.1.raw
  modified_base (177)..(177): a, c, t, g, unknown or other
  misc_feature (177)..(177): n is a, c, g, or t
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
  modified_base (450)..(450): a, c, t, g, unknown or other
  misc_feature (450)..(450): n is a, c, g, or t
  modified_base (651)..(651): a, c, t, g, unknown or other
  misc_feature (651)..(651): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcgttggcctagtttcacgctgactcacgcccctactctgngtcggacgtcgtaccgggaaagtaccggttaccatcctctcgccaaccgcagcagtggcagcattaccncgtctagtgtcggcaggttcggaccaggcacggccggcccggcttccgtccccnccacgtccacgtccgtagaaacgaaccaacgtaaaacggccctacggttcgggtaccctgtacgtcgttcgtcgtcgccgtactaacgtccgactaccgttacccgtacctacgttactccgtccccttaaaccctacctaacgtttccncgttagacccttaagaaccgtacgtaggaaacgggcgacgtcgaagtacgtacgtacttaggtacgtgtttacgtaggacgtactaacgtgtcgttgggtacgggtcgggttcggggaccggggtatacgggtccttacggccgttacgacggtacgacgtaccgagccgtaccgccccgttacgtcctacgtccttcccncccgtacctccg

SEQ ID NO: 126840 - DNA, 657 bp, Homo sapiens
  misc_feature: GYAE6OF01ERRY1.35.81.H04.1.454.CMB.1.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (492)..(492): a, c, t, g, unknown or other
  misc_feature (492)..(492): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctaccgggaaagcggttaccatcctcctgccacccgnagcagtggcagctattacctccggntatgtgcagtgtaccagcagcgccggctccttccccaccaccgtcactccgtgaacgacaacgtaaacggcccttcgtcggggttcctgtacgttcggttctcgtcggctacactcgactaccgtcctacctaactttcctcgtccctaccctaaacctcttcctcgtacggactagaacgacgtggaacgggacgaggtctacgtactactacgttgtactacgttcgttttaggacggtacaacgtnttcgttggttggggttcgggttccggggacgggggtaccgaacggtccgtacggtacccggttaccgtacgggtccgaaccggacccgtaacggtcccgtacccggtcccccgttaccggtcctacccgttacccgtttcccggttcccccgtccccttaccccg

SEQ ID NO: 126841 - DNA, 706 bp, Homo sapiens
  misc_feature: GYAE6OF01BTEZH.35.81.H04.1.454.CMB.1.raw
  modified_base (226)..(226): a, c, t, g, unknown or other
  misc_feature (226)..(226): n is a, c, g, or t
  modified_base (686)..(686): a, c, t, g, unknown or other
  misc_feature (686)..(686): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgccccatcgtgtgtcggagtcgtccgggaaagtccggttaccattcctacctgaccaccccgnacgctacggtggcctaggcctaacgttcccgtccgggacttagtcggtacgacgacggttacggtaaccgacgaccgtacggcccggtcccggggtaccttcccttaccccccaaccgtaccgtccgtactccggtagaaccgacctaaaccggtaaacgtcccgttcggttacgggtttcctaggtacgtcccgggttacttcgtaccgtccgtcctaagtcccgtagtacccgtcctaccgtaactttccgacgttaccccctaacgttacccattaccgtacgtcgtaacgtacgaagtacgtaggacggtacgagtctacgtacgtacttcgtacgtcgttacgtcgtttacgcggaactacgagtacgttggtacggttgtccggtaccgtacgggtaccacgtcgtaccgtaccgtaccgtagctaccgaccgagtccgccgtccgtacgtacncccgtctccgtacccgtccc

SEQ ID NO: 126842 - DNA, 744 bp, Homo sapiens
  misc_feature: GYAE6OF01BWGEK.35.81.H04.1.454.CMB.1.raw
  modified_base (164)..(164): a, c, t, g, unknown or other
  misc_feature (164)..(164): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacnccccactctgtgtcggagtcgtaccggggaaagtacggttaccactcctcctcgccacccgcgacgcgaggtcgcaacgcctaacttacccgtccggtacttagtgtgctaaggtcggtaacacggcgacggccggcccggtccttcccttacccccacctaccgtcactccgtagaacgaaccaacgtaaaacggccctcggttcgggtctgtcttcggtctcgtcgcctcatccgactacgtcccactaacttcctaccgtccccttaccctaacctacttcctacgtacgtacgtagtaaaccgtcgtacggaacggtaacggacggtacgtactaaccttaacgttacttacgtacgttaccgtttacggttttacggaacgggtaccgtaaccgtaagtccgggttgggttagggggttaccggggtttacgggggaacccggggtaacgtacgggtccttaccggtaacccggtacctaacgggtaccgaccggtaacccgacgggtcccgttaccgtacccccgtcggttaccctaccgttcccgttacccgtccccggtaccccttacccgg

SEQ ID NO: 126843 - DNA, 517 bp, Homo sapiens
  misc_feature: GYAE6OF02I4UAE.35.81.H04.1.454.CMB.1.raw
  modified_base (353)..(353): a, c, t, g, unknown or other
  misc_feature (353)..(353): n is a, c, g, or t
  modified_base (441)..(441): a, c, t, g, unknown or other
  misc_feature (441)..(441): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccactctgtgtcggagtctccggggaaagacggttaccatctcctgcacccgcagcagtggcagcattaccctccggctatgtgcagtggtaccagcagcgcccgggctcttcccccaccaccgtcatccgtgaagacactaaaaggccctctggggttcctgatcggttctctggctccatcgacncgtcctccaattctgcctccctaaccatctctggactgaagactgaggacgaggctgactactactgtcagttctttgagggcaacgntctgtggtgtcgggcggggacagctgaccgtctagcgagccaggctcgcccctcggtcactctcgtcccacctccc

SEQ ID NO: 126844 - DNA, 517 bp, Homo sapiens
  misc_feature: GYAE6OF02F0TY9.35.81.H04.1.454.CMB.1.raw
  modified_base (437)..(437): a, c, t, g, unknown or other
  misc_feature (437)..(437): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgcacccgcagcagtggcagcattacctccggctatgtgcagtggtaccagcagcgcccgggctcttcccccaccaccgtcatccgtgaagacactaaaaggccctctggggttcctgatcggttctctggctccatcgacacgtcctcaattctgcctccctaaccatctctggactgaagactgaggacgaggctgactactactgtcagttctttgaggcaacgntctgtgggtgtcgggcgggggacagctgccgtcagtcagcccaaggctcgcccctcggtcactctcgttcccaccctccc

SEQ ID NO: 126845 - DNA, 518 bp, Homo sapiens
  misc_feature: GYAE6OF02G68TD.35.81.H04.1.454.CMB.1.raw
  modified_base (217)..(217): a, c, t, g, unknown or other
  misc_feature (217)..(217): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgcacccgnagcagtggcagcattacctcggctatgtgcagtggtaccagcagcgccgggctcttcccccaccaccgtcatccgtgaagacactaaaaggccctctggggttcctgatcggttctctggctccatcgacacgtcctccaattctgcctccctaacatctctggactgaagactgaggacgaggctgactactactgtcagtctttgaggcaacgatctgtggtgtcggcggggacagcgtgaccgtctaggtcgagcccaagacctcgccccgtcgtcactcgtcgttcccgccctcccg

SEQ ID NO: 126846 - DNA, 561 bp, Homo sapiens
  misc_feature: GYAE6OF02HA501.35.81.H04.1.454.CMB.1.raw
  modified_base (236)..(236): a, c, t, g, unknown or other
  misc_feature (236)..(236): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccggggaaagacggttaccatctcctgcacccgcagcagtggcagcattaccnccggctatgtgcagtggtaccagcagcgcccgggctccttcccccaccaccgtcactccgtgaacgacactaaaacggccctctggggttcctgatcggttctctggctccatcgacacgtcctccaattctgccctccctaaccatctctcggactgaagactggaggacgaggctgactactactgtctagttcttttgagggtacaacgatcgttggtggggttggttcgggcgggggaccgacgcgtcgaccgtccgtaagtcgacgccgaacggccgtcgtccccgtccggtccaccgttctccggttcccgccctcccg

SEQ ID NO: 126847 - DNA, 525 bp, Homo sapiens
  misc_feature: GYAE6OF02FLIAB.35.81.H04.1.454.CMB.1.raw
  modified_base (375)..(375): a, c, t, g, unknown or other
  misc_feature (375)..(375): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcacccgcagcagtggcagcattacctccggctatgtgcagtggtaccagcagcgcccgggctcttcccccaccaccgtcatccgtgaagacactaaaaggccctctggggttcctgatcggttctctggctccatcgacacgtcctccaattctgcctccctaaccntctctggactgaagactgaggacgaggctgactactactgtcagttctttgaggcaacgatctgtgggtgttcggcgggggaccaaggctgaccgtcgtaggtcgacgcccaggcctcgcccctcggccacctctcgttcccgccctccc

SEQ ID NO: 126848 - DNA, 598 bp, Homo sapiens
  misc_feature: GYAE6OF02IHP6H.35.81.H04.1.454.CMB.1.raw
  modified_base (243)..(243): a, c, t, g, unknown or other
  misc_feature (243)..(243): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgccacccgcagcagtggcagcattacctccggntatgtgcagtggtaccagcagcgcccgggctcttcccccaccaccgtcactccgtgaacgacactaaaacggccctacgtggggttcctgattcggttctctggctccatcgacacgtcctccaattctcgcctccctaacactctctgactgaagctgagagaggctagactactactgtctagttcttttggaggaccaacgtactacgttcggtggggttcggttccggggtcggggggaacctaagggccgttacggtacccggttaccgtaaggtccgaacgcccgaacggtccgtccggacccccgttcggtaccaccgttccgtccgttccccgtccccgttaccccg

SEQ ID NO: 126849 - DNA, 529 bp, Homo sapiens
  misc_feature: GYAE6OF02HCPC9.35.81.H04.1.454.CMB.1.raw
  modified_base (350)..(350): a, c, t, g, unknown or other
  misc_feature (350)..(350): n is a, c, g, or t
  modified_base (439)..(439): a, c, t, g, unknown or other
  misc_feature (439)..(439): n is a, c, g, or t
  modified_base (522)..(522): a, c, t, g, unknown or other
  misc_feature (522)..(522): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccggggaaagacggttaccatctcctgcacccgcagcagtggcagcattacctccggctatgtgcagtggtaccagcagcgcccgggctcttcccccaccaccgtcatccgtgaagacactaaaaggccctctggggttcctgatcggttctctggctccatcgacncgtcctccaattctgccctccctaaccatcctctggactgaagactgaggacgaggctgactactactgtcagttctttgaggcaacgntctgtgggtgttcgggcgggggaccagctgaccgtctagtcgagcccaaggcctcgccccgtcggtccacctctcgttccccnccctccc

SEQ ID NO: 126850 - DNA, 765 bp, Homo sapiens
  misc_feature: GYAE6OF02J1VF0.35.81.H04.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (434)..(434): a, c, t, g, unknown or other
  misc_feature (434)..(434): n is a, c, g, or t
tcagtacagatcgtcacgaccggtgctcgatttagtagtgtagattcgcgggggttaggcgtcgaggaggcagagcctggagcatctccactatggcctgggtctccactacttctcacccgtcctcgctcactgcacaggttctggccagtttcacgctgacctcacgccccatctggtcgtcggaagtctaccgggaaagccggttaccatcctctgccacccgnagcagtcggcagcattccncggctaatcgtagctagtcggtacagacacgccgaccggtcctccgttcccccgacgacccgtcactccgtacgaacaacaacctaaacggtccctacgtccggggttaccncgtacgtccgttacncgtgcctccacgttccgaccgtacgtccctcgtaacttccacgtcccttacccgaaccgtnttcccgtcgtacggaccgttacggaacgtacgtacggaacggaccggaaacggtccgttaagtaccgttaacgtaaccgttacggtaccgtacggttttacgtttaacgggtcggtaacgtaccgttacgttacgtttacgggttacggggtacgggtttcccgggggaaccgggggtaaccggtaaccggttaccgggttaccgtaccccggttacgttaaccggttaccggaaccggtaccccggtaaacgggtcccgttacccggtacccccggttccggttaccctaccggttcccgttcccggttacccccgtcccgttcccccgg

SEQ ID NO: 126851 - DNA, 569 bp, Homo sapiens
  misc_feature: GYAE6OF02I5FP6.35.81.H04.1.454.CMB.1.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (369)..(369): a, c, t, g, unknown or other
  misc_feature (369)..(369): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgcacccgnagcagtggcagcattacctccggctangtgcagtggtaccagcagcgccccggctccttcccccaccaccgtcactccgtgaagacactaaaacggcctcgtcgggttcctgatcggttctctcggctccatcgacacgtcctcaattcncgcctaccctaaccatcctctcgactagaacgactgaggacgaggctagactactactgtctagttcgtttgacggacaacgtagtcgtggtgggttcggttcgggcgggggtaaccaaggtcgtacgaccgtccgtaagtcgacgccacggtccgtaccgccccgtcgtccaccgtccgtcgttcccctacccgtcccg

SEQ ID NO: 126852 - DNA, 655 bp, Homo sapiens
  misc_feature: GYAE6OF02JSU8P.35.81.H04.1.454.CMB.1.raw
  modified_base (227)..(227): a, c, t, g, unknown or other
  misc_feature (227)..(227): n is a, c, g, or t
  modified_base (260)..(260): a, c, t, g, unknown or other
  misc_feature (260)..(260): n is a, c, g, or t
tcagtacagatcgtcacgaccggtgctcgatttagtagtgtagattcgcgggggtaggcgtcaggaggcgagagcctggagcgatctccactatggcctgggctccgactacttctcaccctcctcgctcactcgcacaggttcttgggccagtttcacgctgactcagccccactctgtgtacggagtctccgggaaagaccggttaccagtcctcctgcacccgnaagcagtcgcagcacttacctccggctatcgtncagtaggtaccagcagccgccgggctccttcccccacacccgtcactccgtcgaagaccacgtaaaacgccctacgtggggttcctgagtcggttctcgtggtcctaccatccgactaccgttcctaccgaacttccgttgacccctttaccctaaacctacttccttaccgtcggtaccgtacgtaaacgaccgtttacgacgggaccgtagggccttaacggactacctacgtcgtcgtaacgttcgtttagacggtcgaacgtacgtactgggttacgggtcggttacgggaccgggggtacaaaggtcgtcgaccgttccgtaagtaccgtacgacccgtaggccgtcgtaccccgtcggcctagtcccgtacgtaccctcccggttaccc

SEQ ID NO: 126853 - DNA, 556 bp, Homo sapiens
  misc_feature: GYAE6OF02H1D3J.35.81.H04.1.454.CMB.1.raw
  modified_base (218)..(218): a, c, t, g, unknown or other
  misc_feature (218)..(218): n is a, c, g, or t
  modified_base (330)..(330): a, c, t, g, unknown or other
  misc_feature (330)..(330): n is a, c, g, or t
  modified_base (450)..(450): a, c, t, g, unknown or other
  misc_feature (450)..(450): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgcacccgnagcagtggcagcattacctccggctatgtgcagtggtaccagcagcgcccgggctccttcccccaccaccgtcactccgtgaacgacactaaaaggccctctcggggttccngatcggttctctggctccatcgacacgtcctccaattctcgcctccctaaccactcctctcggactgaacgactggacggacgaggctgactactactgtcagttctttgagggcaacgntacgtgtgggtgttcgggcgggggaccaaggcgtcgaccgttccgagtcgaacgcccgaaggcctccgccccgtcggtccaccttcctcgttccccacccttcccg

SEQ ID NO: 126854 - DNA, 533 bp, Homo sapiens
  misc_feature: GYAE6OF02GHFPB.35.81.H04.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (442)..(442): a, c, t, g, unknown or other
  misc_feature (442)..(442): n is a, c, g, or t
  modified_base (487)..(487): a, c, t, g, unknown or other
  misc_feature (487)..(487): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtgtcggagtctccgggaaanacggttaccatctcctgcacccgnagcagtggcagcattacctccggctatgtgcagtggtaccagcagcgcccgggctcttcccccaccaccgtcatccgtgaagacactaaaaggccctctggggttcctgatcggttctctggctccatcgacacgtcctccaattctgccctccctaaccatcctctggactgaagactgaggacgaggctgacctactactgtcagttcttttgagggcaacgntctgtgggtgttcgggcgggggaccaggcgtgaccgtctaagtcnggacccaggctcgccccgtcggtccactctcgttccccgcctcccg

SEQ ID NO: 126855 - DNA, 532 bp, Homo sapiens
  misc_feature: GYAE6OF02FF6H1.35.81.H04.1.454.CMB.1.raw
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctccgggaaagacggttaccatctcctgcacccgcagcagtggcagcattacctccggctatgtgcagtggtaccagcagccgccccgggctccttccccccaccaccgtccatccgtgaagacaactaaaaggcccttcgtggggttccctgactcgggttctctggctccatcgacacgtcctccaattctgcctccctaaccatctctggactgaagactgaggacgaggctgactactactgtcagtctttgaggcaacgtatctgtgggtgttcgggcgggggaccaagctgaccgtctagcagccaaggctcgccccgtcggtcacctctcgttcccaccctcc

SEQ ID NO: 126856 - DNA, 603 bp, Homo sapiens
  misc_feature: GYAE6OF02GUMNG.35.81.H04.1.454.CMB.1.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (457)..(457): a, c, t, g, unknown or other
  misc_feature (457)..(457): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcaccgnagcagtgcagcattaccncggctatgtgcagtggtaccagcagcgccggctccttcccccaccaccgtcactccgtagaagacaactaaaacggccctacgtcggggttcctgattcggttctcgtggcctccatccgacacgtcctccaattctcgccctaccctaaccatctctgactagaacgtactgaggacgaggctacgactactacgtgtactagttctttggacggtacaacgtntacgttggtgggttcggttccggggacgggggacctaaggtccgtacggtacccgttaccgtaacgtccgacggtacccgaacggtccgtacccggtccccgttcggtcctaccgttccgttacccgttccccgtccccttacccg

SEQ ID NO: 126857 - DNA, 622 bp, Homo sapiens
  misc_feature: GYAE6OF02IYF6P.35.81.H04.1.454.CMB.1.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcaccgnagcagtgcagcattaccncggctatgtncagtgtacngcagcgcccggctctcccccacaccgtcatccgtagacgacaacgtaaacggccctcgtggggttcctggacttcggttctcgtggcctccatcgactaccgtcctaccaattctcgtccctaccctaaccattccgtctcggactacggaagacgtggacggacgaggctagacctactactgtactacgttcgtttacggacggacaacgtagtcgttgggtcgggttcgggttcggggaccggggggtaccaacggtccgtacggtacccggttacgtaacggtccgaacggtacccgaacgggtcctaccggacccccgttcggtacctaccgttccgttcccggttccccgtccccgttacccg

SEQ ID NO: 126858 - DNA, 798 bp, Homo sapiens
  misc_feature: GYAE6OF02F49OS.35.81.H04.1.454.CMB.1.raw
  modified_base (282)..(282): a, c, t, g, unknown or other
  misc_feature (282)..(282): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctccgggaaagacggttaccatctcctgccaccgcagcagtggcagcattacctcggctatgtgcagtggtaccagcagcgcccgggtctccttcccccnccaccgtcactccgtgaacgaccaactaaaacggccctcgtcgggggttcctggtacttcggttcctcgtcggcctccacgtcgacctaccgtccctacctaactttcctcgtcccttacccctaaccctacttccttccgtggtaaccgtacggtaaacgtaccgttacgggaacgggtaacggaacgggtaccgttaccggtaaccttaccgttaaccgttcgttaccgttacggttttccgttttacgggtaacgggtacccgtaaacggtacgttacgtttggggtttacgggggttcggggtttacccggggggtaccggggggggtaacccgtaaacgggtcccggttaccggtaacccgggtttacccgttaaacggttacccggtaaccgggtacccccggtaaacggggtccccggttacccggtacccccccggtttacccgggtaccgttaccccggtttccccggtttaccccggttttccccccgtcccccgtttacccccgg

SEQ ID NO: 126859 - DNA, 552 bp, Homo sapiens
  misc_feature: GYAE6OF02GLZSR.35.81.H04.1.454.CMB.1.raw
  modified_base (214)..(214): a, c, t, g, unknown or other
  misc_feature (214)..(214): n is a, c, g, or t
  modified_base (350)..(350): a, c, t, g, unknown or other
  misc_feature (350)..(350): n is a, c, g, or t
  modified_base (440)..(440): a, c, t, g, unknown or other
  misc_feature (440)..(440): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctcgggaaagcggttaccatctcctgcacccgnagcagtggcagcattaccctccggctatgtgcagtggtaccagcagcgcccgggctccttcccccaccaccgtcatccgtgaagacactaaaaggccctactcggggttcctgatcggttctctggctcatcgacncgtcctcaattctcgcctccctaaccatctcgtgactgaagactgaggacgaggctgactactacttgtctagttctttgaggtcaacgntcgtggtgggttgttcgggacgggggaccaaggcgtacgaccgtcgtaacgtcgaacggaccaggcctccgccccgtcggtccaccgttcctccgttccccgtccctacccg

SEQ ID NO: 126860 - DNA, 679 bp, Homo sapiens
  misc_feature: GYAE6OF02HDSBU.35.81.H04.1.454.CMB.1.raw
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagtacagatcgtcacgaccggtgctcgatttagtagtgtagattcgcgggggtagctcgaggaggctagagcctggagcatctccaactactggccgtgggctaccactacttctcgtacccttcctcgctcactgctacaggtttctgggccagtttctacggcctaggacctcacgtccccgatctggtcgtccggaattcgtaccggggaaanccggttaccagttctcctggcctacccgnacgtccagtggctagctattaccncggtctagtcgtgcagtcggtacngcagcgccggctccttccccacaccgtcactcgtagacgacacgaaacggcctcgtgggttcctgtatcggttctctggctctancgacnccgtcctacacttctcgcctccctaactactctcgtcgactgaactacgtgaggacgagctaggacctacgtactgtcaagttcgtttaggacggactacgacgttcgtgggtagggttccggttacggggacgggggaaccgtacggtccgttaccggtaccccgggtttacgtaacggtccgtaaccccggggtaacccgtaagggtcccgtaacccgggttcccccgttaccgggtacccgttaaccccgttccggtttccccgggttccccgtaacccccggtttccccg

SEQ ID NO: 126861 - DNA, 507 bp, Homo sapiens
  misc_feature: GYAE6OF02GSXB6.35.81.H04.1.454.CMB.1.raw
  modified_base (435)..(435): a, c, t, g, unknown or other
  misc_feature (435)..(435): n is a, c, g, or t
  modified_base (471)..(471): a, c, t, g, unknown or other
  misc_feature (471)..(471): n is a, c, g, or t
  modified_base (480)..(480): a, c, t, g, unknown or other
  misc_feature (480)..(480): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcacccgcagcagtggcagcattaccctccggctatgtgcagtggtaccagcagcgcccgggctcttcccccaccaccgtcatccgtgaagacactaaaaggccctctggggttcctgatcggttctctggctcatcgacacgtcctcaattctgcctccctaaccatcctctcggactagaagactgaggacgaggctgactactactgtcagtcttgaggcaacgntctgtggtgtcgggcggggacagctgacgtctagcncgccaggcncgcccgtcgcnctctcgtcccncctcc

SEQ ID NO: 126862 - DNA, 704 bp, Homo sapiens
  misc_feature: GYAE6OF02J11H6.35.81.H04.1.454.CMB.1.raw
  modified_base (271)..(271): a, c, t, g, unknown or other
  misc_feature (271)..(271): n is a, c, g, or t
  modified_base (397)..(397): a, c, t, g, unknown or other
  misc_feature (397)..(397): n is a, c, g, or t
tcagtacagatcgtcacgaccggtgctcgatttagtagtgtagattcgcgggggtagctaaggaggcagagcctggagcatctccactatggcctgggctccactacttctcaccctcctcgctcactgcacaggttcttgggccaggtttcacgctgactcagccccactctgtgtcggagtctccggggaaatcggttaccattctcctgccacccgcagcagtcggcagcattacccgtccggcttagtgtcgcagtcggtaccaacnggccgcccgggcacgttcccccaatacctcgtgactctaagtaaaggtgaataccgaaacgtacccttcggtacggggttaccctggtacgttccggttcttcggtcgggttacccagtccggacncgtcctccctacctaactcctcgaccccttccctacctactacttccgttccgtacggtactaccaagtcccgtaggaacgggacgagtactggtacttagttaccttcgtacgtacgttactttagtacggtagttagggtacgtacgtaaagtttccggttacggttccgggttaccggttcggggaccgggaacggtacccgtagaccggtttaccgtcccgggttacgtacggttaccgaccgaacccggtaacggttacccgccggttaccccccggtaggttacccgtaccctttccccgg

SEQ ID NO: 126863 - DNA, 641 bp, Homo sapiens
  misc_feature: GYAE6OF02HPRXY.35.81.H04.1.454.CMB.1.raw
  modified_base (219)..(219): a, c, t, g, unknown or other
  misc_feature (219)..(219): n is a, c, g, or t
  modified_base (308)..(308): a, c, t, g, unknown or other
  misc_feature (308)..(308): n is a, c, g, or t
  modified_base (459)..(459): a, c, t, g, unknown or other
  misc_feature (459)..(459): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtcgtacgggaaagtaccggttaccatctcctgcacccgnagccagtggcagctacttacctccggctagtgtgcagtcggtaccagcaggccgccgggtctccttcccccaccaccgtcactccgtanaacgacaacgtaaacggcctcgtcgggttcctgatcggttctcgtgcctcagtccgactaccgtcctaccaattcctcgcccttaccctaaccattcctcgtacggacttacgaacgtacgtaggaacgggacgaggtcttaggtaacttnttagttcgtagtacgtttcttagtaggtacttacgtacctaaacgttccttccgttggtcggtttccggttaccgggggcggggtaacctacgggcgttaccggaccggttaccgtaacgtccgacgacccggtaacggcctcccggtcccgtaccggtccaccggttcctacgttcccccg

SEQ ID NO: 126864 - DNA, 858 bp, Homo sapiens
  misc_feature: GYAE6OF02IXB0W.35.81.H04.1.454.CMB.1.raw
  modified_base (222)..(222): a, c, t, g, unknown or other
  misc_feature (222)..(222): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgccccatctgtgtcggagtcctaccggggaaagccggtttaccatctcctgccacccgnagcagtggcagctacgttacccgtccggacttagtcggtcgactacggttacggtacccgagaccgacggtccccggaccccggggtccttcccccgttacccccccaccgtaccccggttacctacgtcccggtacggaacgaaccctaaacgtaaaaccggtccccttcggttacgggggttccctaggtaccgttccgggttctcgtacgggtcctccgtacgtacccggtacctaccggttccctttaccctaagtttcccgtacgtacccccttaccccctaaaccgttaccttcctacgtcggtacctacggaacggtaccgtacgggacgggtaccggtacggtccttaaggtaccttaaccgtacgttacggttacctaacgttttccgtttaagggaccggtacggaaaccgttacgttcggttacggggtacggggtttccggggttccggggggaaaccgggggttacctaacgggaccgttaccgggttaacccgtaccggttaaccggttaccggaaccggtacccggtacggtaccccggttccccggtaacccccgggtttccgtaccccggttacctttacccgggtacccctttaccccgttaccccccgttaacccgg

SEQ ID NO: 126865 - DNA, 718 bp, Homo sapiens
  misc_feature: GYAE6OF02H33KG.35.81.H04.1.454.CMB.1.raw
  modified_base (299)..(299): a, c, t, g, unknown or other
  misc_feature (299)..(299): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtgtcggagtctccgggaaagaccggttaccatctcctgcacccgcagcagtggcagcattacctcggctatgtgcagtggtaccagcagcgccgggctccttcccccacaccgtcactccgtgaanacaacgtaaaacggccctacgtcgggggttcctgacgtccggttctctcggcttccatccgactccgtcctccgaacttcctcgacccttccctaaaccacttcctcgttcggacttagaagtaccgtgaacgggaacgaggtctacgtaccttaaccgtaacttcgttacacgtttcgtttttacgggaacggggtacctaaacggaacgtttccgttgggttcgggggttcgggtttccgggggaaccggggggtaaacccggtaaaggtcccgttaagggtaccccggttaccggtttaaacggttcccgaaccggttaaccccgaacgggtcccgtttaccccggccccccgtttacggggttacccaccgttttcccggtttaccggttccccccccggttccccttcccccgg

SEQ ID NO: 126866 - DNA, 610 bp, Homo sapiens
  misc_feature: GYAE6OF02HT4CA.35.81.H04.1.454.CMB.1.raw
  modified_base (338)..(338): a, c, t, g, unknown or other
  misc_feature (338)..(338): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtgtcggagtctccgggaaagacggttaccatctcctgcaccgcagcagtggcagcacttacctccggctatggtgcacgtggtaccagcacggccgcccgggctccttccccccaccaccgtcactccgtgaacgacaacgtaaaacggccctcgtcgggttccngtagttcggttctcgtcggctccgtactcgactaccgtccttaccaacttctcgtaccctaccctaaaccactcctctcgactagaagacgtgacggacgaggctacgactactacgtcgtcgtacttcgtttaggacggacacgtacgtcgttggtgggtcggttcgggacggggtacacggcgtacggaccgtcgtaacgtacgacgtacccgaacggccgtccggcccctcgggtacctaccgttcctccggttccccgtccttacccg

SEQ ID NO: 126867 - DNA, 767 bp, Homo sapiens
  misc_feature: GYAE6OF02HITQA.35.81.H04.1.454.CMB.1.raw
tcagtacagatcgtcacgaccggtgctcgatttagtagtgtagattcgcgggggtagctcaggaggcagagcctggagcatctccactatggcctgggctccactacttctcaccctcctcgctcactgcacaggtttcttgggccagtttcacgctgactcagccccactctgtgtcggagtcctaccggggaaagacggttaccatctcctgccacccgcagcagtggcagcacttaccctccggcttagtggtcgcaggtcggtaccagcgacgccggccccgggcctcccttccccccaccacccgtcactccgtagaacgacaacgtaaaacggccctcgtcggggttcctgattcggtctcgtcgctccatccgactaccgttcctactaacttctcgtacccctaccctaacctactctcgtaggtacctagaacgacgttcggaaggaccgaggtactacggaaccttacctacgttcgtactacgtttcgtttacgggacgggtacctaacgtacgttaccggttggggttcgggggtttacgggtttacccggggggacccggggggtaaacccgtaacggggttcccgtaccgggttaaccccgggttacccgttaaaggttaccccgggtaaccggtaccccccggtaaacgggtccccgttaccccggtccccccgggtttacccgggttaccccgttaccccggtttcccccggtttaccccccgggtcccccttttaccccggtaaccccgg

SEQ ID NO: 126868 - DNA, 599 bp, Homo sapiens
  misc_feature: GYAE6OF02F5IM2.35.81.H04.1.454.CMB.1.raw
  modified_base (364)..(364): a, c, t, g, unknown or other
  misc_feature (364)..(364): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgcacccgcagcagtggcagcattacctcggctatgtgcagtggtaccagcagcgccgggctcttcccccaccaccgtcatccgtgaacgacactaaaaggccctcgtcggggttcctgactcggttctctggctccatcgacacgtcctccaattcngcctccctaaccatctctgactgaagactgaggacgaggctcgactacttactgtacagttcttttggaggtcaacgtatacgtggtggggttcggttcggggaccggggggaaccaacggtcgtacggtacccgttccgtaacgtaccggtacgacccgaacgggtccttccggtcccccgttaccgggtcccgtaccgttaccgtccggtttacccccgtccccgttaccccg

SEQ ID NO: 126869 - DNA, 746 bp, Homo sapiens
  misc_feature: GYAE6OF02ILNUM.35.81.H04.1.454.CMB.1.raw
  modified_base (594)..(594): a, c, t, g, unknown or other
  misc_feature (594)..(594): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcacgccccatctgtgtcggagtcgtccgggaaagcggttaccatctccgtgccacccgcagcaggtggcagcctattaccctccggctactggtcgcgaaggtcggtaccagcgacgccggccccggtctcccgttcccccaccaccgtcacgtccgtagaacgactaacctaaacggcccttacggtcggggttcctaggacttccgggttctcgtcggtacctaccgtacgtaccgaccgtacggttcccctaacttaacgtttccgtacccgtcccctttaacccctaaaccgtcttcccgttaccgtacggtaaccgttacggtaaacgtaccgtacgggaacgggtaaccggtacggtcgtaacggtaacctaccgttaacgttcggttactacggttttcgtttacgggacggtacctaaacggttnttacggttcggttacgggggtttcggttacccggggacgggggtaaccaggtacccgttacggtacccgtacgtaacggtcgaacccggtaccgtacggtcccgtccggtaccccgtcgtccgtaccttcccgtcgttacccccgcttcccg

SEQ ID NO: 126870 - DNA, 688 bp, Homo sapiens
  misc_feature: GYAE6OF02F56KH.35.81.H04.1.454.CMB.1.raw
tcagtacagatcgtcacgaccggtgctcgatttagtagtgtagattcgcgggggtagctcaggaggcagagctctgggaatctcaccatggcctggatccctctacttctccccctcctcactctctgcacaggctctgaggcctcctatgagctgacacagccaccctggtgtcagtcgtccccaggacagacggccaggatcacctgcctctggagatgcattcgaccaaagcaatatacttatggtacctagcaagaagtcgaggccacggcccctgtacttgatgagtagtaataaacgacaacgtggacgacggtcccgtacgacggtactccgtggagcctagttccttacgtggtcctaccgagtcctacgaacggggaaccaaaccgtaacgtccgtacggtttacgaacctagtaccgtaggtagggaacgtccgaacgggaccgaaagggaacgggtaaacggaacgggacgttaacggttaaacgtttaacgtttaacgtacggttaactaaccgttaacgacgtaacgaaccggtaaaccaaaccgtaaacctaacgttaccggttacccggttgggtttacgggaccggggtaccggaaccgtacggtcgtaaccggtccgtaccggtacggtacccgacggtaacccgcgggtaccctaccccggttcccccgg

SEQ ID NO: 126871 - DNA, 708 bp, Homo sapiens
  misc_feature: GYAE6OF02FGQBF.35.81.H04.1.454.CMB.1.raw
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctccgggaaagcggttaccatctcctgccacccgcagcagtggcagcattacctcggctatgtcgcagtcggtaccagcacgccgccccgggcttcccttccccccaccgtacccgtcacgttccgtagaacgtaccaactaaaacggcccttacggttcggggttcctaggtacttcggttacctcgtgggccttccatccggaactaccggttccctacctaactttcctacgaccccttacccctaaacctacttcctcgtacggtactacgaaacgtctagggaacgggtacggtacggaccttacggaacctaacttacgttcggtacttacggtttcgttttggacgggtacctaacgtactacgttagggttcgggttcgggttaccgggggaccgggggtaacctaacggtctacggtacccgttacctaacggtccgtaacgcccgaacgggttccctaccggtcccccgttcggtacctacccgttccgttacccttaccccgtaccccttacccg

SEQ ID NO: 126872 - DNA, 605 bp, Homo sapiens
  misc_feature: GYAE6OF02GT14J.35.81.H04.1.454.CMB.1.raw
  modified_base (153)..(153): a, c, t, g, unknown or other
  misc_feature (153)..(153): n is a, c, g, or t
  modified_base (192)..(192): a, c, t, g, unknown or other
  misc_feature (192)..(192): n is a, c, g, or t
tcagtacagatcgtcacgaccggtgctcgatttagtagtgtagattcgcgggggtaactcaggaggcagagcctggagcatctccactatggcctgggctccactacttctcaccctcctcgctcactgcacaggttcttgggccaattttangctgactcagcccactctgtgtcggggtctccggggganaccggttaccctctcctgccacccgcaacagtggcagcatcgccaacaactatgtgctattcggtaccagcagccgcccggcacgtcccccatcattgtctattttgaagatagtacaaggtcctcgtcgggtcctgttcgttctctgctcatcgacacgtcctcattctcgcctcctcacctatcctcgtagtactagaagtctaggaggacggagctgtacttattattgtctacgttacttatgtatactacgactaccttccgttggttcggttccggtttccggggaccgggggtaccgtagggtcccgtacggtacccgttaccgtacgtccggaaccgacccggaacggtccctccggtcccccgttacggtcccacctttccggtcccgttaccccgttcccccg

SEQ ID NO: 126873 - DNA, 646 bp, Homo sapiens
  misc_feature: GYAE6OF02G40O2.35.81.H04.1.454.CMB.1.raw
tcagtacagatcgtcacgaccggtgctcgatttagtagtgtagattcgcggggggggtagctcaggaggcagagcctggagcatctccactatggcctgggctccactacttctcaccctcctcgctcactgcacaggttcgttgggccagtttcacgctgactcacgccccactctgtgtcggagtcgtccggggagacggtgaccatctcctcgccaccgcacgcagtgcagcacttacagacaactatgtgctaggtacggtaaccaacgacggccggcccggggactaccggttaccccaattacctcgtgtactacgtaagtaaaggtgaactaaccgaaacgtaccgtcggttcgggtccgtgtacgttccggttcttcggtcggtacctacgtacgacgacgtccttacctacccgtaactccgtccgtccctccctactactacgtcctcgtacgaccttacgaacgtacgtacgggacgaacggcgtactcggtaacttacgtctgtactacgttacttagtagtaggtacgagtaacgtagttcgtcggtcggttcgttccgggacgggtacgtacgcgtcggtaacggccgttacgtaccggtcaccgtacgaccgtccgtcccgtacccggtcg

SEQ ID NO: 126874 - DNA, 641 bp, Homo sapiens
  misc_feature: GYAE6OF02JUYSL.35.81.H04.1.454.CMB.1.raw
  modified_base (196)..(196): a, c, t, g, unknown or other
  misc_feature (196)..(196): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactcgcacaggttcttgggccagtttcacgtctgactcagcccactctgtgtcggagtctccgggaaancggttaccatcctctgccaccgcagcagtcggcagcacttaccgccggctatgcgtacgaggtgtaccagcgacgccgccgggtctccttcccccaacctaccgttacacgtccgtagaacgtaaccaacggtaaaaccgccctcggtacgggttcctagtacgttcggttctcgtacgctccagtccactccgtcctactaacttcnctccaccctacntctcgtcgactagaacnctacggagagacgtctaggtaaccttacgtacgtcgttacgacgttacttagtacgtacgtaggtaacgtacgtaacgttagttcgggtacgttacggttccgggacgggtaacgacctacggacgtacggaccggttcgaacggtcaaccgtaccggaagtcccgttacccggacccgttcggtacctaccgttacccgttaccccg

SEQ ID NO: 126875 - DNA, 733 bp, Homo sapiens
  misc_feature: GYAE6OF02HSPFW.35.81.H04.1.454.CMB.1.raw
  modified_base (222)..(222): a, c, t, g, unknown or other
  misc_feature (222)..(222): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggtttcttgggccagtttcacgctgactcacgccccactctgtgtcggatccgtaccgggaaagcggttaccatctcctgccacccgnagctaggtggcagcacttacccgccggctagtgtgcagtgtaccagcagcggcccggctcctcccccaccaccgtcacgtccgtagaacgacaacgtaaacgccctcgtggggtccttgacttccgggttctcgtcggtctccgattccgactacgtccctactaacgttctcgtaccctaccctaacctactccgtacgtacggtacgtaacgaacgtacgtaggaacgggacgacgggtctacgaaccttaacgttacgttacggttaccctaggtttccgttttagggaccgggtacctaacggttacgttccggttagggttcggggtttcggggttacccgggggtaccggggggtaaacccgaacgggtccggttaccggtacccggttaccgttaacggtacccggaacggtaaccccgtaacgggtcccgttacccggtcccccccggttcggtacccttacccggtttcccgttccggtttccccccgtacccgttaccccg

SEQ ID NO: 126876 - DNA, 672 bp, Homo sapiens
  misc_feature: GYAE6OF02I7JSW.35.81.H04.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgccccatctgtgtcggagtcgtaccgggaaanaccggtaccatcctcctgccacccgcancagtcggcagcaacttaccgaccggctagtgtgctagtcggtaccagcacgcgacccggctcctcccccgacnccgtcactccgtnacgacacgtaaacggccctcgtcgggttacctagacgttccgttctcgttcggcctaccgagtccgtaccgaccgtacctacgaactttcgtccgtccctaccctaacctacgtccttcgacggtaccgtagtaacgtaccgtacggacggtacgtacgtacgtcgaaccttacgtacgttcgttacgtattccgttagacgggacctaagtcgttacgtacggttggggtaccggtttcggggaccggggtaacacggtcgtaccgtacccgtacggttaactccggaacggtaccgaacggtacccgtcccggtaccccgtaggtccctactcccgttacccgtccccgtacccctacccg

SEQ ID NO: 126877 - DNA, 715 bp, Homo sapiens
  misc_feature: GYAE6OF02HKZR8.35.81.H04.1.454.CMB.1.raw
  modified_base (133)..(133): a, c, t, g, unknown or other
  misc_feature (133)..(133): n is a, c, g, or t
  modified_base (443)..(443): a, c, t, g, unknown or other
  misc_feature (443)..(443): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacnggttcttgggccagtttcacgctgactcagccccactctgtgtcggagtcgtccggggaaagtccggtttaccattcctcctgccacccgcagcagtggcagcattaccctcggactatgtgcagtggtaccagcagcggccccgggtatcccttaccccccacctacccgtctacgtccggttagaacgaccaaccgtaaaacggcccctacggttccggggttcctgtacgttccgggtttcctacgtcggacctccagtccgactccgtacccgttacaacgttcctccgtacccttcccctaaccncgttcctcgtacgacttacggaacgtacgtacggaacgggaccgacggtcgtacgtaaccttacgtcttcggttctacgtttccgttttaggacgggaacctaacggtcgttcgtagggtttcggggttcgggtccgggggtaaccgggggtacctacggtcgtaccggtaccgttacgaacgttccggaacggtaccgtaccgggaccctcccgggtcccccgtacggttcccgtacgtttcccgttacccggttccccctcccgtacccg

SEQ ID NO: 126878 - DNA, 669 bp, Homo sapiens
  misc_feature: GYAE6OF02FTHKN.35.81.H04.1.454.CMB.1.raw
  modified_base (129)..(129): a, c, t, g, unknown or other
  misc_feature (129)..(129): n is a, c, g, or t
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (658)..(658): a, c, t, g, unknown or other
  misc_feature (658)..(658): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactncacagttcttgggccagtttcacgctgactcagccccatctgtcgtcgagttcnccgggaaanacggttacatctcctgccaccgcagcaggtcggcagcactttacccncgggacttactggtcgcagtcggtaccgtagcacgccggccccgggctccgttcccccaccacccgtcacgtccgtacgaacgtaccaactaaaacggccctacgtcggggttcctggacgttcgttctctcggtcctaccgtatccgaccgtaccgttcctcccgtaaattccgtcgtacccttacccctaaccctactcctccttcggactagtaacgacgttacggaacgtacgacggctacgtacctacgtacgtcgtactacttcggtttagtacggtaactacgattacgttcggtcggtacggggttccgggtacggggggactacggacgttacggccgttaccgtaacgtcggaaccgtaccgacggtcccgtacgtacccggtccgtaccgccttcgtacccgttcccncccgttacccg

SEQ ID NO: 126879 - DNA, 825 bp, Homo sapiens
  misc_feature: GYAE6OF02HVXY7.35.81.H04.1.454.CMB.1.raw
  modified_base (291)..(291): a, c, t, g, unknown or other
  misc_feature (291)..(291): n is a, c, g, or t
  modified_base (815)..(815): a, c, t, g, unknown or other
  misc_feature (815)..(815): n is a, c, g, or t
tcagtacagatcgtcacgaccggtgctcgatttagtagtgtagattcgcggggggtagctcaggaggcagagcctggagcatctccactatggcctgggctccactacttctcaccctctcgctcactgcacaggttcttcgggccagtttcacgctgactcacgccccactctgtggtcggtagtccgtaccggggaaagtaccgggttaaccactcctcctcggcccaaccgcagcacggtggcaacgctaacttaccgtccggtctagtgtcgctaggttcggaaccncgcgacgtcccggcccgggtccttacccgttacccccccgaccgtacccgttaccgtaccgtaccggttaacggaaccgtaaaccgtaaacccggtaaaaccggtccccgttaacgggtttccggggtttaacccttacggtaaccggtttccggtttccgtacggtccggtaccgttcccgtagttacccggacctaccggttcccttacccgtaactttccgtccgtaccccttacccgtaacctccgttcctcggtcgtaacgtacggtaaaccgacgtacgggaacggacggtacggtaccgttaacggtaacttacctaacggtttccgttacgttacgtttccggttaggacggtaacccgtagtaaccgttggttacgggttcgggggttccggttaccgggggtaccggggaacctacggcgtaccgggttacccgtcgggtacggttccgaaaccggtacctacggtaaccgtccccgtcccgtacggtcccttacgtaccggtcccttaccccnccggttaccc

SEQ ID NO: 126880 - DNA, 778 bp, Homo sapiens
  misc_feature: GYAE6OF02HPB0E.35.81.H04.1.454.CMB.1.raw
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtctaccgggaaagaccggttacatctcctgccaccgcagcaggtcgcagtcacttaccgtcggctatgtgctagtcggtaccagcgacgccgcccgggtctcccgttacccccaccgacccgtcacgtcccgtagaacgacaaccgtaaacgccccgtggtcgggttccacgtacgtccggttactcgtcggtacctccgacgtccgacctaccgttacctacccgtaactttccgccgtacccttaacccctaacgtaccttaccgttccgtaaccgggtactaagggtaaaccgtaccgttagggaaccgggacgtaacgggccttaacggtaaccgtttaccttaaccgttacggttacttaacggttttacggtttacgggaacgggtaccctaaaggtacttcgggttacggggtttacggggttcgggttaccgggggaccgggggtaacctaaacggtccggttacgggaccgtttacccgaacgggtacccgtaacggtaccccggaagggtacccccgttcccgtaccccggttacgggtaccccttacggttccccggttaacccgttcccccaaccccgttaccgg

SEQ ID NO: 126881 - DNA, 789 bp, Homo sapiens
  misc_feature: GYAE6OF02HAXR9.35.81.H04.1.454.CMB.1.raw
  modified_base (258)..(258): a, c, t, g, unknown or other
  misc_feature (258)..(258): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtcgtcggagtctccgggaaagcggttaccatctcctgccaccgtcagccaggtcggcagccattaccctcggctagtgtcgacgngtacggtaccagcgacggaccggccccgggccttcccgtttcccccccaacccgaccccgtccacgtcccgataaggaaaccgacctaaaaccgttaaaaaccgggccccttacgggttcggggttcccgtacggtacgttccgggtttccgtccgttggtacccttcccgaacgttccggtaactacgtttacccctacctaattccgtacgtccccttcccgtacctaaccgtcttccgttccgttacggaccgtagtaaaccggacgttacggggaagggtaccgtacgggtaccgttacggtaccttttaagtttaacgtttccgtacggttaagtttaccctagttacgtaaggttactaccgtaaccgtcctttcccggttagggttcccgggttcggtaccgggggcccggggtaacgtacgggtccgttaccgggtaacccggttcccgttaaggtacccgtaaccgcccggttaaggtcccgttccccgtaccccggttccggtaccctaccgtttaccccg

SEQ ID NO: 126882 - DNA, 886 bp, Homo sapiens
  misc_feature: GYAE6OF02GMMW5.35.81.H04.1.454.CMB.1.raw
tcagtacagatcgtcacgaccggtgctcgatttagtagtgtagattcgcgggggtagctcaggaggcagagcctggagcatctccactatggcctgggctccactacttctcacctcctcgctcactgcacaggttcttgggcctagtttcacgctgactcacgcccactctgtgtcggagtctaccgggaaagaccggttaccatcctcctgccacccgcagcctaggtggcacgtactacgtttacccgtccgggacttagtcggtgctaggtcggaccagcgacgcccggtcccggtccttccccttcccccgacctaccgtcaacgtccggtaagaacgaaccaaacgtaaacggtccttcggttacggggttcctaggtacttccgggttctcgtcggacctaccgtacgtaccgtaacgtaccggtacccttacgttaactttaccggccgttccccgttaaaccccgtaaaaccttaccttcccgtttacggttacgggaaccgtttaacggaaacgtaccggtacggggtaaacgggacggtaaccgggtaccgttaacgttaaccctaaccgtttaaccgttggttaccccttaagggttttttccggtttacgggggtaaaccggaaccggttaaaaccggttacggtttaccggttacgggggttttacggggggtttccggggttaaccgggggggaaccggggggttaaccctaaacggggttcctaacccgggtacccggtttaacccgttaggtaaccccgggtaaccggtttaaccccggaacgggttccccggtaaccccggttccccggttcccggtaacttccccggttaaccgtttcccccgtaacccccgttccccttaacccgg

SEQ ID NO: 126883 - DNA, 625 bp, Homo sapiens
  misc_feature: GYAE6OF02GA8LU.35.81.H04.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcagccccatctgtgtcggagtctccgggaaagacggttaccatctcctgccacccgnagcagtggcagcattaccnccggctatgtgcagtcgtaccagcagcgcccggctccttcccccacaccgtcactccggtagaacgaccaacgtaaaacggccctacggtcgggtcctgacgttccggttctctggcctcatcgacncgtcctcattcncgcctacctaacntcctgtacgctacganacgtagacggacgacgtctagaacctactacgtcgtcttagttcgtttcggacgggtacaacgtacgtcgttggtacggggttcggtacggggtccggggaacaacggtccgtacgtacccggtacgtaacggtacgaaccggaccctaacgggtcctacccggtaccccgttacgggtaccctaccgttccggtacccgttcccccgtcccttacccg

SEQ ID NO: 126884 - DNA, 783 bp, Homo sapiens
  misc_feature: GYAE6OF02IHVUW.35.81.H04.1.454.CMB.1.raw
  modified_base (236)..(236): a, c, t, g, unknown or other
  misc_feature (236)..(236): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacgtaggttcttgggcctagtttcacgctgactcacgccccatctgtcgtcggagtccgtaccggggaaagaccggtttaccattcctccgtcgccaaccccggnaacgtcaggtcggcgtagctacgtttacccgccggtacttagttcggtcgcgtaggttacggtaaccgaagcgacggccggtccccggggtccttcccgttaccccccaacccgtaccggtacgtaccgttcccgtagtaaacgaacctaaaccgtaaaaacggtcccttccggttcgggggttcccttacggtacgttccggttcttccgtcggtccttacgacgttaccgaccgtaccgtcccttacctaacgtttcctccgtacccttacccctaaaccgtctccgttccgtacgtacgtacggtaacgtacgttggaaacggacggtacgtccgtacggtaactacgttaacgtcgttacgtacgtttacgtttggacgggtaaccaacggttatcggttgggtcggtccgggttaccggggacggggtaacctaacggtcgtacggtacctacggttacgtaccgaacggacccgaacggttccgtaccccggtcccgttcggtaccaccgtttaccggtcccttaccccgcccgttacccg

SEQ ID NO: 126885 - DNA, 723 bp, Homo sapiens
  misc_feature: GYAE6OF02JAMO3.35.81.H04.1.454.CMB.1.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
tcagtacagatcgtcacgaccggtgctcgatttagtagtgtagattcgcgggggtagctcaggaggcagagcctggagcatctccactatggcctggctccactacttctcaccctcctcgctcactgcacaggttcttgggcctagtttcacgctgactcacgccccactctgtgtcggtagtcgtaccgggaaagtacggttaccatcctccgtcgccacccgcagcgngtgcagctacgttacccgccggntagtgtgcgtagtcgtaccngcgacgccgccccggtcctccctcccccaccgtaccgtcaccgtccgaaggaacaacctaacgtaaaccggtccgtcggttcgggtcctgtcgttccgttctcgtcgtctccgtactccgacctaccttcccacttacgttcctaccgtaccctaccctaacctactcctcgacgtacgtaacgtacgtacgtaggacggacgacggtaccgtacgtaaccgtaccgttacgttacgttacgttcggttccggtaacggtacgtaacgtacgttacgttcgggttacgggttacgggtccggggtaccggggtaacggtaccgtacggtaccgtaccgttaccgttacggtaaaaaccgtcgtaacccggaccggtaccgtcccggtacccgtcccgttacccggtaccgttacccgttccccgtccccgtaccccgtccgtaccccgg

SEQ ID NO: 126886 - DNA, 585 bp, Homo sapiens
  misc_feature: GYAE6OF02FO4IX.35.81.H04.1.454.CMB.1.raw
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (466)..(466): a, c, t, g, unknown or other
  misc_feature (466)..(466): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttgggccagtttcacgctgactcagccccatctgtgtcggatctccgggaaagcggttaccatctcctgcacccgcagcagtggcagcacttccnccggctatgtgcaggtggtaccagcgacgccgccccgggctcccttcccccaccaccgtcactccgtagaacgacaacgtaaaacggcctcgtcggggttcctgtattcggttctcgtggctcctancgacncgtcctcatcncgtcctcctaacntctcgtcgactagaacacgtgacggacgcggctagactacttacgtgtctaagttcgttaggacggtacaacgtntcgtggttcgggtggtccggggcggggacaggtcgtacgtccgtacgtacgtcacggccgaacggtcctcccggtcccgtcgtcctaccgttccgtccgttcccccggtccttacccgg

SEQ ID NO: 126887 - DNA, 709 bp, Homo sapiens
  misc_feature: GYAE6OF02I968B.35.81.H04.1.454.CMB.1.raw
  modified_base (315)..(315): a, c, t, g, unknown or other
  misc_feature (315)..(315): n is a, c, g, or t
  modified_base (354)..(354): a, c, t, g, unknown or other
  misc_feature (354)..(354): n is a, c, g, or t
  modified_base (538)..(538): a, c, t, g, unknown or other
  misc_feature (538)..(538): n is a, c, g, or t
tcagtacagatcgtcacgaccggtgctcgatttagtagtgtagattcgcgggggggtagctcaggaggcagagcctgggagcatctccactatggcctgggctccactacttctcaccctcctcgctcactgcacaggttcttgggccagtttcacgctgactcacgccccactctgtgtcggagtcgtaccggggaaagtacggttaccattcctcctgccacccgcaacgagtggcagcatccgaccaaacaactatgtgctagttggtaccagcacgcgccccgggcacgttccccccacacctcactccgngaagacaacgtaaacgccctgtcgggtctgactcggttntcgtggtcctccatcgacaccgttccctaccgtaattcctcgtccccttacccctaaacctactccttacccgtaggtaccttacggaaacgtacgtgggaacggtaacggacggtacttacgtacccttaacgttaccgttcgttaccgtacgtttcgttttacgggagggtacctaaaccgngtttacggttgggtggggtttacggggttccggggtaccggggggtaacgtacggtaccgtacggtaacccggttccgtaacggtacgaccgggtacccaagggtcccttacccggtcccccggtcggttacccaccgtttcccgtccggtttccccctaccccttcccgg

SEQ ID NO: 126888 - DNA, 881 bp, Homo sapiens
  misc_feature: GYAE6OF02G28YM.35.81.H04.1.454.CMB.1.raw
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggcctagtttcacgctgactcacgccccactctgtggtcggagtctacgggaaagtccggttacatcctctgccaccgcagcgagtggcagctaacttacccgtccggtacttagtggtcgacgtaggttacggtaccaggccgacggtcccggcccccgggtacccttacccccgtttacccccccgaaccccgtacccggttaccgtaaccgttacccgggtacggaaaaccgtaacccgtaaaacccggtaaaaaccggtcccccgtttaccggttaccgggggttttaccctacggtaacgtttccggtttccgtacgttcggtcctacccgtactaccgtaaccgtaccgtacccttaacctaacgtttccctccggtaccccttaccctaaaccgtactaccgttcgttacggaacgtacgtaaacggtacgttagggaaccggtacggtaacggtcgtaacggtaaccgttaaccgttacgttacgtaccgttacggttttacgttacgggaacggtaaccgttaacgtcgttaccgggtttagggttcgggggtttacgggttacccggggggtaacgggggtaacccgtaaggtacccgttaacgggtcccgttaaccgggtaacgtacccggaaccgggaaccccgtaagggtaccccgtaccccggtccccggttaacggtccccgtaacctttccccggtacccgttacccccttaccccgtaacccg

SEQ ID NO: 126889 - DNA, 781 bp, Homo sapiens
  misc_feature: GYAE6OF02IQDX8.35.81.H04.1.454.CMB.1.raw
tcagtacagatcgtcacgaccggtgctcgatttagtagtgtagattcgcgggggtagctcaggaggcagagcctggagcatctccactatggcctgggctccactacttctcaccctctcgctcactgcacgtaggttcttgggcctagtttcacgctgactcacgccccactctgtcgtcggagttcgtaccgggaaagtacggttaccattcctccgtgacccaccccgcaagcctaggtcggcacgcctaacgtttccccgtaccggcttaagtcggtcgtcgtacggttcggtaccgaacgccgacggccggaccccggggtccttccccgttacccccccaacctacccgtcacgtcccggtacggaaacgaaccgtaaaccgtaaaaccggccccgttacggttccggggttccctaggtaccgttccggttctccgttacgggcctacgtactaccgaaccttacccgtaccctttaccccgtatttaccgaccgtccctacccctaactacttccgtacgtacggtactacggtaaacgcgtacgggaacggaccggacggtaccgtagtaccctaacgtccgttagtccgtacgtttcgttacggacggtaccgtacgtagttcgttcgggttacgggttcgggtaccgggtaccgggggtacacggttaccgtcgtacccgtacgtacggaccgtaccgtacccggtaacggtcccgtacccgtacccgtcccgtacgtcccgttaccgtcccggttcccgtcccctaccg

SEQ ID NO: 126890 - DNA, 751 bp, Homo sapiens
  misc_feature: GYAE6OF02HNRIM.35.81.H04.1.454.CMB.1.raw
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
tcagtacagatcgtcacgaccggtgctcgatttagtagtgtagattcgcgggggtagctcaggaggcagagcctggagcatctccactatggcctgggctccactactctcaccctcctcgctcactgcacaggttcttgggccagtttcacgctgactcacgccccactctgtcgtcggacgtctccggggaaaagaccggttaccattccgtcctcggaccacccggctagctaggtcggcaagctaacttaccgtccggntaagtgtgcgtaggtcggtaccagccgacgccggccccggtctccgtccccccacgcccgtcacnccgtagaacgacctaacgtaaacggcccttcggtacggggttcctagtacgttccggttctcgtcgtcctcgtacgtcgaaccgtccgtcctacgtaacttctccgtccctacctactactccttcgtaggtacgtagaacggtaccgtaggaacggacgtacggacgttacgaacttaccgtactacgtacttaacggtttctttaaggacggtactaacgagttccggttaggggccgggtttcggggtaaccggggcccggggtaaacgtaccggtaccgtttacgggtaacccgttacgtaacccggtttcggaaaccccgggtacccgtaacgggttcccccgcccggtttaccccccggtacggtaccctttacccggttcccttaccccggttaccccgtaaccccctttacccgg

SEQ ID NO: 126891 - DNA, 778 bp, Homo sapiens
  misc_feature: GYAE6OF02JNZT7.35.81.H04.1.454.CMB.1.raw
  modified_base (219)..(219): a, c, t, g, unknown or other
  misc_feature (219)..(219): n is a, c, g, or t
tcagtacagatcgtcacgaccggtgctcgatttagtagtgtagattcgcggggggtagctcgaggaggcagagcctggagcatctccactatggcctgggctccactacttctcaccctcctcgctcactgcacgaggttcttgggcctagtttcacgctcgactcacgcccacgtctgtgtcgagtcgtaccgggaagtccggtacctagtccttccngcccgaccgctagccagtcggcgagtctacttaccgcccggtattagtgtcgacgtacgtacggtacctagacgacgtccggacccggtcttcccgtacccccgaccgtacccgtcctacgttccgacgtaacggaaccaacggtaaaccggtcccgttaccggttacggttccgtagtaccgttcgttactacgtcggtacctccgtactccgggacttaccgtacctacgtaacgttcctacgtccccgttaccgtaccctaagttcccgtaacgttacgggacccttacgtaacgtccggttaaggacccgggtaacgagggtaccttaccggaacctttacgtaccgtttacgttccgttaaacggtttccgtttaacgggacggtaccaacggttcgttaacggttgggttccgggttcgggtaccgggacggggtaaccgacgttacgccgtttaaccggtcgttaaccggcgtaaccgtaccgtaaggtccgtaaccccggtcccaaggttcccgtaacgttcccgtaccggtttcccgtacccttacccgg

SEQ ID NO: 126892 - DNA, 675 bp, Homo sapiens
  misc_feature: GYAE6OF02F24TG.35.81.H04.1.454.CMB.1.raw
  modified_base (544)..(544): a, c, t, g, unknown or other
  misc_feature (544)..(544): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggttcttgggccagtttcacgctgactcagccccatctgtgtcggagtcgtaccggggaaagtaccggttaccatctcctgccacccgcagcagtcggcagctacttaccgtccggctagtgtgcagtggtaccagcacgcgccccgggtctccttccccccgaccgtaccgtccacgtcccgtggaaacgaccaacgtaaaaccgggtccccttacggttccgggggtttcctaggtacttaccggtttctccgtcgggcctaccgtacgtcgaccgtaccgtccctactaacttcgtacgtcccctaccctaaccgtactcctcgtcggactaggaactacgtaggacggacggacggctacgtacctacctacgtcgttcgtacgttcgtttggacggcctaacgtntcgttgggtgggttcgggtcggggaccggggtacacggcgttacgtaccggtacgtaggtccgacgacccggacggtccgtacccgtccccgtcggtccgacccttaccgttcccgtaccctcccgtcccg

SEQ ID NO: 126893 - DNA, 896 bp, Homo sapiens
  misc_feature: GYAE6OF02HLGCF.35.81.H04.1.454.CMB.1.raw
  modified_base (233)..(233): a, c, t, g, unknown or other
  misc_feature (233)..(233): n is a, c, g, or t
  modified_base (267)..(267): a, c, t, g, unknown or other
  misc_feature (267)..(267): n is a, c, g, or t
tcagtacagatcgtcacgaccggtgctcgatttagtagtgtagattcgcgggggggtagctcaggaggcagagcctggagcatctccactatggcctgggctccactacttctcaccctcctcgctcactgcacaggttcttggggcctagtttcacgctgactcacgccccactctgtcgtcgggtagtccgtaccggggaaagtaccggttaccatcctcctcgcacccgnagcagtggcagctacttacccgcggtactatcgngtccgaggtacggtaccaggcgacggcccggtccccgggtccttacccttaccccccgacctacccggtacaccgtaccgtacgaaacgtaaccgtaaaccggtaaaaccggtccccggttacggttaccggggttccgttaacgggtaccgttaccgggtttaccgttaccggttcgggtcccttaccgtacgtaccggtaacccgtaccggttccctaacccgttaacgtttccgttaccggttccccttaaccccgttaaacctaaccttttaccgttaccggttacgggttaactacggtaaaccggtacggttaaccgggaaccgggtacggaaccgggttccttaaaccgggttaacctttaaaccggttaccggtttaacggttacccgtttaagggtttttaccgttacggggtaaccggggtacctaaccggttaggttaccgtttggggtttacggggttacgggtttcccggggggaccgggtaacgtaccggtcgttaccggtacccgttacgtaccgggtaccaacgggtaaccctcgggtacccttacccgggtcccccttacgggttccctaccgtttaccccggtttacccgtccccgttaaccccggtaccc

SEQ ID NO: 126894 - DNA, 670 bp, Homo sapiens
  misc_feature: GYAE6OF02GXNW7.35.81.H04.1.454.CMB.1.raw
  modified_base (226)..(226): a, c, t, g, unknown or other
  misc_feature (226)..(226): n is a, c, g, or t
  modified_base (447)..(447): a, c, t, g, unknown or other
  misc_feature (447)..(447): n is a, c, g, or t
  modified_base (528)..(528): a, c, t, g, unknown or other
  misc_feature (528)..(528): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcagccccactctgtgtcggagtcgtaccgggaaagtaccggttaccatcctccgtagccaccccgnacgtcaggtggcagctacttacccgtccggtactagtgtcgtactaggtcggtaaccagcgaacggccggccccgggtcctcccttaccccccgaccgtacccgtctaacgtccggtagaacgacctaaacgtaaaccggccttcggtggggttccacgtacgttccggtttctcgtcggcctaccgactaccgaacctaccgtacctactaacgtttccncctccctaccctaactctctacgtgaactagactcgtaggacgtacggatcacgtacctacgtactcggtattacggtttnttaggacgtactacgacgttcggttgggtgggttcggtaccggggaccggggaactaggtcgacccgtccgtacgtaacgtccgaaccggtccgacggtccgtcccgcccgttgtcgccttccgtcccgtcccgcctacccg

SEQ ID NO: 126895 - DNA, 709 bp, Homo sapiens
  misc_feature: GYAE6OF02G5A0V.35.81.H04.1.454.CMB.1.raw
  modified_base (112)..(112): a, c, t, g, unknown or other
  misc_feature (112)..(112): n is a, c, g, or t
  modified_base (123)..(123): a, c, t, g, unknown or other
  misc_feature (123)..(123): n is a, c, g, or t
  modified_base (575)..(575): a, c, t, g, unknown or other
  misc_feature (575)..(575): n is a, c, g, or t
tcagtacagatcgtcacgaccggtgctcgatttagtagtgtagattcgcggggggtagctcaggaggcagagcctggagcatctccactatggcctgggctccactacttcncaccctcctcnctcactgcacagggttcttgggcctagtttccacgctgactcacgccccatctgtggtcggacgtcgtaccggggaaaggtaccggttacctactcctcctcgccacccgcacgcaggtggcagctacgttacccgccggtactatcgtgcgtaggtcgtaccgagcgacgccggtcccgggtcctccttcccccaccgaccgtcacgtccggtagaaacggaccgtaacgtaaaccggccctcgggttcggtcgtcgtacgttcgtactcggtcgtacgtaccgtacgtaccgtacctaccgttccctacgtaaccgttctacccgtcccttaaccccgtaaccgtccttaccttcggtaccggaacctaggaaccgtacggtcggaacggacggtacgtcgtactacctacgtacttcggtacttgttacgttacggacggtctaacgtntacgggttggtgggttcgggtacgggggaccgggtaagtccgtacgaccgtaccgtacgttacgacgtccggacgtccggtacgtcccgtacccgtcggtaccttccgtaccgtcccgtaccctcccggtaccg

SEQ ID NO: 126896 - DNA, 737 bp, Homo sapiens
  misc_feature: GYAE6OF02G0ADW.35.81.H04.1.454.CMB.1.raw
  modified_base (277)..(277): a, c, t, g, unknown or other
  misc_feature (277)..(277): n is a, c, g, or t
  modified_base (646)..(646): a, c, t, g, unknown or other
  misc_feature (646)..(646): n is a, c, g, or t
tcagtacagatcgtcacgaccggtgctcgatttagtagtgtagattcgcggggggtagctcaggaggcagagcctggagcatctccactatggcctgggctccactacttctcaccctcctcgctcactgcacaggtttcttgggcctagtttacacgctgacgtcacgccccattcctgtacggtcggtagtccgaccggggaaagtacggttaccattcctccgtcggccgacccggcaagcctaaggtcggcaagctacttaccgtccggactntggtcgcgtaggttcgtaaccgtagtacgaacgtccgggcccgggtccctcccgttacccccacccgaccgtcgacgtccggtacgaaaccgtaccgaaaaccgttaaaccgggtccccttcggttccggggtccttacgacggtttccggttacgttccgtaggtccctaccgtacgtaccgaacgttccgtaccttacacgttttcaccgttaccctacctaaccgtacgtcctttacgacgtaacgacggaaacgttcgtaggacgggtaacgacggtcgtacgtacctacgtacgttgtactacggtttcttacgggacggtactaacgtgttcgtaggtcgggttacggtcgggaccgggtaanacggtacgtaccgtccgtactaaggccgtacggaaccgtcggcccgtccgacccgtcgtaccgttacctccggttacctcccgcccttacg

SEQ ID NO: 126897 - DNA, 711 bp, Homo sapiens
  misc_feature: GYAE6OF02GG30B.35.81.H04.1.454.CMB.1.raw
  modified_base (241)..(241): a, c, t, g, unknown or other
  misc_feature (241)..(241): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgccccactcgtgtgtcggagtctaccgggaaagacggttaccatcctcctgccacccgcagcagtggcagcattaccncggtctagtgtgcagtcggtaccagcagcgccccgggctcctcccccaccaccggtcactccgtgaacgacaacgtaaacggccctacgtcgggttcctagacgttcggttctctcggctccntcgactcgtcctacatctcncctccctaacnctctctcggtactgaacgtactaggacggacggaaggtccgagtaacctacgtaccgttgtacgtacgtttcgttttaggaacgggtcctaaacggtcttacgggttaggttaggggttccgggttacgggggtacccgggggtaacctaaacgggtccggttaccgacccgggtttaccgtaacgggtttaccgaaccggttaacccggaaaccgggttcccccgttaacccgggtcccccccggtttaccgggttacccttaacccggttccccggtttcccgggttttccccccgtaccccgtttccccccgg

SEQ ID NO: 126898 - DNA, 708 bp, Homo sapiens
  misc_feature: GYAE6OF02JC2XB.35.81.H04.1.454.CMB.1.raw
  modified_base (221)..(221): a, c, t, g, unknown or other
  misc_feature (221)..(221): n is a, c, g, or t
  modified_base (509)..(509): a, c, t, g, unknown or other
  misc_feature (509)..(509): n is a, c, g, or t
tcagtacagatcgtcacgaccggtgctcgatttagtagtgtagattcgcgggggtagctcaggaggcagagcctggagcatctccactatggcctgggctccactacttctcaccctcctcgctcactgcacaggttcttgggccagtttcacgctgactcacgccccatctgtgtcggagtcgtaccggggaaagtacggttaccatctcctgccaccgnagcaggtggctagctacttaccctccggcttatcggtcgtcaggtcggtaccgacgcgacggccggccccgggccttacccttccccccaccctacccgtacctacttacccagtcgaaacgacctaaccgtaaaaaccggccccttcggttaccgggtttcctcgtacgttccggttctcgtcggtcctcacgtctacgtacgttccctactacttcgtcgtccctccctaccacctctaccgtctacggcttagaactacgtcggagacgaggtctggtaaccttntttaacttcgtactcgttacttagtatcgtacgtcaacctaccgttccggtcgtttacggggtccggttccgggggtaccgggggtaccgtacgggacggtacccggtaacccggttaccgtacggttacccgacggtaccccgtacggttcccggtaccccggttcccccggtcggtacccgttccctttaccccggg

SEQ ID NO: 126899 - DNA, 408 bp, Homo sapiens
  misc_feature: GYAE6OF01BBMOV.48.59.F04.1.454.CMB.1.raw
  modified_base (403)..(408): a, c, t, g, unknown or other
  misc_feature (403)..(408): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatactctgagcggctggcaaggcgcatagnnnnnn

SEQ ID NO: 126900 - DNA, 408 bp, Homo sapiens
  misc_feature: GYAE6OF01B436F.48.59.F04.1.454.CMB.1.raw
  modified_base (404)..(408): a, c, t, g, unknown or other
  misc_feature (404)..(408): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctggggcacagcggccctgggctgcctggtcaaggactacttcctatgtatactctgagcgggctggcaaggcgcatagnnnnn

SEQ ID NO: 126901 - DNA, 502 bp, Homo sapiens
  misc_feature: GYAE6OF01APL03.48.59.F04.1.454.CMB.1.raw
  modified_base (474)..(474): a, c, t, g, unknown or other
  misc_feature (474)..(474): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccaggaaggggctggagtggattgggagtatttaccacagtgggagcacctactacaacccgtcctcaaaagtcgaggcaccatatccgtagacacgtccaagaaccaatctcctgaagctgagctctgtgaccgccgcagacacggctgtctattactgtgcgacggcccgagcgcagtgcttttgatgcctttgatntgtgggcaagggacaagtggtcaccgtc

SEQ ID NO: 126902 - DNA, 518 bp, Homo sapiens
  misc_feature: GYAE6OF01BT4PD.48.59.F04.1.454.CMB.1.raw
  modified_base (182)..(182): a, c, t, g, unknown or other
  misc_feature (182)..(182): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctccaggctcctcatctacggtgcatccagcagggccactggcatcccagacaggttcagtgcagtgggtctgggacagacttcactctcaccgtcagcagactcggaccctgaacgtatttgcagtgtattactgtcagcagtatggtagctcaccgatcaccgttcggaccgaagggacaacgactaggacgtaacgttaaccgaactgtgctgcaccatctcgtctcactccttcccgctactctanatntgtaac

SEQ ID NO: 126903 - DNA, 504 bp, Homo sapiens
  misc_feature: GYAE6OF01DRHVM.48.59.F04.1.454.CMB.1.raw
  modified_base (477)..(477): a, c, t, g, unknown or other
  misc_feature (477)..(477): n is a, c, g, or t
  modified_base (499)..(499): a, c, t, g, unknown or other
  misc_feature (499)..(499): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcagactggaccctgaagattttgctagtgtattactgtcagctagtatggtagctcaccgatcaccttcgcaagggacacgactgagattaaccgactgtgctgcaccatctgtcttcnctccttcccgcctactctgatntgtac

SEQ ID NO: 126904 - DNA, 532 bp, Homo sapiens
  misc_feature: GYAE6OF01CAPSS.48.59.F04.1.454.CMB.1.raw
  modified_base (448)..(448): a, c, t, g, unknown or other
  misc_feature (448)..(448): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccacggcccccagggaacgggctggagtggattggagtatttaccacagtggagcactactacaacccgtcctacaaaagtcgaggcacatatccgtagacacgtaccaaagaaccaattcctaccctagaacgctgagcttctgtcgacccgccgcacgaccacggctgtctaatttacngtcgcgacggccccgagccgcaggttggtcttttgatcgtccttgatagtggtagggaccaagggacaagtgtccgtccggttc

SEQ ID NO: 126905 - DNA, 515 bp, Homo sapiens
  misc_feature: GYAE6OF01CX9Z6.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgtattttgctagtgtattactgtcagcagtatggtagctcaccgatcaccttcggccaagggacacgactggagtattaaccgaactgtggctgcaccatctgtcttcactccttcccgctacttctgtactatgtaac

SEQ ID NO: 126906 - DNA, 519 bp, Homo sapiens
  misc_feature: GYAE6OF01C3INN.48.59.F04.1.454.CMB.1.raw
  modified_base (313)..(313): a, c, t, g, unknown or other
  misc_feature (313)..(313): n is a, c, g, or t
tcagagtatacatacacgaccggtgctcgatttagtacacacacttagggattgggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactcgtgggctggactccgcacgccccgaggggagggctggagtggagtgggagtatttaccanagtggagcacctactacaacccgtccctacaaaagtcgacggacaaccatatccgtagacacgtaccaaagaaccaattctccctagaacgctgacgctctgtcgaccgccgcagacacggctgtctattactgtgcgacggcccgagcgcagtcggtctttgatgtccttgatgtgtcggggacaagggacaagtcgtcaccgtc

SEQ ID NO: 126907 - DNA, 413 bp, Homo sapiens
  misc_feature: GYAE6OF01B1GEC.48.59.F04.1.454.CMB.1.raw
  modified_base (403)..(413): a, c, t, g, unknown or other
  misc_feature (403)..(413): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggcaatggtcaccgtctcttcggcctccaccaagggcccatcggtcttccccctggcaccctcctccaagagcacctctggggcacagcggccctgggctgcctggtcaaggactacgttcctatgtatactctgagcggctggcaaggcgcatagnnnnnnnnnnn

SEQ ID NO: 126908 - DNA, 533 bp, Homo sapiens
  misc_feature: GYAE6OF01C3QFE.48.59.F04.1.454.CMB.1.raw
  modified_base (417)..(417): a, c, t, g, unknown or other
  misc_feature (417)..(417): n is a, c, g, or t
  modified_base (465)..(465): a, c, t, g, unknown or other
  misc_feature (465)..(465): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagtacttacttcgtgggctggactccgccacgcccccgagggaggggcctggacgtggagttgggagtatttaccacgagtgggagcaccgtactacaacccgtcctacaaaagtcgacggcacatactccgagacacgtcaaacgaaccacttctccctagaagctagagtctntgtcgaccgcgcagcacgctgtctatctgtcgcgtacgcccgagcgcngtcgtcttttgattcgtcctttgattgtcggtagggccgtaaacgggacaagtcggtccgtccgttcg

SEQ ID NO: 126909 - DNA, 508 bp, Homo sapiens
  misc_feature: GYAE6OF01BWSVS.48.59.F04.1.454.CMB.1.raw
  modified_base (502)..(502): a, c, t, g, unknown or other
  misc_feature (502)..(502): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcagactggaccctgaagatttgcagtgtattactgtcagcagtatggtagctcaccgatcaccttcggccaagggacacgactggagattaaccgactgtggctgcaccatcgtgtcttcattccttcccgcctactctgactntgtaac

SEQ ID NO: 126910 - DNA, 533 bp, Homo sapiens
  misc_feature: GYAE6OF01D0MAE.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtgggctggatccgccacgcccccgaggggaacgggctggagtggagttgggagtatttaccacagtggagcacctactacacccgtcctacaaaagtcgagcacatactcgtagacacgtaccaaacgaaccaattcctaccctagaacgtctagagctctgtcgaccgccgcacgacacggctcgtactattacgtgtcgcgacggcccgagcgcagtcgtcttttgattcgtcctttgattgtggtcgggaccgaagggactagtcggtcgccgttc

SEQ ID NO: 126911 - DNA, 408 bp, Homo sapiens
  misc_feature: GYAE6OF01CZRNJ.48.59.F04.1.454.CMB.1.raw
  modified_base (388)..(388): a, c, t, g, unknown or other
  misc_feature (388)..(388): n is a, c, g, or t
  modified_base (402)..(408): a, c, t, g, unknown or other
  misc_feature (402)..(408): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaaggcccatcggtcttccccctggcaccctcctccaagagcacctcgtggggcacgagcggccctgggctgcctggtcaaggactacttcctatgtatactctgagcggntggcaggcgcatgnnnnnnn

SEQ ID NO: 126912 - DNA, 410 bp, Homo sapiens
  misc_feature: GYAE6OF01D3GPM.48.59.F04.1.454.CMB.1.raw
  modified_base (405)..(410): a, c, t, g, unknown or other
  misc_feature (405)..(410): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatactctgagcgggctggcaaggcgcatagnnnnnn

SEQ ID NO: 126913 - DNA, 403 bp, Homo sapiens
  misc_feature: GYAE6OF01DUWN7.48.59.F04.1.454.CMB.1.raw
  modified_base (399)..(403): a, c, t, g, unknown or other
  misc_feature (399)..(403): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggcaatggtcaccgtctcttcagcctcaccaagggcccatcggtcttcccctggcaccctcctccaagagcacctctggggcacagcggccctgggctgctggtcaaggactacttcctatgtatactctgagcggctggcaaggcgcatagnnnnn

SEQ ID NO: 126914 - DNA, 410 bp, Homo sapiens
  misc_feature: GYAE6OF01BEGY5.48.59.F04.1.454.CMB.1.raw
  modified_base (405)..(410): a, c, t, g, unknown or other
  misc_feature (405)..(410): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatccggtcttccccctggcaccctcctccaagagcacctctgggggcacagcggccctgggctgcctggtcaaggactacttcctatgtatactctgagcggctggcaaggcgcatagnnnnnn

SEQ ID NO: 126915 - DNA, 530 bp, Homo sapiens
  misc_feature: GYAE6OF01D3GNG.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccagcccccagggaggggctggagtggattgggagtatttaccacagtgggagcacctactacaacccgtcctcaaaacgtcgaggcaccatatccgtagacacgtaccaagaaccaattcctccctgaagctgagctctgtcgacccgccgcacgacacggctgtctattactgtgcgtacggccccgagcgcgagtggtcgtttttgattcgtcctttgattgtggtggggacctaagggacaagttcggtccgccgttccg

SEQ ID NO: 126916 - DNA, 520 bp, Homo sapiens
  misc_feature: GYAE6OF01EFK90.48.59.F04.1.454.CMB.1.raw
  modified_base (485)..(485): a, c, t, g, unknown or other
  misc_feature (485)..(485): n is a, c, g, or t
  modified_base (513)..(513): a, c, t, g, unknown or other
  misc_feature (513)..(513): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtgggattggggagtatttaccacagtgggagcacctactacaacccgtccctcaaaagtcgaggcaccatatccgtagacacgtccaaagaaccaattctccctgaagctgagctctgtcgaccgccgcagacacggctgtctattactgtgcgaggccccgagcgcagtggcttttgatgtcctttgattntgtggggacctaagggacaagtcggtcnccgttcg

SEQ ID NO: 126917 - DNA, 574 bp, Homo sapiens
  misc_feature: GYAE6OF01DFARR.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacggcccccgaggggagggcgtggagtggagttgggagttagtttaccacgaggtgggagccacctactaaccaccgtcctacgaaaagtcgaggcaacatactaccgtagaccacgtaccaaagaacctaattcctacccgtagaacgctgacgtctcgtcgtcgacccgcgcacgacacggtctgtacttattactggtcgcggaccggccccgagccgacgtagtcggtcttttgagttcgtccttttgacgttgttgggacgggaccgtaagggactaagtcgggtcctacccggttcg

SEQ ID NO: 126918 - DNA, 408 bp, Homo sapiens
  misc_feature: GYAE6OF01ENUY7.48.59.F04.1.454.CMB.1.raw
  modified_base (293)..(293): a, c, t, g, unknown or other
  misc_feature (293)..(293): n is a, c, g, or t
  modified_base (406)..(408): a, c, t, g, unknown or other
  misc_feature (406)..(408): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtnttcccccctggcaccctcctccaagagcacctctgggggcacagcggccctgggctgcctggtcaaggactacttcctatgtatactctgagcgggctggcaaggcgcatagnnn

SEQ ID NO: 126919 - DNA, 635 bp, Homo sapiens
  misc_feature: GYAE6OF01D26HI.48.59.F04.1.454.CMB.1.raw
  modified_base (326)..(326): a, c, t, g, unknown or other
  misc_feature (326)..(326): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggactccgccacgccccgaggggacgggctggagtggagttgggatatttaccacgaggtgggacncacctactacaacccgtcctacaaacgtcgagcacatactcgtagacacgtaccaaagaacctaacttcctaccctagaacgctagacgcctcgtcgtaccgaccgccgacacgacgaccggtctacgtcttaagttacgtggtcggaccggaccggccccgaggccgacgtaacggttcggttcgttttttacggacgtttcggtcccgtttttaggaacgtttacggttacggggttacgggggtaacccgtaaaagggggtaaccttaaacgggtttccgggttacccgtaacccgggtttacccg

SEQ ID NO: 126920 - DNA, 754 bp, Homo sapiens
  misc_feature: GYAE6OF01C5VWW.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccaactgcagctgcaggagtcgggcccaggactggtgaagccgttcggacgaccctgtccctcacctgcactgtcctcgtggtcggctccatcagcagctacgtacttacgtcgtgggctggactccgccgaccgccccggaggggacgggcgtgggagtggtagttgggagttacgttacgacgtagggtaggacgacctaacctaactaacccgaacccgtacctaaacgtaaaacgtcgaacggaccaaccgtaatacgtaccgtaacgaacctaccggtaaccaaacgtaaacctaactttaccctaccctaggaaacgtcgttaggaacgtccgtcgtcggtaccgacccggaccgaccgaacggaccgtaaccggtcgttacgttaccttaacgtttaaccgtcggtaccgggaccgggtaacccgggtcccccggtaacggcccggtaccgtacgggtttacgggtttctttttacggaacgtttccggttacccgttttaggtaacggtttacgggttcggggtacccgggggtaaccggtaaacggggtaaccttaaacgggttccgggttacccgttacccggttcgtttacccgg

SEQ ID NO: 126921 - DNA, 509 bp, Homo sapiens
  misc_feature: GYAE6OF01E3V16.48.59.F04.1.454.CMB.1.raw
  modified_base (503)..(503): a, c, t, g, unknown or other
  misc_feature (503)..(503): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggagggctggagtggatgggagtatttaccacagtgggagcacctactacaaccgtcctacaaaagtcgaggcaccatactccgtagacacgtccaagaaccaattctccctgaagctgagctctgtcgaccgcgcagacacggctgtctattactgtgcgacggcccgagcgcagtggtcttttgattgtctttgatgtgtgggccgaagggacaagtcggtcncgttcg

SEQ ID NO: 126922 - DNA, 407 bp, Homo sapiens
  misc_feature: GYAE6OF01AVBRW.48.59.F04.1.454.CMB.1.raw
  modified_base (404)..(407): a, c, t, g, unknown or other
  misc_feature (404)..(407): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatactctgagcggctggcaaggcgcatagnnnn

SEQ ID NO: 126923 - DNA, 541 bp, Homo sapiens
  misc_feature: GYAE6OF01B70VK.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggagttgggagtatttaccgacagtgggagcacctactacaacccgtcctacaaaagtcgaggcaccatatccgtagacacgtaccaaagaaccaattctccctagaagctgagctctgtcgacccgccgacacgacgacggctgtctattacgtgtcgcgtacggccccgagcgcagtggtcttttgattcgtcctttgattgtggtggggaccgtaaagggactaagtcggtacctcccggttacc

SEQ ID NO: 126924 - DNA, 464 bp, Homo sapiens
  misc_feature: GYAE6OF01BDZ9H.48.59.F04.1.454.CMB.1.raw
  modified_base (453)..(464): a, c, t, g, unknown or other
  misc_feature (453)..(464): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccagggcccatccggtcttccccctggccaccctcctccaagacgccacctcgtcgggggccacgacggccggccccgtgggcctcggcccgtggtacgaaacgggtaccttaccttccctagttcgtacttacgtcgtggacggcggggtcgtcgggacgaacgggcgcgagtagnnnnnnnnnnnn

SEQ ID NO: 126925 - DNA, 515 bp, Homo sapiens
  misc_feature: GYAE6OF01DO3F4.48.59.F04.1.454.CMB.1.raw
  modified_base (442)..(442): a, c, t, g, unknown or other
  misc_feature (442)..(442): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactctggggctggatccgccagcccccagggaaggggctggagtggagttgggagtatttaccacagtgggagcacctactacaacccgtcctacaaaagtcgaggcacatatccgtagacacgtaccaagaaccaattctaccctgaaacgctagagctctgtcgaccgccgcagacacggctgtctattacngtcgcgacgccccgagcgcagtgtctttgatgtccttgatgtgtgggacctaagggacaagtcggtcaccgtc

SEQ ID NO: 126926 - DNA, 568 bp, Homo sapiens
  misc_feature: GYAE6OF01BKWUY.48.59.F04.1.454.CMB.1.raw
  modified_base (281)..(281): a, c, t, g, unknown or other
  misc_feature (281)..(281): n is a, c, g, or t
  modified_base (417)..(417): a, c, t, g, unknown or other
  misc_feature (417)..(417): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctccaggctcctcatctacggtncatccagcaggccatggcatcccagacaggttcagtggcaggtgggtctgggacagtacttcactctcacgtcagcagactcggaccctgaagtactttgctagtcgttattacgtgttacagctagtatggtacncttcaccgtatccgacttcggcgaacggcaacgacgtggaacgtaacgttaaccgatcggtcggacgtacggacctaccgtattccgttcggttaccttccgtacgttcccttccccgacttacgtaccttaggtacttagttacgttaac

SEQ ID NO: 126927 - DNA, 414 bp, Homo sapiens
  misc_feature: GYAE6OF01CKT3N.48.59.F04.1.454.CMB.1.raw
  modified_base (318)..(318): a, c, t, g, unknown or other
  misc_feature (318)..(318): n is a, c, g, or t
  modified_base (406)..(414): a, c, t, g, unknown or other
  misc_feature (406)..(414): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagngccacctcgtcggggcacgagcggcccgtgggctcgcctggtcaaggctactcctatgtatctctgagcggctggcaggcgtcatagnnnnnnnnn

SEQ ID NO: 126928 - DNA, 706 bp, Homo sapiens
  misc_feature: GYAE6OF01DDUPO.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccacgcccccgagggagggctggagtggattgggagtatttaccgacagtgggagcacctactacaaccctccctacaaacgtcgacggcaccatactaccgtagaccaccggtaccaaacgaacctaattacctaccccgtagaaacgtctagacgtcttccgtaggtccgaacccggtcccgacgaacggaaccgtaccgggtaccttcgttaccgtttaactttaaccgttcggtacggacccgggtaccgggtaccccccgaaggcccggtaccggtaacgggtttcgggtttaccgtttttttacgggacgttttcggttacccctttttagggttacgtttaacgggtttacggggttaaccggggggaccccgtaaaagggggtaacccttaaaagggtttcccgggttaacccgcccccggttttaccccg

SEQ ID NO: 126929 - DNA, 416 bp, Homo sapiens
  misc_feature: GYAE6OF01AW5NW.48.59.F04.1.454.CMB.1.raw
  modified_base (404)..(416): a, c, t, g, unknown or other
  misc_feature (404)..(416): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccaagggacaatggtcaccgtctcttcagcctccaccaagggcccatcggtcttccccctggccaccctcctccaagagccacctctgggggcacagcggccctgggctgcctggtcaaggctacttcctctctcgactcgtgagcggctggcaggcgcatagnnnnnnnnnnnnn

SEQ ID NO: 126930 - DNA, 416 bp, Homo sapiens
  misc_feature: GYAE6OF01DGJ3I.48.59.F04.1.454.CMB.1.raw
  modified_base (404)..(416): a, c, t, g, unknown or other
  misc_feature (404)..(416): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaaggcccatcggtcttccccctggccaccctcctccaagcgcacctcgtgggggcacagcggccctggctgcctggcaaggactacttcctatgtactactctgagcggctggcaaggcgcatagnnnnnnnnnnnnn

SEQ ID NO: 126931 - DNA, 507 bp, Homo sapiens
  misc_feature: GYAE6OF01CT592.48.59.F04.1.454.CMB.1.raw
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagagtatacatacacgaccggtgctcgatttagtacacacacttagggattgggggaagacaatgggtttgattcagattacatgggtgacttttctgttgtatttccaatctcagatgccccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggaccgaagggacacgactaggagtattaaccgactgtgctgcaccntctgtcttcntcttcccnctatcntactntgtac

SEQ ID NO: 126932 - DNA, 514 bp, Homo sapiens
  misc_feature: GYAE6OF01D4VL6.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagtatttgacagtgtattactgtcagcagtatggtagctcaccgatcaccgttcggccaagggacacgactggagtacttaaccgaactgtggctcgcaccatctgttctctatccttcccgctactctagattgtgtac

SEQ ID NO: 126933 - DNA, 589 bp, Homo sapiens
  misc_feature: GYAE6OF01BU287.48.59.F04.1.454.CMB.1.raw
  modified_base (317)..(317): a, c, t, g, unknown or other
  misc_feature (317)..(317): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagtacttactcgtggggctggactccgccacgccccgagggaacgggcgtggagtggagttggagtatttaccanaggtggagctactactacaacccgtcctagaaaacgtcgagcaacatactaccgtagacaacgtaccgaaacgaaccaattccctacctagaacgcctagactctctagtcgacccgccgacacgacgacggcttgtacttacttacgtgtcgccgtacggccccgagccgcgtagtcggttacttttgacttcggttacctttaggagttcgttgggtacggggacccgtaaaggggaacttaaggttcggtaccgtacccggtttacccg

SEQ ID NO: 126934 - DNA, 630 bp, Homo sapiens
  misc_feature: GYAE6OF01D23E4.48.59.F04.1.454.CMB.1.raw
tcagagtatacatacacgaccggtgctcgatttagtacacacacttagggattgggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggacgaccctgtccctcacctgccactgtctctggtcgctccatcagcagctagttacttacgttcgtgggctggactcccgccaccggcccccgaaggggacggggcgtgggaggtggagttagggtagttaactttaccgagtaggtgggacgccaaccctactaaccgtaaccccgtacctaacgaaacggtcgaacggccaaccaatacgtaccgtaacgaccaaccgtaccaaacgtaacctaacttcctaccgtagaacgctagacgtctcgtgtaccgacccggccgacgacgaccgacggtcttcgtacctagttcgtgtcggaccggtaccggcccgagcgcgtagtggtttactttgagttcgttcctttaggattacggtcgggtacgggacgtaaacgggactaaggttcggtccgtccgtccg

SEQ ID NO: 126935 - DNA, 529 bp, Homo sapiens
  misc_feature: GYAE6OF01DJJMA.48.59.F04.1.454.CMB.1.raw
  modified_base (446)..(446): a, c, t, g, unknown or other
  misc_feature (446)..(446): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttactctggggctggatccgccacgcccccagggaaggggctggagtggattggggagtatttaccacagtgggagcacctactacaaccgtccctacaaaagtcgaggcaaccatatccgtagacacgtaccaaagaaccaattctccctgaacgctgagtctctgtcgacccgccgcagacacggctgtctattacngtcgcgtacggcccgagcgcagtgtcttttgatggtcctttgatcgtggtcggggaccgtaagggactagtcggtctaccgtc

SEQ ID NO: 126936 - DNA, 544 bp, Homo sapiens
  misc_feature: GYAE6OF01AJ53U.48.59.F04.1.454.CMB.1.raw
  modified_base (501)..(501): a, c, t, g, unknown or other
  misc_feature (501)..(501): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcacgtcagcagactggaccctagaagtattttgctagtgtatactgtcagctagtatggtagctcacgatcaccttcggaccaagggaccaacgacgtaggagtaacgttaaccgaacgtgtaggccttgccgaccacgttctcgttccttntaccttccttccccgccctacttccttagacttagttgttaac

SEQ ID NO: 126937 - DNA, 749 bp, Homo sapiens
  misc_feature: GYAE6OF01BJ3J6.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctcgtggtcgctcatcagcagcagtacttacttcgtgggctggactccgccacgcccccgaggggaacgggctgggaggtggagttaggggtagttaacgttttacccgaacgtaggtcggggaacgtccgaaccccgtttaaccgtaaccctaaacccccggttacccctaacgtaaaaacggtccggtaacggaccaaccctaattaaccgtacccggtaacgaacccgtaaccggtacccaaaacgtaacccctaaactttacccgtaccccgttagaaaccgtccgttacggacgtccgttccgttacggttacggaccccgccggaccgacggaacccgaccggtcttagtaccgttaactttacgtcggttcggaccgggtaccgggtccccgaggcccgacgtaacggttcggttacgttttttggaacgtttcggtacccgttttagacgttaggttcgggttaccggggaaccgtaaacggggtaacgtaaggttccgggttcccgtaccggttacccg

SEQ ID NO: 126938 - DNA, 600 bp, Homo sapiens
  misc_feature: GYAE6OF01AC4KR.48.59.F04.1.454.CMB.1.raw
  modified_base (398)..(398): a, c, t, g, unknown or other
  misc_feature (398)..(398): n is a, c, g, or t
  modified_base (458)..(458): a, c, t, g, unknown or other
  misc_feature (458)..(458): n is a, c, g, or t
  modified_base (554)..(554): a, c, t, g, unknown or other
  misc_feature (554)..(554): n is a, c, g, or t
  modified_base (577)..(577): a, c, t, g, unknown or other
  misc_feature (577)..(577): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctccaggctcctcatctacggtgcactccagcacgggcccacgtcggcactcccagacaggttccagtcggcagtgggtcgtgggactagaccttcactctccgaccgtcaacgcgacgacgtcggaccctagtaacgtntttggacctaggttagttatttaacgttgtaccgagtaccgtaagttaggtacggttacnccgttaccgaccgtactaccgtacccgttcggaaccgaaacgggacaacggtacgtaggacgtaacgttaaccgacgtggtggacctcgctacctntcgttctacttctcttcctcccnctacttacgtagcttatgttacg

SEQ ID NO: 126939 - DNA, 516 bp, Homo sapiens
  misc_feature: GYAE6OF01B39ET.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaacggggctggagtggattgggagtatttaccacagtgggagcacctactacaaccgtcctcaaaagtcgaggcaccatatccgtagacacgtccaaagaaccaattctcctagaagctagagctctgtgaccgcgcagacacggctgtctattactgtgcgacggcccgagcgcagtggtcttttgatgtcctttgattagtggtgggccaagggacaagtcggtcaccgttcg

SEQ ID NO: 126940 - DNA, 738 bp, Homo sapiens
  misc_feature: GYAE6OF01D4XK8.48.59.F04.1.454.CMB.1.raw
tcagagtatacatacacgaccggtgctcgatttagtacacacacttagggattgggggctttctgagagtcatggatctcatgtgcaagaaaatgaagcacctgtgttcttcctcctgctggtggcggctccagagtgggtcctgtccagctgcagctgcgaggcggtccgggccaggactgggtagacgtccgttcggacgtacccgtcgtccctcacctgctactgtctcgtggtcgcctacatcgagcgagtactacgttacctttacgttcggtcggggtctcggtacctccgaccgaccggccccggaggggacgggcgtgggaggtggtaggttgggtacgttacgttaccgagtaggtcggactaccgtaaccgtaacctaacccgaacccgttacccgtaacgtaaaacgtcggacgacctaactaagttaccgtaccgtaacgaccgtaaccgtaaccgtaaactaaccttacttcccgtaccgtagtaaccgtcgtagtcgtacctcgtacggtaccgacccgaccgacgtacgaacgtccgtacgttacgttaccttagttaccgtcgggtaccggaccggtacccggtaccccggagtaccggtacggttagggtttccggttttacgttttagaccgtttccggtttacgtttaggtacggtttcgggtacggggtacgggaaccggtaacgggtacgtaacggtttccgtaaccgtcccgttac

SEQ ID NO: 126941 - DNA, 719 bp, Homo sapiens
  misc_feature: GYAE6OF01BAK8H.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgaggggaacgggcgtgggagtggagttgggtagttactttaccgacgtaggtgggacgcgtacctaactaacccgaaccccgtaccctaacgaaaacgtccggaacggaccaacctaactacgtacccgtaacgaacctaaccggtacccaaacgtaaccctaactttccctacccgtagaacgtcgtacggaacgtccttacgtcggtaccgaccccggtcccggaccgaacggacccgaccgggtcttacggttaccgtttaacgtttacgtggtccggaccgggtacccgggcccccggtaggcccggtacgtacggttcgggttaccgttttttggacgtttcggttcccgttttaggtaacgttaggttcgggtaccgggggaacccggtaaaggggtacctaaagggttcggttaccccgtacccggtttcccg

SEQ ID NO: 126942 - DNA, 864 bp, Homo sapiens
  misc_feature: GYAE6OF01DH6UU.48.59.F04.1.454.CMB.1.raw
  modified_base (162)..(162): a, c, t, g, unknown or other
  misc_feature (162)..(162): n is a, c, g, or t
tcagagtatacatacacgaccggtgctcgatttagtacacacacttagggagttgggggctttctgagagtcatggatctcatgtgcaagaaatgaagcactgtgttctctctgctggtggcggctccgagatgggtcctgtcccagctgctagctgcaggngtcggccaggactggtgaacgtccgttaggacgacccgtggtccctcacctcggcctacgtgtccttcgtagggtcgcccttaccgagtccgagccgagtccgtaacgtttacctttaccgttcggtcggggtacttcgggaccttcccgaccgaaccggtcccccggaagggggtaaccggggcgttagggtacggttcgggtagtttacggggacgtttaacgtttaccgacggtagggtacgggaccgtaccgaacccgttaaccgtaacccgtaccccgtaccgtaaacgtaaaacggtcggaacggtaccctaacgtacgtaaccgtaccgtaacgtaacccgtaaccgtaaccgtaaaacgtaaacccttaccgtttcccgtaacccgtaacggaacgttcgtaaccggtaactccgttacggtcggtaacccggaccccgacgtaacccgaaacggtacccgtaccgggttacttacgtttaccgttaacttttaacccggagggttacccggacccggggtaacccgggcccccggtaggtacccggttcggtaacgggttttccgttaaccttttgggaaccgtttcgggttttaccgttagggtttagtttccgggtacgggggtacccgggtaaacccgtaaaggggttacccttaagggttcccggtacccgttaccgttttaaccccgg

SEQ ID NO: 126943 - DNA, 595 bp, Homo sapiens
  misc_feature: GYAE6OF01C0H1D.48.59.F04.1.454.CMB.1.raw
  modified_base (352)..(352): a, c, t, g, unknown or other
  misc_feature (352)..(352): n is a, c, g, or t
tcagagtatacatacacgaccggtgctcgatttagtacacacacttagggattgggggaagacaatgggtttgattcagattacatgggtgacttttctgttgtatttccaatctcagatgccccccggagaaattgtgttgacgcagtctccagacaccctgtctttgtctccaggggaaagagccaccttctcctgcaggtccagtcagagtcttaccaacgactacttagcctggtaccatcagaacctggccaggctccaggctcctcatctacggtgcatccagcagggccacgtggcactcccagacaggttcagtggcaggtgggtctgggacagacttcactcncaccgtcagcagactcggacctagaacgtatttgactagtgtattactgtcagctagtatggtagctacgaccgtatccgtacccgttacggaccgaacgggacaaccggtacgtacggaacgtaacgttaaccgtacgttggtacgcgtacgaccgtacctagtccgttacgttccctttactacctttccccgttaccccgtacctaccgttacttacggtaacttacgttggttaaaccc

SEQ ID NO: 126944 - DNA, 677 bp, Homo sapiens
  misc_feature: GYAE6OF01DURH5.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctcatcagcagcagtacttacttctgggctggatccgccagccccccgaggggaaggggctggagtgggattgggagtatttaccacagtggagcacctactacaacccgtcctacaaaacgtcgacggtcaaccatactaccgtagaacctacgtaccaaacgaacctaacttcctacccgtagaacgcgtacgacgtactcgtcgtcgacccgtccgacgaacgaccgaaccgggtcttacggtaccttaacgtttaaccgttaggtcggacccgggtacgggaccccccggtaaggcccgtaccggtacggttacgggtttcccgtttttttaggaacgtttccgggttccctttttaggaacgtttacggttcggggttacgggggtaacccgtaaaaggggtaaccgtaaaggtttccgggtaaccgtaccccggtttacccg

SEQ ID NO: 126945 - DNA, 552 bp, Homo sapiens
  misc_feature: GYAE6OF01BCHAG.48.59.F04.1.454.CMB.1.raw
  modified_base (180)..(180): a, c, t, g, unknown or other
  misc_feature (180)..(180): n is a, c, g, or t
  modified_base (280)..(280): a, c, t, g, unknown or other
  misc_feature (280)..(280): n is a, c, g, or t
  modified_base (379)..(379): a, c, t, g, unknown or other
  misc_feature (379)..(379): n is a, c, g, or t
  modified_base (454)..(454): a, c, t, g, unknown or other
  misc_feature (454)..(454): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
  modified_base (524)..(524): a, c, t, g, unknown or other
  misc_feature (524)..(524): n is a, c, g, or t
tcagagtatacatacacgaccggtgctcgatttagtacacacacttagggattgggggaagacaatgggtttgattcagattacatgggtgacttttctgttgtatttccaatctcagatgccccggagaattgtgttgacgcagtctccagacaccctgtctttgtctccaggggaaangccaccttctcctgcaggtccagtcagacgtcttaccaacgactacttagcctggtaccatcagaaacctggccaggctccaggctcctcatctacggtncatccagcagggccacgtcggcactcccagacaggtcagtggcaggtcgggtctgggactggacttccactctcaccgtcagcagctggacctgaagtntttggcgtttatctgtcagtcagtctgacctactggacctgtacgacggttcggacggtagggacccgtaagggngtaccaagtaccgaaacgtaacgtggcggaccngacaaccgtntaccgtgtaccttcaattcccgtaccnctattctacgattactggtaactcgtcg

SEQ ID NO: 126946 - DNA, 652 bp, Homo sapiens
  misc_feature: GYAE6OF01D3SNU.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtccgggcccaggactgggtagaacgtcccttcgggacgacccctgtcccctcacctgccactgtctcgtggtcgcctccatcagcagcagtacttacttcgtgggctggactccgccacgcccccgaggggaaggggctggaggtggagttggggattagtttaccagaggtgggacgcacctactaccaacccgtcctaacgaaacgtcgacggcaccatactacgtacgacacgtaccaaacgtaacctaacttcctaccctaggaacgtctacggtacgtctacgtcggtaccgacccgtccgacgacgaccgaccggtcttacgttacttaacgttcgtggtccggacgggtaccggccccggtagccgtcgaacggttcggttacgttttgacgttcgttccgtttaggagtttacggttcgggtacggggtaccgtaaacggggtactaagggtttccgggtccgtaacccggtttccg

SEQ ID NO: 126947 - DNA, 594 bp, Homo sapiens
  misc_feature: GYAE6OF01AL6ZE.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtcggctccatcagcagcagtacttacttcgtggggctggactccgccacgcccccgagggaaggggcgtggagtggagttgggagtatttaccgacgtaggtgggacgcacctaactaaccgaacccgtaccctacgaaacggtcgacggaccacctatactaccgtacgacctaccgtaccaaacgaaccctaacttccctaccctagtaacgcgtagaacgtctcgtacgtcgacccgccgaccacgaccgacgtcgttgtaccttatacgtggtcgcggacggcccgagcgcgtagtcggttcgttttgattcgtctttagattcgtggtcgggacgtaacggactaagtcggtctccggttcc

SEQ ID NO: 126948 - DNA, 701 bp, Homo sapiens
  misc_feature: GYAE6OF01AV79D.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggactccgccacgcccccgagggaacggggctgggagtggagttgggagttatttaccgacgaggttgggacgccgaacccttaacgtaacctaaaccccggtcccctacgaaaaacgtcgaacggtccaaccaatactacccgtagaccgaacgtacccaaacgaaaccctaactttacctaccctaggaacgtctacggacgtcttcgtcggttccgacccgtcccggacgaacgaccgaccgggtcgttagttccgttaagtttaccgtacggttcgggaccggtaccgggacccccggtggacccgacgtacgggttcgggttcctttttttagggactttccggttcccgttttaggaacgtttacggttaggggtaccggggaacccggtaaaggggtacctaaaggtttccgggttccgtaacccggtttcccg

SEQ ID NO: 126949 - DNA, 740 bp, Homo sapiens
  misc_feature: GYAE6OF01CQSE2.48.59.F04.1.454.CMB.1.raw
tcagagtatacatacacgaccggtgctcgatttagtacacacacttagggattgggggctttctgagagtcatggatctcatgtgcaaagaaaatgaagcacctgtgttcttcctcctgctggtggcggctcccagatgggtcctgtcccagctgcagctgcaggagtccgggcccaggactggtgaacgtcccgttcggacgaccctgtcccctcacctgcctactgtctcgtggtcgcctccatcagcagctagttacttacgtcgtgggactggactccgccgaccggcccccgaggggaacgggtcgtaggaggtggtagttgggtaacgttacgtttaccgacgtaggtgggacgcctaacccgtaacctaacccgtaaccccgttaccctaacgtaaaaacggtccggaacggaccaacctaacgttacgtacccgtaacgaccgtaaccgtaaccgaaaacgtaaccctaacttccctacccgtaagaaccgtccgtagtaccgtaccgttcgtacggtaccgaccccgtccgaaccgacggaccacgggtcttacgtaccttactttacgtcggcggtacccggaccggtccccggaagtcccggacgtacgggttcgtttccgttttacggacgtttcggttaccgttttaggacgtttacgggttcggggaacggggtaacccggtaaagggtacgttaaggtcccgggttaaccgttcccgtttaccgg

SEQ ID NO: 126950 - DNA, 570 bp, Homo sapiens
  misc_feature: GYAE6OF01DY8QX.48.59.F04.1.454.CMB.1.raw
  modified_base (185)..(185): a, c, t, g, unknown or other
  misc_feature (185)..(185): n is a, c, g, or t
  modified_base (528)..(528): a, c, t, g, unknown or other
  misc_feature (528)..(528): n is a, c, g, or t
  modified_base (542)..(542): a, c, t, g, unknown or other
  misc_feature (542)..(542): n is a, c, g, or t
tcagagtatacatacacgaccggtgctcgattttagtacacacacttagggattgggggaagacaatgggtttgattcagattacatgggtgacttttctgttgtatttccaatctcagatgcccccggagaaattgtgttgacgcagtctccagacaccctgtctttgtctccgaggggaaagngccaccttctcctgcaggtccagtcgagagtcttaccaacgactacttagcctggtaccatcagaacctggccaggcctcccaggcctcctcatcgtacggtcgacatccagccgacgggcccacgtcggacacgtcccgagacgtaggttcgaggtggctaggtggtcgtggacagtacttcactctacgaccgtcagcacgacgtcggacccgtagaacgtatttcgactagtgttacttactgtacgaagtctaagtagtacggtactctacgtacgtactcctaccgttcgacgaacggacacgacgtagacgtaacgtaacgatgtacgcagcgacgngtcgtcgtcttacnctcctccgactactctatctagtgtaac

SEQ ID NO: 126951 - DNA, 414 bp, Homo sapiens
  misc_feature: GYAE6OF01BWD92.48.59.F04.1.454.CMB.1.raw
  modified_base (303)..(303): a, c, t, g, unknown or other
  misc_feature (303)..(303): n is a, c, g, or t
  modified_base (401)..(414): a, c, t, g, unknown or other
  misc_feature (401)..(414): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaaggcccatcggtcttcccctggcnccctcctccaagagcacctcgtggggcacagcggccctgggctgcctggtcaaggactacttcctatgtatactctgagcggctggcaggcgcatagnnnnnnnnnnnnnn

SEQ ID NO: 126952 - DNA, 599 bp, Homo sapiens
  misc_feature: GYAE6OF01BU9B7.48.59.F04.1.454.CMB.1.raw
tcagagtatacatacacgaccggtgctcgatttagtacacacacttagggattgggggaagacaatgggtttcgattcagattacatgggtgtacttttctgttgtatttccaatctcagatgcccccggagaaattgtgttgacgtcagtctccagactaccctgtctttgtcttccgaggggaaagagccaccttctcctgcaggtccagtcagagtcttaccaacgactacttagcctggtaccatcagaaacctggccaggctcccaggctcctcatctacggtgcatccagcacgggccacgtcggcactcccagacgaggttcagtggcaggtggtcgtgggacagtacttcactctacaccgtcagcagactcggaccctgtaagtatttagctagtgtacttactgtcagtactaagtacgtaggtacgcctacgactactacctaccgttcggaccgtaacgggacaccgtacgtaggaacgtaacgttaaaccgaacgtgtacggctacgacctacctagttccgtcgtttactacgacgttcccgttaccccgtaccgtacttacgtagtacgttagttcgttaaccg

SEQ ID NO: 126953 - DNA, 653 bp, Homo sapiens
  misc_feature: GYAE6OF01BC5OM.48.59.F04.1.454.CMB.1.raw
tcagagtatacatacacgaccggtgctcgatttagtacacacacttagggattgggggctttctgagagtcatggatctcatgtgcaagaaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggactccgccacgcccccgaggggaaggggctgggagtggagttgggagttactttaccacgtagtgggacgcaacctactaaccgaaccccgtacctacgaaaacgtcgaggccaaccatactccgtacgacacgtaccaaagaacctaacttcctaccctagaacgctagacgtctctcgtcgacccgtccgacacgacaccggtctacggttccttaacttacgtcggtcggacccggtaccgggccccggtagccgtacgtaaggttcggttccgtttttaggacgtttccggtcccgtttttaggaacgtttacggttcggggtacgggggtacccgtaaaagggggtacctaaaggttccgggttaccgtacccggtttacccg

SEQ ID NO: 126954 - DNA, 496 bp, Homo sapiens
  misc_feature: GYAE6OF01DVYEJ.48.59.F04.1.454.CMB.1.raw
  modified_base (372)..(372): a, c, t, g, unknown or other
  misc_feature (372)..(372): n is a, c, g, or t
  modified_base (469)..(496): a, c, t, g, unknown or other
  misc_feature (469)..(496): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgtcctttgattatggtgggccaagggacaagtggtcaccgttctcttcagccctccaccgaagggcccagtccggtccttccccccgtggccgtcccctgcctccgaggacgccacccgtccgagacgcacgaggcccggtccccgngggcctacggccgtggtacgaacggtacttactttcctagtcggttactaccctcgtggacgggccggggcgtcgggacgtacgggtcactaagagnnnnnnnnnnnnnnnnnnnnnnnnnnnn

SEQ ID NO: 126955 - DNA, 443 bp, Homo sapiens
  misc_feature: GYAE6OF01EUZ3N.48.59.F04.1.454.CMB.1.raw
  modified_base (424)..(424): a, c, t, g, unknown or other
  misc_feature (424)..(424): n is a, c, g, or t
  modified_base (431)..(443): a, c, t, g, unknown or other
  misc_feature (431)..(443): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggccccgagcgcagtggtcttttgatgtcctttgatatgtgggccaagggacaatggtcaccgttctcttcacgccctccaccgaacgggcccagtccggtccttccccccgtggcctacccctcctccaacgtacgcctaccgtcgtcgggggcacacgcggcccctgggcctgcccgtggtcaggactacttctctctcgactcgtgagcggctggcacggcncagtagnnnnnnnnnnnnn

SEQ ID NO: 126956 - DNA, 660 bp, Homo sapiens
  misc_feature: GYAE6OF01CME0V.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaacgtccttacggagaccctgtcccctcacctgcactgtctcgtggtgcctccatcagcagcagttacttactcgtgggctggactccgccgacgccccggagggacgggcgtaggagtggagttggagttacgtttaccacgtaggtacggacgtacacctaacctacccgaaccccgttaccctaacgaaaacgtccggaacggacctaaccacgttaacgtacccgtaaacgaaccgtaaccggttaacccaaacggtaaacccttaactttacccgtaccccgtaaggtaaaccgtcgttacgaacgtcctacgtcgtcgaacccgccgtacacgaccgtacggtctcgttaccttacgttacgtcgtcggaccgtccggacccgagccgtacgtaggttcgttccgttttagacgttcgtactttgacgttgtcggtacgggacgtaaggtacagttcgtccgcgttacc

SEQ ID NO: 126957 - DNA, 417 bp, Homo sapiens
  misc_feature: GYAE6OF01ANI5I.48.59.F04.1.454.CMB.1.raw
  modified_base (409)..(417): a, c, t, g, unknown or other
  misc_feature (409)..(417): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggcaatggtcaccgtctcttcagcctccaccaagggcccatcggtcttcccccctggccaccctcctccaagagccacctcgtgggggcacagcggccctgggctgcctggtcaaggactacttcctatgtatactctgagcgggctggcaaggcgcagtagnnnnnnnnn

SEQ ID NO: 126958 - DNA, 532 bp, Homo sapiens
  misc_feature: GYAE6OF01ETGMI.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattggggagtatttaccacagtgggagcacctactaccaacccgtccctacaaaacgtcgaggcaccatatccgtagacacgtccaaagaaccaattctccctagaacgctgagcctctgtcgaccgccgcacgacacggctgtctattctgtgcgacggccccgagccgcgagtggtctttttgattgtcctttgattgtggtggggaccgaagggacaagtcggtcgccgttccg

SEQ ID NO: 126959 - DNA, 527 bp, Homo sapiens
  misc_feature: GYAE6OF01AMZ5B.48.59.F04.1.454.CMB.1.raw
  modified_base (409)..(409): a, c, t, g, unknown or other
  misc_feature (409)..(409): n is a, c, g, or t
  modified_base (519)..(519): a, c, t, g, unknown or other
  misc_feature (519)..(519): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcacgactcggaccctgaagtattttgctagttgtattacgtgtcagcagtntggtagctcaccgatcaccttcggaccgaagggacctacgactgggacgtattaaaccgactggtcggctgcaccatcgtcgtcttcgcttccttcccgcctactctatntatgttac

SEQ ID NO: 126960 - DNA, 707 bp, Homo sapiens
  misc_feature: GYAE6OF01CKJQB.48.59.F04.1.454.CMB.1.raw
  modified_base (167)..(167): a, c, t, g, unknown or other
  misc_feature (167)..(167): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatcgggtcctgtcccagctgcagctgcaggngtccgggcccaggactggtgaacgcccttggacgaccctgtccctcacctgctactgtctcgtggngctccancagcagcattacttacgtcgtggggctcggactccgaccgaccggaccccggaaggggaacggggcgtagggacggtggtaggttagggtaacgttacgtttaaccgacggtagggtacgggacgtacctaaccgtaacctaacccgtaacccgtaccgtaacgaaaaacgtcggaacgaccaccattactaccggtaacgaccaaccgtaccaaacgaacctacttaccaccgtagacgtctagacgtctcgtacgtaccggacccgaccgacgaacgtaccgaacggtccttcgttaccgttaacttacggtacggtcggaccggtacccgggaccccgaggcccggtacgtaacggttcggttcgttttacggacttccggttccgtttaggtacgttacgggtacgggtaccggggtaacggtaaacgggtactaacgggtcggttcccgtacccggttaccg

SEQ ID NO: 126961 - DNA, 521 bp, Homo sapiens
  misc_feature: GYAE6OF01A5EK2.48.59.F04.1.454.CMB.1.raw
  modified_base (411)..(411): a, c, t, g, unknown or other
  misc_feature (411)..(411): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgattttgcagtgtattactgtcagcagtatggtanctcaccgatccaccgttcggaccaagggaccacgactggagtacttaaccgaatcggtgctgcaccatcgtgttcttctcttccttcccgctactctagattagtgtaac

SEQ ID NO: 126962 - DNA, 596 bp, Homo sapiens
  misc_feature: GYAE6OF01DFYXG.48.59.F04.1.454.CMB.1.raw
  modified_base (212)..(212): a, c, t, g, unknown or other
  misc_feature (212)..(212): n is a, c, g, or t
  modified_base (342)..(342): a, c, t, g, unknown or other
  misc_feature (342)..(342): n is a, c, g, or t
  modified_base (390)..(390): a, c, t, g, unknown or other
  misc_feature (390)..(390): n is a, c, g, or t
tcagagtatacatacacgaccggtgctcgatttagtacacacacttagggattgggggctttctgagagtcatggatctcatgtggacaagaaaatgaagcacctgtggttcttcctcctgctggtggcggctcccagatgggtcctgtcccagctgcagctgcaggagtcgggcccaggactggtgaacgccttcggagaccctgtccctnacctgcacttgtctctggtcgctccattcagcagctagtacttacttcgtggggctggactccgccacggcccccgaggggaacgggctggaggtggagttgggacgttactttaccacgtaggtgggancacctactaccaacccgtcctacaaacgtcgagcacgatactccgtanacacgtaccaagaacctattcctaccgtagaacgtctagacgtctctgtacgacccgcgacgagaccacggcttcgtactacgttacgtcggtcgccggtaccggccccgagccgcgtaggtcggttcttttgacgttcgtccttttagacttaggttcgggtcgggaacctaaagggacctaaggttcggtcctacccggttacc

SEQ ID NO: 126963 - DNA, 581 bp, Homo sapiens
  misc_feature: GYAE6OF01CMCAN.48.59.F04.1.454.CMB.1.raw
  modified_base (389)..(389): a, c, t, g, unknown or other
  misc_feature (389)..(389): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcacgggccacgtggcactcccagacaggttcaggtggcaggtgggtcgtgggaacagacttcactctccaccgtcagcagacctcggaccctagaagtntttgactagtagtattactgtcagtacgtagtataggtacgcgtcaccgactcctaccgtacggacgaacgggacgaacgacgtacggaacgtaacgtaaccgtaacgtggtcgacgtcgacacctacgtcgttcgttcttactcttacccgttcccgtccacttttttttacagtaactagttcgttaacg

SEQ ID NO: 126964 - DNA, 668 bp, Homo sapiens
  misc_feature: GYAE6OF01AC84W.48.59.F04.1.454.CMB.1.raw
  modified_base (163)..(163): a, c, t, g, unknown or other
  misc_feature (163)..(163): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcgctccagatggtcctgtcccagctgcagctgcaggngtccgggccaggacgtggtgaacgtccgttcggacgtacccgtgtccctcacctgctacgtgtctgtggtcgcctccatcagcagcatacttactcgtggtctgactccgcgaccgccccggaggacgggcgtggagtggtagtcgggtagttacttacgagtagggtcggacgtaccctaacctaacctacccgtaacccgtaccgtaacgaaaacggtccgaacgaccaactacgtacgtacgacgaaccgtaacgtaaccgaaaccgtaaccttaacgttccctacccgtagtaaccgctacgtacgtccgtaccggtcgtaaccggacccgcccgtaacaaccggtactaccgggtactacgtacttaacgttcgtacggtacgacccggacggtcccgagtccgcgtacggttcgttagtttcgacgttcgttccgttaagtaccgtaggttcgggtaacgggacgtaaacgggacttaacgtcggtccctccgttaccg

SEQ ID NO: 126965 - DNA, 612 bp, Homo sapiens
  misc_feature: GYAE6OF01AIO57.48.59.F04.1.454.CMB.1.raw
tcagagtatacatacacgaccggtgctcgatttagtacacacacttagggattgggggaagacaatgggtttgattcagattacatgggtgacttttctgttgtattttccaatctcagatgcccccggagaaattgtgttgacgcagtctccagacaccctgtctttgtctccaggggaaagagccaccttctcctgtagggccagtcagaatgttaagagccactccttagcctggtaccagcaaaaacctggccagcctcccaggctcctcatctatggtgcgtccaccagggccactggcatccccagacaggttcagtcggcagtgggtcgtgggacagcttcactctcaccatcaccagactggacgcctgactgtattttgctagttgttttctgtcagctagtagtggaagttccacgtcggactacgtttcggaccgtaacggggaccaagggtacggaaacgtaccgaaaacggacgttacggtggtcctacggacctaacccgtacgtcgttacgttaccttaccgtaccttacccgtttaccccgtccttaccttccgttacggtacttaacgttacgttacttacccgttcgtacgggg

SEQ ID NO: 126966 - DNA, 431 bp, Homo sapiens
  misc_feature: GYAE6OF01A28OK.48.59.F04.1.454.CMB.1.raw
  modified_base (413)..(413): a, c, t, g, unknown or other
  misc_feature (413)..(413): n is a, c, g, or t
  modified_base (419)..(431): a, c, t, g, unknown or other
  misc_feature (419)..(431): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccccgtggccaccctcctccaagacgccacctcgtgggggcacagccggcccgtgggctcgccgtggtacgaaggactacttcctctctcgactctgaggcggctggacgagggcncatagnnnnnnnnnnnnn

SEQ ID NO: 126967 - DNA, 586 bp, Homo sapiens
  misc_feature: GYAE6OF01D7IQP.48.59.F04.1.454.CMB.1.raw
  modified_base (455)..(455): a, c, t, g, unknown or other
  misc_feature (455)..(455): n is a, c, g, or t
  modified_base (562)..(562): a, c, t, g, unknown or other
  misc_feature (562)..(562): n is a, c, g, or t
tcagagtatacatacacgaccggtgctcgatttagtacacacacttagggattggggagagctgctcagttaggacccagagggaaccatggaaaccccagcgcagcttctcttcctcctgctactctggctcccagatgcccccggagaattgtgttgacgcagtctccagacaccctgtctttgtctccgaggggaaagagcccaccttctcctgccaggtccagtcagatcttaccaacgtactactagcctggtaccatcaagaaacctcggaccaggcctcccgaggcctcctcacttcgtacggtgcactccgagcgacgggccacgtcggcactcccagacgtaggttcagtggcgaggtggtcgtgggacagtacttcactctacaccgtcagtcacgtacgtacggaccctagagtagtttgactagttgtacttacgtgtcgagntacgtagtaggtagctaccgacgtactaccgtaccgttccggaacgacgggacacggtacgtaggaacgtaacgttaaccggagttggacggtctacgctaaccgtnttacttagttcttcgtcttccccg

SEQ ID NO: 126968 - DNA, 646 bp, Homo sapiens
  misc_feature: GYAE6OF01BXITM.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgaggggaacgggctggagtggagttgggagtactttaccgacgaggtggacgcacctactaccaacccgtcctacgaaacgtcgacgacaccatacgtaccgtagacctacgtaccaaacgaaccctaactttcctacccgtaggaacgtctacggaactccttcgtcggtcggacccgccgtacgaacgaccgaccggtcttacgttaccttacttacgtggttacgacgggtaccggcccgaggccgtacgtacggttcggttacttttttcggacgtttccgttaccgtttagaagttcgttaggggtaccggggtaccgtaaacggggtactaaagggtttcggtcccgtaaccggtttcccg

SEQ ID NO: 126969 - DNA, 623 bp, Homo sapiens
  misc_feature: GYAE6OF01AHSQ1.48.59.F04.1.454.CMB.1.raw
tcagagtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctccaggctcctcactctacggtgcatccagcgacgggccacgtggcacgtcccagactaggttcaggtcggactaggtcgggtcgtaggggacaggtaccttcgaacttccgtaccgaccgtcacgccaacgaccgtacggaccctgaacgttactttcgactagttacgttattacgtgtacgagtactagttacgtggtactcgtaccgaccgtacttaccgtaccggtttaccggaccgaacgggaccaccggtacgtacgggaacgtaacgttaaaccggtacgttggtacggctaccggacctaaccgtacttaccgttagttccttctacgttaccccg

SEQ ID NO: 126970 - DNA, 678 bp, Homo sapiens
  misc_feature: GYAE6OF01AV6V2.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctctgctggtggcgctccagatggtcctgtcccagctgcagctgcaggagtcgggcccagggactgggtagaacgtccctttcgggacgtaccccttggtcccctcgacccttggacctacgttgtccttcgtaggtcgccttccagtcagcagctagtacttacgttcgtgggctggactccgaccgacgccccgagggacgggctggacgtggagttgggtacgtacgttaccgagtaggtggacgtacgtacctacgtaccgaccgtcctaacgtaaacgtcgacggtaccacgtatacgtccgtaacgacctaacgtaccgaaacgtaacctacgttccgtacctaggaacgtcgtacgacgtacctcgtcgtaccggaccgccgtacgacgaacgtaccggtcttacgtacttaacgttaccgttaggtaccggtaccgggtaccggtcccgaggtaccgtacgtacggttcggttcgttttacgacgttccgtaccgttagtacttacggtcgggtacggaccggtaacggtacgtaacggtccggtacgtccgttccg

SEQ ID NO: 126971 - DNA, 782 bp, Homo sapiens
  misc_feature: GYAE6OF01EB4AH.48.59.F04.1.454.CMB.1.raw
tcagagtatacatacacgaccggtgctcgatttagtacacacacttagggagttgggggctttctgagagtcatggatctcatgtgcaaagaaaatgaagcacctgttggttcttcctctgctgggtggcggctccagagtgggtcctgtcccagctgcagctgacgaggacgtccgggcccagggacttgggtacgaacggtcccgtttacgggacgtaccccttcggtcccctctaaccgtggacctacgtgttcctcggtgggttcgacctccgatcgacgcacgtacgtacgttaacttaccgttcggtcggggctacgggacctcccgaccgaccggccccgggaagggggacgggtcgtagggtacggttaggtacggttagggtaactttaacgtttaacccgaggtagggttcgggaaccgtacctaaccgtaaccgtaacccgtaaccccgtaccgtaacgtaaaacgggtccggaacggacctaaccgtaacgttaacgttacccggtaacgaaccgtaacccggttaaccaaaacgtaaccttaacgttaccctaccgtacgtacgcgttacgacgtctcgtacgtaccgtcgtccgacacgacgtacggtcttacgtacttacgtacgtcgtacggaccgtaccggaccgtacggccggttacgaggtttcggttcttttaggacgtttacgtccggtttagtacggtttcgggacgggttacgggaacgtaacgggtaacttaccgggttacgtccgtaccggttaccg

SEQ ID NO: 126972 - DNA, 768 bp, Homo sapiens
  misc_feature: GYAE6OF01BSS0Q.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgccccggagaaattgtgttgacgcagtctccagacaccctgtctttgtctccgaggggaaagagccaccttctcctgcaggtccagtcagagtcttaccaacgactactagctgtaccatcagaaacctggccaggcctccgaggcctcctcatcgtacggtgcatccgagcacgggccacgtcggacacgtcccgagaccgtaggttcaggtcggacagggtcgggtcgtaggggacctaggacttccgacgtcctcgacccgtacgacgccgaaggtaccgtacgggtaacccctaggtaaacggtacttttaggaccgtaggttacgttaacgtttacgtcggttacgtaacgtcgtaagttaacggttcgggttacgaccgttaccgaacccggtaacgtttaccccgtaacccggtttacccgggaacccggtaaacggggaacccgtaacccggaaccgggttacgggtaaaccggttaaacccgtttaaaacccggtaaccgggtttaccgggttacggggtaacccgttacggaaccccggtaaaccccttaacgttccgtttaccgttccgtttacctacccgttcccgttacccccgtaccttaccgttaccttacggtaacttagttacgttaaccg

SEQ ID NO: 126973 - DNA, 635 bp, Homo sapiens
  misc_feature: GYAE6OF01CQWXS.48.59.F04.1.454.CMB.1.raw
  modified_base (205)..(205): a, c, t, g, unknown or other
  misc_feature (205)..(205): n is a, c, g, or t
  modified_base (318)..(318): a, c, t, g, unknown or other
  misc_feature (318)..(318): n is a, c, g, or t
  modified_base (466)..(466): a, c, t, g, unknown or other
  misc_feature (466)..(466): n is a, c, g, or t
tcagagtatacatacacgaccggtgctcgatttagtacacacacttagggattggggagagctgctcagttaggacccagagggaaccatggaaaccccagcgcagcttctcttcctcctgctactctggctcccagatcgcccccggagaaattgtgttgacgcagtctccagacaccctgtctttgtctccgaaggggaaagngcccaccttctcctgcaggtccagtcagagtcttaccaacgactacttagtcctgtaccatacaagaaacctcggaccaggcctcccgaggcctcctcacgttccgtacggtntcctactccaggccgtacggccacgtcggcactcccagacgtaggttcgaggtcggctaggtgggtcgtggactacgtcttacactctaccaccggtcagaccgtagtaccgtacggtaccctagtaattagtttcgacgtaaggttnttaacttcgtacggttacagtcgttaagttagtcgggtaatccgtaccgacgtactaccgtacccggttacggaacggaaggtaccgtacgtaacggtgaaccgtaagttaaccgtaggttgaccggtcttcgacgaccttcgttatcgtttactccgtaccgttcccg

SEQ ID NO: 126974 - DNA, 574 bp, Homo sapiens
  misc_feature: GYAE6OF01AETHB.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctccaggcctcctcatctacggtgcatccagcagggcccactggccatcccagacaggttcagtggcaggtgggtctgggacagacttcactctcgaccgtcagcagactcggaccctgaagtatttgctagttgttttctgtcagtctagtagtggtaacttcaccgtcgacagttccggccgacggggtacgaagggtacggaaactacgtaaacgaacgtaggtcggtactacggaccaaccgtcgtcgttcgtaccttctacttcccgttcccgcctacgtctagtacttattagtacttacgtcgtacggg

SEQ ID NO: 126975 - DNA, 676 bp, Homo sapiens
  misc_feature: GYAE6OF01ERRML.48.59.F04.1.454.CMB.1.raw
  modified_base (284)..(284): a, c, t, g, unknown or other
  misc_feature (284)..(284): n is a, c, g, or t
  modified_base (388)..(388): a, c, t, g, unknown or other
  misc_feature (388)..(388): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggcctcctcatctacggtncatccagcagggccacgtggccacgtcccagacaggttcgagtcggctagtgggtcgtgggacagtacttcactctcacgtcagcacgctcggacctgaacgtntttgctagttgtattacgttgtacagtacgtagtagtaggtacgcgttaccacccgtaactcccgtaaccgtttaccgggaccccgtaaacgggacctaacggtaaccgtaggtaaacgtaacgtttaaacccggtacgttagggtccggtacctacggacctaacccggtaactttccggttccggtttacctttacccggttacccgtttacccccgtttaccccccggacccgtttaaccgtttcccgttaaacgttacgtttaacgttaacgggttttaaaccc

SEQ ID NO: 126976 - DNA, 813 bp, Homo sapiens
  misc_feature: GYAE6OF01DL2J8.48.59.F04.1.454.CMB.1.raw
tcagagtatacatacacgaccggtgctcgatttagtacacacacttagggattgggggctttctgagagtcatggatctcatgtgcaagaaaatgaagcacctgtgttcttcctcctgctggtggcggctcccagatgggtcctgtcccagctgcagctgcaggagtcgggcccaggactgggtgaacgtccgttcggacgaccctgtcccctcacctgctactgtctcgtggtcgcctccatcagcagctagttacttacgtcgtgggctaggactccgaccgacggaccccggaggggacgggtcgtagggtaggtgggtaggttgggtaacgtttaacgtttaccgagtagggtacgggacacctaaccgtaaccgtaacccgtaaccccgttaccgtaacgaaaaacggttccggaacgtaccaaccgtaactaccgtaccgtaacgaaccgaaccgttaccaaaacgtaacccgtaacttcccgtacccgtaaggaacgtctaggaacgtccgttacggtacggtaccggacccggccgtaccggaaccggtacccgtaccgggttacttacggtttacctttaagtttaccggtgggttaaccggacccgggtaccccgggaccccgggtaggcccggttaacggttccgggtttacggttttccggtttttacgggaaccgttttcggttaacccgtttttagggaaaccggttttgggttacccgggggggttaacggaaacccgggtaaagggggtaaacccttaagggtttcccggggttaaccctacccgggttttaccccg

SEQ ID NO: 126977 - DNA, 457 bp, Homo sapiens
  misc_feature: GYAE6OF01BSUJY.48.59.F04.1.454.CMB.1.raw
  modified_base (437)..(457): a, c, t, g, unknown or other
  misc_feature (437)..(457): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgccttttgatatggtggggccaagggacaagtggtcaccgtctcttcagcctccaccaaggcccatccggtccttccccctggccaccctcctccaagacgccaccgtcggtcggggccacgcgccggtcccgtgggctcgccgtcggtacaacggtactaccttcctctctcgactcgtgacggcggtcgtcggcgacgggcgacgagtagnnnnnnnnnnnnnnnnnnnnn

SEQ ID NO: 126978 - DNA, 804 bp, Homo sapiens
  misc_feature: GYAE6OF01BL4KW.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcgacctgcactgtctctggtgctccatcagcagcagtacttacttctgggctggactccgccacggcccccgagggaacggggcgtggagtggagttgggtagttactttaccgacgtaggtcgggacgactaacccgttaacctaacccgtaaccccgtacccctaaccgtaaaacggttcccgaacgggaccaaccctaacgttaccgtacccggttaacggaaacccgtaacccggttaacccaaaaccggtaaaacccgtaaccttttacccgtaacccccttaaggtaaaccgtccgttaacggacgtaccgttccgttacggttacccggaccccgtaccccggaccgaacgggaacccgaccgggtaccgtttcggttaccttaacgtttaccgttgggttaccggacccgggtacccgggtaccccccggtaaggtcccgtaccgtacgggttcggtttaccgttttttcgggaactttccggttcccgttttaggtaacggtttacggtttacggggtacgggggtaacccgtaaacgggggtaaccgtaaacggttacgggttacccgttaacccggtttccccg

SEQ ID NO: 126979 - DNA, 657 bp, Homo sapiens
  misc_feature: GYAE6OF01CWPTD.48.59.F04.1.454.CMB.1.raw
tcagagtatacatacacgaccggtgctcgatttagtacacacacttggggattgggggctttctgagagtcatggatctcatgtgcaagaaaatgaagcacctgtggttcttcctcctgctggtggcggctcccagatgggtcctgtcccagctgcagctgcaggagtcgggccaggactggtgaagtccttcggacgaccctgtccctcacctgcactgtctcgtggtcgcctccatcagcagctacgtacttacttcgtgggcttggactccgaccacgcccccgaggggaagggcgtggaggtggtagttagggagtttacgttaccgaacgtaggtgggacgccgaacctactaaccaacccgtcctaacgaaacgtcgacggaccaaccatacgtaccgtacgaccaccgtaccaaacgaacctacttacctaccgtagaacgtcgtagacgtctcgtacgcggtacccgcgacgacgacgaccggtcttcgtaccttagttaacgtcggtacgaccggtaccggtcccgacgccgacgtacggttcggtttacgttttcggtacgtttcgttacccgtttagacgtttaacgttcgggtacgggaaccggtaaacgggaataacgggttccggtaccgtacccgtttaccg

SEQ ID NO: 126980 - DNA, 670 bp, Homo sapiens
  misc_feature: GYAE6OF01A4NHR.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactctgggctggatccgccacgcccccgagggacggggctggagtggagttgggagtatttaccacgaggtgggacgcaccctaacgtaaccaaaccccggtaccctacgtaaaacgtcggaacgcaaccatacgtaccggtacgaccgtaccgtaccgaaacgtaaccctaactttcctacccgttagaacgtctacggacgtcgttacgtgtaccgacccgacccgcgaacgaccgaccggtcttacgtccttaacgtttacgtcgtcggtaccggaccggcccccgaggccgaccgtaggttcggttcgttttttacgacgtttacggttccgttttaggtactttaacggtcgggttaccggggtaacccggtaaacggggtaacgtaaaggttcggttaccggttacccgttacccg

SEQ ID NO: 126981 - DNA, 723 bp, Homo sapiens
  misc_feature: GYAE6OF01CTQ60.48.59.F04.1.454.CMB.1.raw
  modified_base (661)..(661): a, c, t, g, unknown or other
  misc_feature (661)..(661): n is a, c, g, or t
tcagagtatacatacacgaccggtgctcgatttagtacacacacttagggattgggggcttttctgagagtcatggatctcatgtgcaagaaaatgaagcacctgtggttcttcctctgctggtgcgctcccagatgggtcctgtcccagctgcagctgcaggacgtcgggccaggactgggtagaagccgttcggacgaccctcgtccctcacctgctactgtctcgtggtcggtcctccgatcgagccagtacctagttaacttacgttcggtgggcttaggactcccgtccgaaccggtcccccggaagggggaacgggtcgtagggtacggtgggtaggttagggtaacgtttacgtttaccgaggtagggttcgggacgtcctaaccgttaccgaaccgtaacccccgtacgtaaacgtaaaacggtcggaacgacctaacgtaacgtacgttaccgaacgtaaccgtaaccggtaaacctaaaccgtaaccttaacgtttacccgacccgttaagaccgtacgtcggactccgtcgtacgtccggaccgtccgacgacgacgtcgtctaggttacttaagttcgtggaccggtccggaccggtcccgagtccgacggttacggttcggtttccttacgtactttcgtccgtttanacggtttcggacggtaacggggtaacaacgggtaactacggttccggtaactcccgttaccg

SEQ ID NO: 126982 - DNA, 657 bp, Homo sapiens
  misc_feature: GYAE6OF01ERII9.48.59.F04.1.454.CMB.1.raw
  modified_base (256)..(256): a, c, t, g, unknown or other
  misc_feature (256)..(256): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagcagtacttacttcgnggggctggactccgccacgcccccgagggacgggctggagtggtagttgggagttactttaccgacgtaggtgggacgacctaacctacctaacccgaaccccgtaccctaacgaaaacgtcggaacgccaacctatactccgtacgaccaccgtaccaaacgaacctaacttcctaccttagaacgcgtagacgtcctcgtgtaccgacccgtccgacgacgaaccgtacggtcttacgttccttaacgttactggtaccggccggtacccgggaccccgtaggccggtaccgtagggttcggtttcgtttttagacgtttccgtccgttttagacgttggttcgggtacggggaacccgtaaacgggtactaaggttccggttaccgtcccggtttccg

SEQ ID NO: 126983 - DNA, 437 bp, Homo sapiens
  misc_feature: GYAE6OF01CWNU8.48.59.F04.1.454.CMB.1.raw
  modified_base (327)..(327): a, c, t, g, unknown or other
  misc_feature (327)..(327): n is a, c, g, or t
  modified_base (420)..(437): a, c, t, g, unknown or other
  misc_feature (420)..(437): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggcaagggacaatggtcaccgtctcttcagcctccaccaagggcccatcggtcttccccctggcacccctcctccaagagcacctcgngggggcacacgcggcccctggggctcggcctggtcaaaggactacttcctaatgtatactctgacggtcgggctgggcaagggcgacgatagnnnnnnnnnnnnnnnnnn

SEQ ID NO: 126984 - DNA, 738 bp, Homo sapiens
  misc_feature: GYAE6OF01EA7KY.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtagaagtccttcggacgaccctgtccctcacctgcactgtctcgtggtcgctccatcagcagactagttacttacgttcgtgggctggactccgaccacgccccggaggggacgggctgggaggtaggtagttgggagttactttaccgacgtaggtgggacgacctaacctactaacccgaacccgtccgtaacgaaaacgtcgaacgaccaacagtactaccgtaacgacctaaccgtaaccaaacgtaaaccctaacgtttccctaacccgtagaacgtcgttacggtaacgtccttacgtacgaccggtacccggcccgtaacgaaccgaccggaccggttccttacggttactttaacgttacgtcggtacggacccgggtacccggtaccccggaagtccggtacgttaacgggttcggtttaccgttttttcgacggtttaccgttccgttttaaggtacgttacgggttacggggtaacccggggtaacccggtaaacggggtaaaccttaacgggtttccgggttaccgtaccccgggtttacccg

SEQ ID NO: 126985 - DNA, 625 bp, Homo sapiens
  misc_feature: GYAE6OF01ATRHN.48.59.F04.1.454.CMB.1.raw
  modified_base (380)..(380): a, c, t, g, unknown or other
  misc_feature (380)..(380): n is a, c, g, or t
  modified_base (427)..(427): a, c, t, g, unknown or other
  misc_feature (427)..(427): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaagagccaccttctcctgcaggtccagtcagagtcttaccaacgactacttagcctggtaccatcagaaacctggccaggctccaggctcctcatctacggtgcatccagcaggggccactggcactcccagacaggttcaggtggcaggtgggtctgggacagacttcactctcaccgtcagcagactcggacctgaagtnttttgactagttgttattacgtgtacgagctaaggttacgtgggtanccgtaccaaccggtactccgtacccgttccggacccgtaaacggggactaaccggaacgtacgggaaccgtaacgtttaaacccggaacgttacggtcggtcgtacggaccgtaacctacgttaccgttcggttaccttccgtaccgtttcccttacccccggaccttacttccgttagtaacttagttcgttaaccg

SEQ ID NO: 126986 - DNA, 585 bp, Homo sapiens
  misc_feature: GYAE6OF01C1N4X.48.59.F04.1.454.CMB.1.raw
  modified_base (368)..(368): a, c, t, g, unknown or other
  misc_feature (368)..(368): n is a, c, g, or t
  modified_base (414)..(414): a, c, t, g, unknown or other
  misc_feature (414)..(414): n is a, c, g, or t
tcagagtatacatacacgaccggtgctcgatttagtacacacacttagggattgggggctttctgagagtcatggatctcatgtgcaaagaaaatgaagcacctgtggttcttcctcctgctgggtggcggctcccagatgggtcctgtcccagctgcagctgcaggagtcgggcccaggactggtgaagccttcggacgaccctgtccctcacctgcactgtctctggtgctccatcagcagcagtacttacttcgtgggctgactccgcacgccccgagggaacgggctggagtggagtggagtatttaccacgagtggagcactactacaaccgtcctacaaaagtcgacgacaccatatcgtanacgacgtaccaacgaacctaacttcctcctagaacgctgacgctcncgtacgaccgccgcaacgacacgggtcttcgtactagttacgtcgtggaccgaccggaccccgagccgcgtacgttcgggttcttttcgaagttcgtacccgttttggacttaggttcggtacgggggtaaccgtaaagggaacctaaggtacgggtccctaccggttacc

SEQ ID NO: 126987 - DNA, 659 bp, Homo sapiens
  misc_feature: GYAE6OF01AMJ9X.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcgctcccagatgggtcctgtcccagctgcagctgcgaggagtcgggcccaggactgggtagaacgccttcggacgaccctgtccctcacctgcactgtctctggtgctccatcagcagcagtacttacgttcgtgggtctggactccgccacggccccgagggacgggcgtggagtggtagttagggagttacgttaccgacgtaggtgggacgaccaccgtaactaaccgaacccgtaccctacgaaaacgtcggaagaccacctagtacgtccgtaacgaccaccgttaccaaacgaacctacttccctacctagaacgtcgtacgacgtcctcgtcgtacggacccgccgacacggacgaccggtcttgtacttaacgttactcggtacggccggtaccggacccccgaggccgtcggtacgttggttccgtttttaggacgttcggtttccgtttaggaacgtttcggtcggggttacggggacccgtaaaagggtaccttaaggttccgggtaccgtcccgtttaccg

SEQ ID NO: 126988 - DNA, 710 bp, Homo sapiens
  misc_feature: GYAE6OF01CUNTD.48.59.F04.1.454.CMB.1.raw
  modified_base (179)..(179): a, c, t, g, unknown or other
  misc_feature (179)..(179): n is a, c, g, or t
  modified_base (190)..(190): a, c, t, g, unknown or other
  misc_feature (190)..(190): n is a, c, g, or t
tcagagtatacatacacgaccggtgctcgatttagtacacacacttagggattgggggaagacaatgggtttgattcagattacatgggtgacttttctgttgtatttccaatctcagatgccccggagaattgtgttgacgcagtctccagacaccctgtctttgtctccaggggaanagccaccttcncctgccaggtccagtcagacgtcttaccaacgactacttagcctggtaccatcagaaccgtgccaggctccaggctccctcatcgtacggtgcactccgacgcgacgggccacgtcggacactacccgagacgaggttccaggtggcgtaggtgggtacgtgggaacacggtacctttacaccgttcgtaccgtaccgttcgaacgtaccgaacgacggtaccgggtaccctagggtaaacgttacgtttttacgacgttaggttacgtttaacgtttacgttacggtacgtaacgtaccgtaggttacggttacgggtacgtacctcccgtaaccgtacgtaaccggtacccgttaccgggaacggtaacccgggaccgtaaccggtaacggtacgggtacgtaaccgttaaacccgagttaccgtcggaccttacgaccgtacctacttcgtaccgttcttaccgtaacttcccgtaccccgtactacctttcgtacgttaactcgttagttaacccg

SEQ ID NO: 126989 - DNA, 778 bp, Homo sapiens
  misc_feature: GYAE6OF01C2TAZ.48.59.F04.1.454.CMB.1.raw
tcagagtatacatacacgaccggtgctcgatttagtacacacacttagggattgggggctttctgagagtcatggatctcatgtgcaagaaaatgaagcacctgtgttcttcctctgctggtgcgctccagatggtcctgtcccagctgcagctgcaggagtcgggcccaggactggtgaaacgtccgtttacggacgaccccttgtaccccttcgaccgtgacctacttggtcctcgtgggtcggacctccgatccgaagcgaagctaagttacttacgttcgtgggtctaggactccggaccaccggccccgaaggggaacgggtcgtagggacgtaggtacgttagggaacgttaacgtttacccgaaggtacggttacgggaacgtaccgtaaccgttaaccgtaacccgtaacccggttacccgtaaagaaaaacggttccggaacggtacctaaccgtaacgttaaccgtaccggtaaacgacccgtaaaccggtaacccgtaaaaacgtaacccgttaaacgtttccccgttaaccgtaacggtaaacgtccgttaacgaccgtacgttccgtacggtacgacccgtaccgacgtaaccggacgtaccggtacttacggttaccttacgttaccgtaggtaccgaccgggtaccgtaccccggaagcccgtacgtaacggttcggttactttacggacgttcgttaccgtttagaacgttgttcgggaacggtacgtaaacggactaacggtcgtacccgtacggtttccg

SEQ ID NO: 126990 - DNA, 637 bp, Homo sapiens
  misc_feature: GYAE6OF01B0TPB.48.59.F04.1.454.CMB.1.raw
  modified_base (576)..(576): a, c, t, g, unknown or other
  misc_feature (576)..(576): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggacgtccgggcccagggactgggtgaacgtccttcggacgaccctgtccctcacctgctactgtctcgtggtcgctccatcagcagctacgttacttacgtcgtggggctggactcccgccaccggccccggaggggaacgggcgtgggaggtggtagttgggtagttacgtttaccgacgtaggtcgggacgtacaaccgtacctaaccgaaccccgtcctaacgaaaacggtcgaacggaccaacagtacgtaccgtacgacctaccgtaaccaaacgtaacctaacttccgtaccgtagaacgtctagacgtcctacgtcgtacgaccgtccgacgacgaccgacgtctacgtctacttcgtgtacgccggaccggaccccgagcgtacgtaggttcgttcgtttacgnttcgtcgttagagttcggtgggtacgggacgtaacggactaaggtcggtaccgtcgttacg

SEQ ID NO: 126991 - DNA, 634 bp, Homo sapiens
  misc_feature: GYAE6OF01BZ7WV.48.59.F04.1.454.CMB.1.raw
  modified_base (328)..(328): a, c, t, g, unknown or other
  misc_feature (328)..(328): n is a, c, g, or t
tcagagtatacatacacgaccggtgctcgatttagtacacacacttagggattgggggctttctgagagtcatggatctcatgtgcaagaaaatgaagcacctgtggttcttcctctgctggtggcggctcccagatgggtcctgtcccagctgcagctgcaggagtcgggcccaggactggtgaacgccttcggacaccctgtccctcacctgccactgtctctggtcggcctccatcagcagcagtacttactcgtgggctggactccgccacgccccgagggacgggcgtggagtggtagttgggagttacttacgagagtgganacctacctactaccaccgtcctacgaaagtcgacgcaccatacgtcgtacgactacgtaccaaacgaacctaacttcctaccctagaacgcgtacggactcttacgtcgtaccggacccgtccgacgacgaccgacggtcttcggtacttacttacgtcgtacggaccgggaccggcccgaagccggtacgtacggttcggtttccgtttttaggacgtttcgttcccgtttaggtacgttcggtcggggttacgggaaccgtaacgggtacttaaacgggtccggttaacccgtccggttacccg

SEQ ID NO: 126992 - DNA, 840 bp, Homo sapiens
  misc_feature: GYAE6OF01DDMHF.48.59.F04.1.454.CMB.1.raw
  modified_base (774)..(774): a, c, t, g, unknown or other
  misc_feature (774)..(774): n is a, c, g, or t
tcagagtatacatacacgaccggtgctcgatttagtacacacacttagggattggggagagctgctcagttaggacccagagggaaccatcggaaaccccagcgcagcttctcttcctcctgctactctggcctcccagatcgccccggagtaattgtgttgacgcagtcctaccacgacctaccctgttctttcgtcctaccggaaggggaaacgcgaccctacctttcctccgtacggaccgtacggtccctaggtacgtacggtacgttaccttaaccgaaaccggtacctttaaccgttaaccggtcccgttacgggttaaccctaacgttaccgaaccggtaaacccggtcggaccccgacgggtcccctacccgtaccggtcccttacccgtacctacgttaccggtacggttcgaccgtacctcccgacggaccggaccgggccaacggttccggacctacctaccccgaagtaccgtacggtttacgacggtcggacgttagggtacgggttcgacgggtactacggttccttacgtaccttcgtaccgccgtacgacgacgtacgtaccgtacgtacccgtaagtagttcgtttacggacgtttaggttattaaccgttacgtggtaccgtacgtacggttaagttaggttccggtaacgtacccttccgtaaacccgttacgtaccccgttaaccggtaaccgggaaccgtaaaccggggtacctaacggtaacggtaccggtaacgttaaacgttaacccggngttacgggtacgccgtaccgactacccggttattacccgttagtacctttacccgtccgttcccgg

SEQ ID NO: 126993 - DNA, 634 bp, Homo sapiens
  misc_feature: GYAE6OF01ATNE9.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccttcggagaccctgtccctcacctgcactgtctcgtggtggctccatccagcagcagtacttacttcgtgggctggactccgccacgcccccgagggaacgggctgggagtggagttgggagtatttaccgacgaggtcgggagcacctactaccaacccgtcctactaaaacgtcgacggacaccgaatacgtaccgtaagacgtaacgtaccaaacgtaacctaactttccctacccgtaggaaacgtcgttaggaacgtccttaccgttacggtaccgacccggtaccgacgaacgaccgtacgggcttacgttactacgttacgtcggacgacggtacggccccgaggcgacgtagttggttactttttgacgttcgtcctttagacgtgtacgggtacgggacgtaaacgggtataacgttcggtaccgtccgttaccg

SEQ ID NO: 126994 - DNA, 578 bp, Homo sapiens
  misc_feature: GYAE6OF01BVRSX.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccgaggggaaagagcccaccttctcctgcaggtccagtcagagtcttaaccaacgactacttagcctggtaccatcagaacctggccaggcctcccaggcctcctcactcgtacgtgcatccagcgacgggccactggcactcccagacaggttcagtggcgagtcgggtctgggacagacttcactctccacgtcagcagacctcggaccctgaagtatttcgcgtagtgttattactgtctagtctagtagtgtacgcctcgaccgactcctaccgttccggaccgtaacgggaccacgacggttaggaagtaaccgttaaccggtaacgtggtacgcgtacgccaccgtatcgttgttcttacctcttcccgttcccgtacctctccgtagtacttgtgttaac

SEQ ID NO: 126995 - DNA, 1061 bp, Homo sapiens
  misc_feature: GYAE6OF01EALMD.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtccgggcccaggactggtagagtccgttcggacgaccctgtccctcaccgtgcactgtctcgtggtcgctcatcacgcagactagttaccttacgttcgtgggtctacggtactcccgaccgaccggaccccccggaagggggtaacggggtcgtacggggtagggtaggtaacggtttaggggttaactttaaccgttttaacccgaacgggtaacgggttacgggggtaacgtcccgttaaacccgttaaccccgttaaaccccgtaaaccccccggttaaccccgtaaaccgtaaaaaccgggtacccggaacgggaccctaaacccgtaacgttaaccgttacccggtaacggaaacccgtaaacccggtaacccgtaaaaccgtaaaaacccgttaaccgttttacccgtaacccccggttaaggaaaccgggttactacgggtaaacccgttcccgttaccggtttaaccgggaccccggttaaccccgggaccccggtaacccggtaacccggtaaaccccgggtaccgggtttaacccgtttaccgggtttaacccgtttttaaacgtttaacccgggtttcccggggttaaccgggttaacccccgggggaacccccgggggttaccccccggggtaacgggtccccggtttaacccggggttaaacggggtttttaccccggggttttttaaccggtttttttaaccgggtacccggtttttaaccgggtttaaccccgggttttttaagggttaaacccgggttttacccggggtttacggggggtttaccccgggggaaaccccgggtttaaaacggggaaacccggttttaacggggttaccccggggtttacccccgttaacccccggtttttaccccgg

SEQ ID NO: 126996 - DNA, 725 bp, Homo sapiens
  misc_feature: GYAE6OF01CKSP6.48.59.F04.1.454.CMB.1.raw
  modified_base (623)..(623): a, c, t, g, unknown or other
  misc_feature (623)..(623): n is a, c, g, or t
tcagagtatacatacacgaccggtgctcgatttagtacacacacttagggattgggggctttctgagagtcatggatctcatgtgcaagaaaatgaagcacctgtgttcttcctcctgctggtgcggctccagatgggtcctgtcccagctgcagctgcaggagtccggccaggactggtcgaacgtccgttacggacgtaccctcgtcccctcgaccttggaccacgttcgttctcgtcggtcggtccttaccgatcgagctagctacgttacctttacgttcgtcggggtcttggaactcccggaccaccggcccccggaaggggaacgggtcgtagggtagttcggtaagttcgggaacgtttaacgtttaccgacgtagggttacgggacctaccgtaaccgttaaccgtaaacccgtaccccgttaccgtaaacgtaaaacggtcccggaacggaccctaaccgtagttacgtaccggaacgtaccgtaaccgtaccgaaaacgtaacctaccttccgacccgtaaggaacgtcgtacgtacgtcgtacgtacggtccggcccgtacgacgaaccgtcgacgtcgtacgtactagtccgtgcgaccgtaccgacccgngtacctcgtaacggttcgttactttacgacgttcgttacgttacgtagttcgtcgggtacgggaacgtaacggtacgtagttacccgtcgaaccggtttccg

SEQ ID NO: 126997 - DNA, 761 bp, Homo sapiens
  misc_feature: GYAE6OF01BV2DP.48.59.F04.1.454.CMB.1.raw
  modified_base (320)..(320): a, c, t, g, unknown or other
  misc_feature (320)..(320): n is a, c, g, or t
tcagagtatacatacacgaccggtgctcgatttagtacacacacttagggattgggggaagacaatgggtttgattcagattacatgggtgacttttctgttgtatttccaatctcagatgccccggagaaattgtgttgacgcagtctccagacaccctgtctttgtctccgaggggaaagagccaccttctcctgcaggtccagtcagagtctaccaacgactacttagcctggtaccatcagaaacctggccaggcctccgggctcctcatcgtacggtcgctatccgagcgacggccacgtggcactccgagacgnggttcaggtggcgaggtcgggtcgtgggacacgtacgttccactcctaccgtaccgcgtacgcgacgtaccgtacggtaacccgtaggtaaacgttagttttcggacgtacggttacgttacgtttaccgttcggttaccgtaggtaccgttaagggttaagttacgggttacgtacccgttaccgtaaacccggtcttaacccgtaaccccgggtttcccgggaaacccggttaaacggggaacccgtaaccggtaacggtacggggtaaacgttaaacccggttaaacccggtaacggttcgggtaccggtaccgtaccggaccgtaacccgttacgttccggtttaccgttcctttaccgttaccgtttcccccgttaccccgtaccgttacgtttacccgttaggttaaccctttagtttacccgttagttaacccg

SEQ ID NO: 126998 - DNA, 757 bp, Homo sapiens
  misc_feature: GYAE6OF01ANFQA.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactgggtgaagccttcgggagaccctgtccctcacctgcactgtctctggtggctccatcagcagctagtacttacttcgtggggctggactccgccacgcccccgagggacggggcgtggagtggtagttgggaagttactttaccgacgaggtggggagccgtaccgtacctaccgaaccccgtaccctacgaaaacgtccggacggccaaccgtactacgtaccgtacgactaccgtaccaaacgaacctaactttccgtaccctaggtaaacgtccgtagacgtcgttaccgtcggtacccggacccggccccggtacgaaccggtaccgtacccgggtaccgttcggttaacctttaacgtttaaccggttcggtaccgggtacccgggtaaacccggggtcccccggaacgggtcccggaccgttaaccggggtttcggtttaccgtttttttaggacgtttacgggtttacccgtttttaggtaacggtttcgttacggggttaaccggggggtaccccgttaaaggggaccgttaaacgggttccgggttacccgtacccgggtttccccg

SEQ ID NO: 126999 - DNA, 418 bp, Homo sapiens
  misc_feature: GYAE6OF01ENKKA.48.59.F04.1.454.CMB.1.raw
  modified_base (404)..(404): a, c, t, g, unknown or other
  misc_feature (404)..(404): n is a, c, g, or t
  modified_base (411)..(418): a, c, t, g, unknown or other
  misc_feature (411)..(418): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggccccgagcgcagtggtcttttgatgcctttgatatggtggggccaagggacaatggtcaccgtctcttcagcctccaccaagggcccatcggtctccccctggcaccctcctccaagcgccacctcgtcgggggcacaggcggccctgggctgcctggtcaaggactacgttccatgtatctctgagcgggctggcaagggcncagtagnnnnnnnn

SEQ ID NO: 127000 - DNA, 626 bp, Homo sapiens
  misc_feature: GYAE6OF01C50LJ.48.59.F04.1.454.CMB.1.raw
  modified_base (321)..(321): a, c, t, g, unknown or other
  misc_feature (321)..(321): n is a, c, g, or t
  modified_base (594)..(594): a, c, t, g, unknown or other
  misc_feature (594)..(594): n is a, c, g, or t
  modified_base (596)..(626): a, c, t, g, unknown or other
  misc_feature (596)..(626): n is a, c, g, or t
tcagagtatacatacacgaccggtgctcgatttagtacacacacttagggattgggagtatttaccacagtgggagcacctactacaacccgtccctcaaaaagtcgaggcaccatactccgtagacaccgtaccaacgaaacctattcctcctagaagctgagtcctctgtcgacccgccgacacgaccgacggtcttcgtacttaattacgtggtcgaccgggaccggccccgagccgacgtggtcggttctttttgactcgttcctttagattagtgggtacgggaccgaagggaactaagtcggtacctacccgttnttcttcgaccgtccctaccaaccggaaccgggccctagttcccggttcccccttcccccgtcggaccccctaccccttaccccgtaaccgaaaaggccgtaccctacccgttcggggtcgggggaccaaccggacggccccgggtcccgtgggccgttacgacggttacggtaaccgaaacggttaccttaacccgtttccgtaagttacgttaactaccgttcgtaggtacgggtccggtcgtacggaacggtacgggacccagtaacgtgntnnnnnnnnnnnnnnnnnnnnnnnnnnnnnnn

SEQ ID NO: 127001 - DNA, 782 bp, Homo sapiens
  misc_feature: GYAE6OF01DEM3U.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcgaggacggtccgggcccagggactgggtagaacgtcccgttacggacgtacccctgtcccctcacctgctactgtcctcgtggtcgctccatcagcagctagttaccttacgtcgtgggtctcggactcccgccgaccggacccccggaggggacggggtcgtagggtaggtcggttaggttagggtaacgtttacgtttaaccgacggtaagggtcgggaacgaccctaacccttaaccgtaacccgtaaccccgttaccctaaacgtaaaacggtccggaacgtacctaaccaacgttacgtacccgtacgaaccgaccgttaacccaaacggtaacctacgttacccgtacccgtaaggtaaacgtccgtacggtacgtccgttacgttacggacccggtacccggaccgaccgaacgaccgtacggttcttcgttacttaacgtttacgcgttacggaccgggtacccggccccgaggtccgtacggtacggtttcgggttttcgtttacggtacgtttcccgttacggtttagtaaggtttacggtccgggggtaaccggggtaccgtaaaagggggtaccttaagggttaccggccccgtttaccggtttcccg

SEQ ID NO: 127002 - DNA, 585 bp, Homo sapiens
  misc_feature: GYAE6OF01BTBMD.48.59.F04.1.454.CMB.1.raw
  modified_base (343)..(343): a, c, t, g, unknown or other
  misc_feature (343)..(343): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (478)..(478): a, c, t, g, unknown or other
  misc_feature (478)..(478): n is a, c, g, or t
tcagagtatacatacacgaccggtgctcgattttagtacacacacttagggattggggagtatttaccacagtgggagcacctactacaacccgtccctcaaaagtcgaggcaccgatatccgtagacacgtccaagaaccaattctccctgaagctgagctctgtgaccgccgcagacacggctgtctattactgtgcgagcccgagcgcagtggctttttgatgcctttgatatggtcgggccaagggacaatcggtcaccgtctcttcagcctccacgaacggccatcggtccttccccgtgccaccctctaccgaagcgcaccgtcggtcggggcacgngcggtccgtggctcgccgtggtacgaagccttacttctatgtatccgtcgtgacggtcggcgttcgggacgtaacgggtccgacgtaccgttagggntacgngacgtgaancggtacncgtcgacacgacgacgngtaccgtcgacgcgacgtcgtcgtagtacgacgacgtacgtacgtacgtacgtacgtacgtcgtagacggcgcgacgtacgtacgtacgacgaccgtcgtacgtacg

SEQ ID NO: 127003 - DNA, 703 bp, Homo sapiens
  misc_feature: GYAE6OF01C2N0Q.48.59.F04.1.454.CMB.1.raw
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccagggaaanagccaccttcncctgcaggtccagtcagagtctaccaacgactactagcctggtaccatcagaaacctgccaggctccaggctctcatctacgtcgcatccagcacgggccacgtcggacactcccagacgtaggttaccgaggttcggcgagtgggtcgttacgggacacgtccttacgactctaccacccgtcacgacgtacgaccgtcggaccccgtagtaaaccgtagttttcggacgtaagttagttaacgtttactaggttaccaaggtacgtaacgttagtacggtaacgtccgtaccgtaacccggtactaccgtacccgtttaccgggaccgtaaacgggtacccaacggtaaccgtacggtaacggttacttaaaccggtaaccgtacggtacggacgttacgacccgtaacgtaccgttacgtacgtttacctttacccgttaacctttcccccggttaaccccgtccgttaaaccgttcttaaccggttattaacgttcggtttaaaccg

SEQ ID NO: 127004 - DNA, 647 bp, Homo sapiens
  misc_feature: GYAE6OF01EAYE7.48.59.F04.1.454.CMB.1.raw
  modified_base (139)..(139): a, c, t, g, unknown or other
  misc_feature (139)..(139): n is a, c, g, or t
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
  modified_base (506)..(506): a, c, t, g, unknown or other
  misc_feature (506)..(506): n is a, c, g, or t
tcagagtatacatacacgaccggtgctcgatttagtacacacacttagggattggggggcttttctgagagtcatggatctcatgtgcaagaaaatgaagcacctgtggttccttcctcctgctggtggcggctccagntgggtcctgtcccagctgcagctgcaggacgtcgggcccaggactgggtgaacgccttcgggataccctgtccctcacctgcacttgtctcgtggtcggcctccatcagcagctacgttacttacgttcgtcggggctgactccgaccgaccgccccgaggggacgggtcgngggaggtgggtagttggggagttacgttaccgacgaggtgggacnctacctactaccacccgtacctacgaaacgtcgacggaccaactactacgtaccgtagaccgacggtaaccaaacgtaaccctacttacctacccgtagaacgtcgtacgacttctacgttgtccgaccgtccgacacgaccgaccggtntcgttaacgttacttacgtggcgaccgggaccgcccggagccgtcgtaggttcggttacttttggacttggttcctttagagtttcggttaggggacgggtaccgtaaagggtacttaagggttcgtaccgtacccggttc

SEQ ID NO: 127005 - DNA, 887 bp, Homo sapiens
  misc_feature: GYAE6OF01DVMVA.48.59.F04.1.454.CMB.1.raw
  modified_base (180)..(180): a, c, t, g, unknown or other
  misc_feature (180)..(180): n is a, c, g, or t
tcagagtatacatacacgaccggtgctcgatttagtacacacacttagggattggggggaagacaatgggtttgattcagattacatgggtgacttttctgttgtatttccaatctcagatgcccccggagaaattgtgttgacgcagtctcagacacctgtcttgtctccgaggggaanagccacttctctcgcacggtccagtcagtacgttccttaaccaacgacttactacgcctacgtacatcaacgaaacctcggaccacggtcctaccgacggccttccctacacgttaccggtaccgggtcgacctacgtacccgaaggaccgacgggggtaccccaacggttcgggaccaaccgttacccccgaaggtaaccggtaccgggtttacgtaagggttcggggccgttaaggggtttcggggttaccggggttacggggaacctaggttaacccttccgtaacctccgttaaccgtaacccggtacgaacggaccgtaacggtaccggtacggtaacccgtaaggtaaagtttacgttttacgacgttaggttacgttactttacgtacgtactacggtacgttaaggtacggttacggtaccgtacctaaccgtaacccgtaccgtttaccgtacccgggtttaccgggaaccccgggttaaagggaaccccgttaaccgggtaaaccggttacgggtaaaccgtaaaccggtttaaaaccccggacggtttccgggtacgttaccggacccgtacctaaacccgttacggtttcccgttacggtttaccccttttaccgaacgttttccccccggttacccccggttactttaaccggttccttaaccggttttaataccgggttaatttaaaccccgg

SEQ ID NO: 127006 - DNA, 727 bp, Homo sapiens
  misc_feature: GYAE6OF01A6E9H.48.59.F04.1.454.CMB.1.raw
  modified_base (489)..(489): a, c, t, g, unknown or other
  misc_feature (489)..(489): n is a, c, g, or t
tcagagtatacatacacgaccggtgctcgatttagtacacacacttagggattgggggaagacaatgggtttgattcagattacatgggtgacttttctgttgttatttccaatctcagatgcccccggagaaattgtgttgacgcagtctccagacaccctgtctttgtctccgagggaaagacgccaccttctcctgcgagtccagtcagacgtcttaccgaacgactacttagcctggtaccatcagaaccgtgccaggcctccgaggcctccgtcactcgtacggtcactactccgacgtcgacggacccacgttcggacaccgttaccccgaaggtaaccgtcgggttaccgtaaggttacggccgtaagggtcgggggttaccgtgggggaaaccctaggtacctttaccgacgttccctaacggacccgtcgaacggtcgaacggtaccgtaccgggtaaacccgtaggtaaaccggttttnttacgggaacgttacggttacgttacgtttaccgtgttaccgtacgtacgtaagtacgttacggtacgtaccgtaccgtaccgtacgtacccgtaccggtaccggtaccgaacggtaccacggtacgtacggaacgttaacgttaacccgagtacggtcgaccgtcgtacctacgtccgttcgttccgttacgtctaccgttacccgttcccgactcttacgtatacttagtcgttac

SEQ ID NO: 127007 - DNA, 775 bp, Homo sapiens
  misc_feature: GYAE6OF01EWNKU.48.59.F04.1.454.CMB.1.raw
tcagagtatacatacacgaccggtgctcgatttagtacacacacttagggattgggggctttctgagagtcatggatctcatgtgacaagaaaatgaagcacctgtggttcttcctcctgctggtgcggctccagatgggtcctgtcccagctgcagctgcgaggacgtccgggcccagggacgttgggtagaacgtcccgttacgggacgtaccccttcggtcccctcacctgacctacttgtcctacgtgggtcgcctaccgactcgagaccgagtacctacgttacgtttaccgttcggtagggtccgtacggacctcccggaccacccggaccccggaagggggtaccgggcggtaggggacggttagggtacggttacgggttaacgtttacgtttaacccggaaggtacgggtaacgggtacgtaaccttaccttaaccctaacccgtaaccccgttacccgtaaacgtaaaacggtcccggtacggaaccaccgtaacgttacgtacccggtacgaacccgtaacgtaaccgaaaccgtaaccttaaccgttcccgtaccgtaagtaccgtacgtagtacctacgttacgtacggtaccgacccggtcgaacgacggtaccgtaccggttctgttaccttgtaccgttcggaccggcggacccggaccgtacgggtctacggtaggtttcgttcgtttgacgtttcgtcgtttagacgttgggtcgtacggggaactaacggacgttaggttccggacgttccgttcg

SEQ ID NO: 127008 - DNA, 455 bp, Homo sapiens
  misc_feature: GYAE6OF01CL714.48.59.F04.1.454.CMB.1.raw
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (437)..(455): a, c, t, g, unknown or other
  misc_feature (437)..(455): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctcctgaagctgagctctgtgaccgccgcagacacggctgtctattactgtgcgaggccccgagcgcagtggctttttgatgtcctttgattatggtggggccaagggacaagtggtcaccgtctcttcagtcctcaacgaacgggcccatccggtctcccccgtggccctacccgtcctccgaagcgcctaccgtcggtgggggccacgagcccggcctgggctcgcgttggacaggactacgttcctctactcgactcgtcgacgccgggtntggcaacgggcganacgtagnnnnnnnnnnnnnnnnnnn

SEQ ID NO: 127009 - DNA, 715 bp, Homo sapiens
  misc_feature: GYAE6OF01BJDZA.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactgggtgaacgccttcggacgaccctcgtccctcacctgctactgtcctcgtggtcgcctcatcagcagctagttacttacgttcgtggggtctggactcccgccgaccggccccggaaggggacgggcgtggggaggttgggtacgtttaggggtaagttaccgtttaccgaacggtagggtacgggaacgtacctaacccttaaccgtaacccgtaaccccgtacccgtaacggtaaaacggtcggaacggaccaccgtaacttacgtaccgtacgaaccgtaccgtaacccaaacgtaacctacgttacctacctacgaacgtcgtagtacgtctcgtcggtacccgacccggtccgacgtaacggccgtacggtccttacgttacttacgttacgtcggtccggccgggtaacccggtcccggacgccggtacgtacggttcggttcgttttagcgtttcgttcgtttaggacgttggttcgggtacgggtaaccgtaacgggtacttaaggtccggttacctccggttccg

SEQ ID NO: 127010 - DNA, 692 bp, Homo sapiens
  misc_feature: GYAE6OF01CBL8Y.48.59.F04.1.454.CMB.1.raw
  modified_base (159)..(159): a, c, t, g, unknown or other
  misc_feature (159)..(159): n is a, c, g, or t
  modified_base (541)..(541): a, c, t, g, unknown or other
  misc_feature (541)..(541): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagagtcgggtcctgtcccagctgcngctgcaggacgtcgggcccaggactggtgaacgccgttcggacgtaccctgtaccctcaccgtgctacgtgttctcgtggtcgctaccatcgagcatcctagttacttacgtcgtcggggcttaggactcccggaccgaccggacccccggaagggggaacgggtcgagggaggtgggtagttagggtacgttacttacgacgtacggtagggacaccctaactaaccgaacctaacccgtacctaacgaaaacgtcggaacgactaccactactaccgtaagacctaacgtaaccaaacgtaaacctaacttaccgtacccgtagaacgacgtagtacgtcttacgtcggtaacgcccgccgacgaacgacgtaccgtacngtttacctacttacgtgtacggacgggcccggtacccggagaccggcgtacggttcgggttactttcggactcggttcgtttaagagttacgggtcgggtaccgggtacggtaaacggtaacgttaggtaaccgttccgtacccgttaccg

SEQ ID NO: 127011 - DNA, 733 bp, Homo sapiens
  misc_feature: GYAE6OF01B24RN.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctcatcagcagcagtacttactcgtgggctggactccgccacgccccgagggagggcgtggagtggagttgggagtactttacgacgtaggtgggacgcacctacctaaccaacccgtcctacaaaacgtcgacggcaaccatactaccgtagacctaacgtacccaaagtaaccctaatttcctaccccgtagaaacgtcgtacggacgtacttaccgtcggtaccggaccccgtccggacgaaccggtaaccgtaaccgggtcctttacgggttaacctttacggtttaaaccgttgggttccggacccgggttaaccgggacccccgggtacgggcccgtaccggttaacggggtttcggttttaccgttttttacgggaaaccgtttccggtttacccggttttagttaacggtttagggttaccgggggttacgggggaacccgtaaaacgggggtaacttaaccgggttcgggttaaccccggtaacccggtttcccg

SEQ ID NO: 127012 - DNA, 785 bp, Homo sapiens
  misc_feature: GYAE6OF01CWWKX.48.59.F04.1.454.CMB.1.raw
tcagagtatacatacacgaccggtgctcgatttagtacacacacttagggattgggggctttctgagagtcatggatctcatgtgcaagaaaatgaagcacctgtgttcttcctcctgctggtggcggctccagatgggtcctgtcccagctgcagctgcaggagtccgggcccaggacttgggtacgaacgtcccgtttacgggacgtaccccgtcgttcccctaccgtacctggcctacgttcgttccgtcgtgggtcgcctacctatcacgcgacgtacctacgtttacttttaccgttcggtcggggtctacgggtaccttccccggacccgtaacccggcccccgggtaagggggaacggggtccggttagggaacgggttacggtaaggtttacggggtaacgtttaccgttttaacccggaggttacgggttaggaaccgtacccgtaaaccctaacccgtaacccgtaaccccgttaccgaaacgtaaaacgtccggacgtaccctaactactacggtaccggtacgaaccgtaaccgtaacccgaaagtaaaccctcgttcccaccggtagacgtgtacgtacgtctagtaccgaccgtcccggaccgtacgaccgtaacgtccggtcttaggtacttacgtttagccggtaccgaccgggtacccgccgtacgccgtagtcggttggtttacctttaggacttcggttctagttaaggttcggttcgggaaacgggacgtaaacggtacttacgggtcgtacccgtggtttaccc

SEQ ID NO: 127013 - DNA, 553 bp, Homo sapiens
  misc_feature: GYAE6OF01BZ5F2.48.59.F04.1.454.CMB.1.raw
  modified_base (182)..(182): a, c, t, g, unknown or other
  misc_feature (182)..(182): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaangccaccttctcctgcaggtccagtcagagtctaccaacgactacttagcctggtaccatcaagaaacctggccaggctccaggctcctcatctacggtgcactccagcagggccacgtgcactcccgagacaggttcagtggcaggtgggtcgtgggacagtactcgactctcaccgtcngcagctcgaccctgaatntttcgctagtntatactgtcagctagtagtgtagtctcaccgtctctaccgtcgaccgaacggacgacgacgtaggataacgtaaccgacgtggtacgcacgacaccgagttccgtcgttccttacctaccgttcccgtcccgtaccctacttctaagtcttagtcgttaacg

SEQ ID NO: 127014 - DNA, 816 bp, Homo sapiens
  misc_feature: GYAE6OF01BS9A0.48.59.F04.1.454.CMB.1.raw
tcagagtatacatacacgaccggtgctcgatttagtacacacacttagggattgggggctttctgagagtcatggatctcatgtgacaagaaaatgaagcactgtgttcttcctctgctggtgcggctcccagagtcggtcctgtcccagctgcagctgcagggacgtccgggcccaaggacgtggtacgaacgtcccgtttacggacgaccccttcggtacccctcaaccgtcgacctcgtgttcctcgttggtacgcctcatcgagcagcgtaagtacttacgttcggtggtcgtacgacgtccgaccgaccggaccccggaagggacgggcgtaggaggtggagttagggtaacttacgttaaccgacgtagggtaggtacgtacctaaccgtaaccgtaaccgtaacccgtaccgtaaacgaaacgggccgtaaccggacctaaaccgtagttaaccgacccgttaagacccgtaaacccgttaacccgaaaacgtaacccgttaacctttaccgtaacccgttaggaaagttcccgtaagtaaccggtacttaccgttacggtaccggaaccccgtacccggaccgtaaaggacccgtaccgggtactttcgtaacctttaacggttaccgtcgttccggaaccgtaccgggcccccgttagacccggtctaacgggtttcgttacggttttacgtaacgttccgggttaccgtttaagggtatttaaccggggtacgggttaaccgggggaaacccgtaaaaggggtaacgttaaaccgggttcgtaacccgtaacccccggtttaaccg

SEQ ID NO: 127015 - DNA, 745 bp, Homo sapiens
  misc_feature: GYAE6OF01C393C.48.59.F04.1.454.CMB.1.raw
  modified_base (543)..(543): a, c, t, g, unknown or other
  misc_feature (543)..(543): n is a, c, g, or t
tcagagtatacatacacgaccggtgctcgatttagtacacacacttagggattgggggctttctgagagtcatggatctcatgtgcaagaaaatgaagcacctgtgttcttcctcctgctggtggcggctcccagatgggtcctgtcccagctgcagctgcgaggagtccgggcccaggactgggtgaacgccttcggacgtaccctgtcccctcacctgcctactcgtctcgtggtcgcctccatcagccagctacgttacttacgttcggtcggggactcggacctcccgacccgaccggcccccggaaggggacgggcgtaggaggtggtaagttgggaagttacttaacgacgtaggtcgggacgtaccgtaaccgtaccgtaacccgtaaaccccgtcccgtaacgaaaacgtcggaacggaccaacctaagtaccttaccggtaacgacctaaccgtaccaaaacgtaaccttacgttacccgtaccgtaacggaacgtccgtagtaacggttccttcggtacggtcccggaacccnccggtaccgaaacggtaacgtaacggttcgtacgttaactttacggttacctgggtacggtacccgggaccgcccggagtccgtacggttacggttcggttattttcggacgtttcgttccgtttaaggacgtttcgggtacggggttaaccgggaaccggtaaacgggaaccgttaggtacccggttcgtacccgttaccg

SEQ ID NO: 127016 - DNA, 713 bp, Homo sapiens
  misc_feature: GYAE6OF01DY3GP.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtccgggcccaggactgggtgaacgccttcggagacccctgtcccctcacctgccactgtctcgtggtcgctccatcagcagcagtacttacttcgtgggcctggactccgccacgcccccgaggggaacgggtctagggaggtggacgttgggagttactttaccgacgtaggttggagccaacctactaccgacccgtccacaaagtcgacggcaacatacgtccgtagacacgtaccgaaacgaacctaacttcctaccctaggaaacgtccgttacggaacgtccgttaccgttcggttccggaaccccggtcccggaaccgtaacgggtaacccgtaacccggggttcttaccggttttaccgttaacgttttacccgtagggttccgggaacccgggtacccggggtaccccccgagggtcccggtaccgtagggttccgttacgttttttacggacgtttcgtacccgttttagacgtttacggtgggtaccggggaccggtaaagggtaccgtagttacgggtccctaccgggttaccc

SEQ ID NO: 127017 - DNA, 801 bp, Homo sapiens
  misc_feature: GYAE6OF01DDGVC.48.59.F04.1.454.CMB.1.raw
  modified_base (768)..(768): a, c, t, g, unknown or other
  misc_feature (768)..(768): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctccagagtcgggtcctgtacccaacgtgcagctgcaggacggtccgggcccaggacgtgggtacgaacggtcccgttacgggaaccgtaccccttccgtcccctaccaccctgcctaccgttcgtcctgtcggtcgtcctacctagtcaacgcacgtacctaacgttacctttacgttcggtcgggtctaggccgtacccgacccgaccggacccccgggaagggggaacgggtcgtaggggtaggtagggtacggtttacggggtaacgtttaacgttaaccggtacggtagggtacgggtaacctacctaaccgtaacccgtaacccgtaaccccgtaccgtaaacggtaaacggtcgaacggtaccacgtaactacgtaaccgaacgacccgtaaccgaaccgaaaccgtaaactaccgttcccgtacgaacggacgtaccgtaggactccgttcgtacggtaccgacccggaccgacgtaacgaccgtacgtctttacggttctaacgtttcgtcgggtaccggaccgggtacccgtacccgggacgtggtaccgttcggttcgtttcttttacgggcttccggttacgtttgtaaccggtttgggtccgggtaaccgggtacggaaacggttntaacggttccggttaccctacgttcgtaacccg

SEQ ID NO: 127018 - DNA, 797 bp, Homo sapiens
  misc_feature: GYAE6OF01EVJEK.48.59.F04.1.454.CMB.1.raw
tcagagtatacatacacgaccggtgctcgatttagtacacacacttagggattgggggcttttctgagagtcatggatctcatgtgcaaagaaaatgaagcactgtggttcttcctctgctggtggcggctccagagtgggtcctgtcccagctgcagctgcaggacgtcgggcccaggtacgtggtagacgtccgttacgggacgacccttcgtccctcaccgtgcctacttcgttcctcgttcggtcgtcctaccagtcgagcagctacgttaccttacgtcggtgggtctacggactacccggaccgaccggaccccgggaagggggtacgggccgttaggggacggttagggtacggttacggggttaacgttaacctttaccggacggtacgggtacgggactaaccgtaaccccgttaacctaaacccgtaaccccggttaccctaaacgtaaaacggtcggaaacggacctaacgtaacgtaccgtaccggtaacgaccgtaaccgtaaccgaaacgtaaaccttacgttaccctacccgtaaggactcgtacgtacgtacgttcgtacggtaccgacccggaccgacgaaccgacccgttacggtcttacggttaccttaacggtttacgtcggacggtacccgggaccgggacccggttaggaccgttacggttggttaccggttttacgtttcgtacgtttcggtttaccttaggtaacgtttcggggttacgggtaccgggtaacggttaacggacgttacggttccggtaacccgtccgtttacg

SEQ ID NO: 127019 - DNA, 800 bp, Homo sapiens
  misc_feature: GYAE6OF01CWBEF.48.59.F04.1.454.CMB.1.raw
  modified_base (624)..(624): a, c, t, g, unknown or other
  misc_feature (624)..(624): n is a, c, g, or t
  modified_base (634)..(634): a, c, t, g, unknown or other
  misc_feature (634)..(634): n is a, c, g, or t
  modified_base (671)..(671): a, c, t, g, unknown or other
  misc_feature (671)..(671): n is a, c, g, or t
tcagagtatacatacacgaccggtgctcgatttagtacacacacttagggattgggggctttctgagagtcatggatctcatgtgcaaagaaaatgaagcacctgtggttcttcctctgctggtgcgctccagatcgggtcctgccagctgcagctgcaggacgtccgggcccaggactgggtagaacgtcccgttacggaacgtccctcggtcccctcacctcgacctcgtcgtccttcggtacgggtcgtcctaccgtaacgtccgaaggccgaacgccgttaaacggtttacctttaacggttccgggttacggggtcgttaccgggtaccgttccccggacccggaacccgggtacccccggggtaaaagggggaaccgggggtccggttacgggtaggttacgggtaggtttacggggtaacgtttaaccgtttaacccgaaggtacgggttacgggaacgtaccctaccgtaacccgtaacccgtaaccccgtaccgtaaacgtaaaacggtcggaaacggcctaaccgtagttaacgtaccgtaaacaccgtaaccgtaacgaaacctaacctaatcccgtacgtagaacgtctagaccgtacgtcgttacggaccnccggtaccgngaaccgtacgacggtcgtacgttaacctaggttaccncggtacggacccggtccggacccgcggtacgcgtcgttcgtttctaggtacttcggttcgtagttacggtcgggttcggaaccgggaaccggtaagggtaccttaaggtcggtaacccgtcgttacccg

SEQ ID NO: 127020 - DNA, 774 bp, Homo sapiens
  misc_feature: GYAE6OF01AN2AY.48.59.F04.1.454.CMB.1.raw
tcagagtatacatacacgaccggtgctcgatttagtacacacacttagggagttgggggctttctgagagtcatggatctcatgtgcaagaaaatgaagcaccttgtgttcttcctcctgctggtggcggctcccagatgggtcctgtcccagctgcagctgcaggagtcgggcccaggactggtgaagccttcggagaccctgtccctcacctgccactgtctctggtgctccatcagcagctagtacttacgtctagggctcggatcccgccacgcccccgaggggaacgggtcctgggagtggtacgttggggacgtttaactttaccgacgtaggtgggacgtccaaccgtacctaccgtaaccccgtccctacgaaaacgtcggaacggacctaaccggactacgtacccgtaagaccctaaccgttacccgaaacgtaacccctaaacgtttccctacccgttacggaaacgtccgtacggacgtaccgttccgtaggttaccggaccccggtcccgaccaacggtaccgtaaccggtccttacgttaccgttacgtttaccgtagggttacgcccgggtaaccgggccccccgtaggtacccggtaccggtaacggtttcgggttaccgtttttttacggaccgtttacccggtttacccgttttaggttaacgttaacgggttccggggttaccggggggtaaccccgtaaaacgggggtaaccctaaagggttccccgggtttacccgtaacccggtttccccgg

SEQ ID NO: 127021 - DNA, 695 bp, Homo sapiens
  misc_feature: GYAE6OF01C4TJ2.48.59.F04.1.454.CMB.1.raw
  modified_base (249)..(249): a, c, t, g, unknown or other
  misc_feature (249)..(249): n is a, c, g, or t
tcagagtatacatacacgaccggtgctcgatttagtacacacacttagggattgggggctttctgagagtcatggatctcatgtgcaagaaaaatgaagcacctgtggttcttcctcctgctggtggcggctcccagatgggtcctgtcccagctgcagctgcaggacgtcgggccaggactggtgaacgcccttcggacgacccctgtcccctcacctgcactgtctcgtggtcgcctccatcagcanctagttacttacttcgtggggctggactccgccacgccccgagggagggctggagtggagtggatacttacagaggtggagcacctactaccacccgtcctacgaaacgcgaggccaccgatactacgtacgacctaacgtacccaaacgaacctagttaccctacccgtacgaacgtcctaggacgtccttacgtcgtaccggacccgccgacgaaccgacgaccggtacttacgttacgttacttacgttggtccgaccgggacccgggaccccgtaggtcccggtccggtaacgggttccggttttacgtttttcggaacgtttccggttcccgtttttaagggtacgtttacgggttaccggggttacgggggtaaacccgggtaacggggaaaacctttacggggtaccgggttcccccgtttaacccggtttacccccgg

SEQ ID NO: 127022 - DNA, 848 bp, Homo sapiens
  misc_feature: GYAE6OF01EIZAE.48.59.F04.1.454.CMB.1.raw
tcagagtatacatacacgaccggtgctcgatttagtacacacacttagggattgggggcttttctgagagtcatggatctcatgtgcaagaaaatgaagcacctgtggttcttcctcctgctggtggcggctccagatgggtcctgtcccagctgcagctgcaggacgtccgggcccaggctgggtgaacgccgttcggacgtacccttcgtcccctcacccgttgcctacttgtccttcgtggtcgcctccatcagcagtcagttaccttacgttcgtgggtctcggactcccgaccgaccggcccccggaagggggtaacggggtcgtagggtacggtagggttacggttacggggtaacgtttaaccgttttaacccgacgttaggggttacgggtaacgtaccgtaaaccccgttaaccgtaaaccccgtaaaccccggttaccccgtaaacggtaaaaaccggttcccggaaacggacccgtaaaccgtaacgtttaacccggtaacccgtaaaccggtaacccgtaaacccggttaaacccgaaaaaccgggttaaaccccttaaaccgttttaccccgtaaccccgttaacggaacgtacccgtaaggtacccgtaccgtttcgttacggtaacccggtacccccggaccgtacccgaaacggtaccccgacggttctttaacggttacctttaacgttaccgtaggtacccgttccgggaaccggtccccggagtccggacgttgggttgtttacgtttgacgtttgtcccgtttagacgttggttcgggacggtaaccgtaacggtaacttaccgttcggtacccgtccggtttacccg

SEQ ID NO: 127023 - DNA, 744 bp, Homo sapiens
  misc_feature: GYAE6OF01A15IJ.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctccagatggtcctgtcccagctgcagctgcgaggcgtccgggcccaggacgttggtagaacgtcccgttcgggacgtacccttcgtacccctacaccttggacctaccgttcgttccgttcgtgggtaccgcctaccatcgacgcacgctacgttacctttacgttcggtgggtcgtggacctcccgccgaccggaccccggaggggacggggcgtagggtacggttgggtaggttacgggtactttacgtttaaccgaggtagggtacgggtacaccgtaaccctaaccgtaacccgtaaccccgtaccttaaacgaaacggtccggaacgacctaacgtacgtacgtaccgtacgaaccgaacgtaccaaacgtaacctacgtttcccgtaccgacgacgtcgtacgtacgtcgttacgacggtaccgacccgaccgtaacgaccgaacggtccgtacttcgttaacctttagtccgtaggtcggacccggtaccgggaccctggacgtaccgttaggttcggtttacgttttcgagttcccgttacgttagtacggttggtaccgggtacggaccgtaaggtacgtaaggttcccggtcctaccgtttccg

SEQ ID NO: 127024 - DNA, 649 bp, Homo sapiens
  misc_feature: GYAE6OF01B17AQ.48.59.F04.1.454.CMB.1.raw
  modified_base (185)..(185): a, c, t, g, unknown or other
  misc_feature (185)..(185): n is a, c, g, or t
  modified_base (261)..(261): a, c, t, g, unknown or other
  misc_feature (261)..(261): n is a, c, g, or t
  modified_base (443)..(443): a, c, t, g, unknown or other
  misc_feature (443)..(443): n is a, c, g, or t
tcagagtatacatacacgaccggtgctcgatttagtacacacacttagggattgggggctttctgagagtcatggatctcatgtgcaaagaaaatgaagcacctgtggttcttcctcctgctggtggcggctcccagatgggtcctgtcccagctgcagctgcaggagtcgggcccaggactggngaacgccttcggagaccctgtccctcacctgctactgtctcgtggtcgctcgatcagcagctagttacttactcgngggtctggactccgcacgccccgagggacgggctggagtgagtggagtacgttacacgtagtgggatccaacctacgtacctacccgtacctaacgaaaacgtcgacggcaacgtactaacgtaccgtaagaccacgtaccaaacgtaacctaacttcctaccgtacgaacgtctaggtacncgttacgtcggtacgacccgtccgacgtaccggaccacgggtcgtcgtacttaacgttcgtacgtggaccgtccggaccccggtagccggacgtacgttacgggttccttttacggactttccgggtctttacgggtaattcggtaccgggttcgggggtaaaccgtaaacggggcttaaaggttccggtaccgtaccccggtttc

SEQ ID NO: 127025 - DNA, 580 bp, Homo sapiens
  misc_feature: GYAE6OF01D1WH0.48.59.F04.1.454.CMB.1.raw
  modified_base (334)..(334): a, c, t, g, unknown or other
  misc_feature (334)..(334): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (504)..(505): a, c, t, g, unknown or other
  misc_feature (504)..(505): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (533)..(533): a, c, t, g, unknown or other
  misc_feature (533)..(533): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (555)..(556): a, c, t, g, unknown or other
  misc_feature (555)..(556): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (575)..(575): a, c, t, g, unknown or other
  misc_feature (575)..(575): n is a, c, g, or t
  modified_base (577)..(579): a, c, t, g, unknown or other
  misc_feature (577)..(579): n is a, c, g, or t
tcagagtatacatacacgaccggtgctcgattttagtacacacacttagggagttggggagtatttaccacagtgggagcacctactacaacccgtcctcaaaagtcgaggcacatatccgtagacacgtccaagaaccaattctccctgaagctgagctctgtgaccgcgcagacacggctgtctattactgtgcgacggcccgagcgcagtggctttttgactggtccttttgatagtggtcgggaccaagggactaagtcgggtacaccggtcttacttcacggtcctaccgaaccgaacggggacccacgttaccggtcctttaccccgnggacctaaccccgttcacgaaacggcgacctaccgttcggcggggacacggtacggcggtccgttgggccttcggaccgttaggtaccaaacgggtctaaccttcgtaactgtactacgtcgttagaggtcggtctaggaacgcgggtccagacgtancgancgacngtnnacgtncgtananacgacacgagcgacanacgagaganacgnacncgcnanncgnanangngncgacacancnnnc

SEQ ID NO: 127026 - DNA, 866 bp, Homo sapiens
  misc_feature: GYAE6OF01C3BEF.48.59.F04.1.454.CMB.1.raw
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (683)..(683): a, c, t, g, unknown or other
  misc_feature (683)..(683): n is a, c, g, or t
tcagagtatacatacacgaccggtgctcgatttagtacacacacttagggattgggggctttctgagagtcatggatctcatgtgcaagaaaatgaagcacctgtgttcttcctcctgctggtggcggcctcccagatgggtcctgtcccagctgcagctgcaggagtccgggcccaggactggtagaacgtccgttacggacgacccctcgtccccctcaccgtgactacgttgtccttcgtgggtcgtcctacctancgancgagtctacgttacttacgttcggtgggtctacggaccgtcccgcccgtaaccggacccccgggaagggggtacggggcgtacgggtacgggtacggtaaggttcgggtaaacgtttacgtttaaccgtacggtaacgggtacgggtacgtaccctaacccgttaacccgtaaacccgtaaccccccgtaacccgttaacgaaaaaccggtccgggtaaccggtaacctaaacccgtaacgtaaccgttacccggtaaacggtaaaccctaacccggtaaacccaaaaccgtaaaccctttaacctttacccgtacccggtacgtaaccgtccgtaggtacccgtccgttaccgtacgggtacccgtacccgccgaacggaaccgtacggtaccgtccgttacgttacttacttaccggnggtacccggacgggtccccggacccggtcggacccggtcgttaacgggtttcgttttacggttttacgcggtttcccggtttcggtttacgtacggttttacgggtaccggggtaacgggtaacccgggtaaaaggggttaacccttagggtttaaccccgacccggttacccgtttaccccg

SEQ ID NO: 127027 - DNA, 708 bp, Homo sapiens
  misc_feature: GYAE6OF01CTQCC.48.59.F04.1.454.CMB.1.raw
  modified_base (341)..(341): a, c, t, g, unknown or other
  misc_feature (341)..(341): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccgttcggacgaccctgtacccctcacctgcctacgtgtcctcgtggtcgcctccatcgagcagcagtacttacgtcgtgggctgactccgccacgccccgagggacgggcgtggagtggtagttgggtattacttacgacgaggtcggacnccaacctacctaaccacccgtccaacgaaacgtcgacgaccaactatactaccgagaccacgtacctaaacgaacctacttacctaccgagaacgtctagacgtctacgtacgccgtacccgaccgcgtaacggaccgtacggtccttacgttacctttaacgtttacgtcgggttacggaccgggtacccggtacccgggacggtaccggtcgttaacgggttccggtttttaccgttttacgggtacgtttccggtttacccgttttagggtaacgtttaggggttcccggggttaacgggggtaaacccggtaaacggggtaaccgttaaggtttcccgggttacccgttacccggtttacccg

SEQ ID NO: 127028 - DNA, 872 bp, Homo sapiens
  misc_feature: GYAE6OF01D2JOA.48.59.F04.1.454.CMB.1.raw
tcagagtatacatacacgaccggtgctcgatttagtacacacacttagggattgggggctttctgagagtcatggatctcatgtgacaaagaaaatgaagccacctggttggttcttccctcctgctgggtggcggcctccagagtcgggtcctcgtcccagctgcagctgcgagggacgtcccgggacccaggtacgtgggtacgaacgtcccgttaccgggacgtacccgttcggtcccctaccgacccgttaggaccctacgttacgttccgttaccggttcgggtccggtacccttccctaaagttcccgaagacccgaaggtaccgttaaacggtttaacctttttaaccggtttccggacgggggtcttaccggggaccttacccggaaccccgaacccggaacccccggaaggggggtaacgggtcggtaggggtaggttacgggtaggttacgggtaacgtttaacgttacccgaaggtaggtacgggaaccgtaccctaaaccctaaaccgttaaaccccggtaaacccccgttaacccgtaaaccgtaaaaacgggtccgtaaaccggtaaccaaccgttaaacttaacgtaacccggtaaacaaccggtaccgaaaccgaaacgtaacccttaacgttcctaaccgtacgtaacgcgtacgacgtacgtactacggacgtacccgacgtaccgacgtaccgtacggtctacgttaccttaacgttccgtacgtccggaccggtacccggacccgagtacccgtagtacggtacgtttccgtttagtaccgttcgtaccgttaggtacgttcggtagggacggtaaccgaacggtaacgtagtaccgtacgtccgttacccg

SEQ ID NO: 127029 - DNA, 677 bp, Homo sapiens
  misc_feature: GYAE6OF01DE0VM.48.59.F04.1.454.CMB.1.raw
  modified_base (327)..(327): a, c, t, g, unknown or other
  misc_feature (327)..(327): n is a, c, g, or t
  modified_base (487)..(487): a, c, t, g, unknown or other
  misc_feature (487)..(487): n is a, c, g, or t
tcagagtatacatacacgaccggtgctcgatttagtacacacacttagggattgggggaagacaatgggtttgattcagattacatgggtgacttttctgttgtatttccaatctcagatcgccccggagaattgtgttgacgcagtctccagaccaccctgttctttgtcctccgaaggggaaagcgaccctaccttcctcctcgccgaggtccagtcgagtacgtaccttaccgaacgtacttactacgcctaggtaccatacaacgaaccgtggaccacggccacccgacggtcctcctactacgtaccgtacggtcactaccnccgacgacgacggaccacgtcggactacctccgagaccgttacgcgtaggcggacgtggtcggtcgtacggacgacgtctaccactccgtaccgtacgctacgaccacgaccgtacgaccgtagtactttgtcgtactacgttagttaccgttgtacgtntacgtactaggttacgtcggtactcgtaccgtaacgtctaccgtaccggtcgaacgacgacgtacgacggtacgacgttaaccgaaccggtgtccgtacgccgtaacctacgtccgttactcgttacccttgttaaccctcccgttacccgtccgtaccttactcgttaacttattcgttaacgttaccg

SEQ ID NO: 127030 - DNA, 871 bp, Homo sapiens
  misc_feature: GYAE6OF01CHWPQ.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctctgctgggtggcgcctccagagtcgggttcctcgtcccagtctgcagctgcgagggacggtccgggaccaggtcgttgggtacgaacggttccgttaccgggacgtaccccgttcggttcccctacgtacccgttcgtacctaccgtttcgttccgttcggttcgggtacggtccttacctactcgacgacgtacggtaccttaacggtttaccttttaccggttcgggtcggggtaccgtacgggtaccgtccccggacccggtaacccgggacccccggggaaggggggtaacggggtcggtaggggtacggttacgggtaacgggtttacggggtaacgtttaaccgtttaaccggacggttacgggtacgggtaccgtaaccctaaccggttaaacccgtaaccccgtaaccccgttacccgtaaacggtaaaccgggtacggtaaccgactaaccgtacgttaaccgtaccgtaacgacccgtaaccgtaacaaaccgtaacctacgttcccgtacgtacgagtacgtcgtacgtccgtacgtcgtaccggaccgaccgacgacgaccgtccgtacgttcgttacgttacgtcgtacggtaccgggtaccggaccggtacccgaggtcccgtacgttcgggttcgtttacgttacggtcgttaccggtttacgttacgtacggttcgggttacgggtaacggggtaaccggtaacggtacgttaacggttcccgtaccgttcccgttaccg

SEQ ID NO: 127031 - DNA, 484 bp, Homo sapiens
  misc_feature: GYAE6OF01D9WNH.48.59.F04.1.454.CMB.1.raw
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (429)..(429): a, c, t, g, unknown or other
  misc_feature (429)..(429): n is a, c, g, or t
  modified_base (431)..(432): a, c, t, g, unknown or other
  misc_feature (431)..(432): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(452): a, c, t, g, unknown or other
  misc_feature (447)..(452): n is a, c, g, or t
  modified_base (455)..(466): a, c, t, g, unknown or other
  misc_feature (455)..(466): n is a, c, g, or t
  modified_base (468)..(468): a, c, t, g, unknown or other
  misc_feature (468)..(468): n is a, c, g, or t
  modified_base (470)..(482): a, c, t, g, unknown or other
  misc_feature (470)..(482): n is a, c, g, or t
  modified_base (484)..(484): a, c, t, g, unknown or other
  misc_feature (484)..(484): n is a, c, g, or t
tcagagtatacatacacgaccggtgctcgatttagtacacacacttagggagttgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcggcagtggctttttgatgcctttgatatgtggggcaagggacaatggtcaccgtctcttcagcctccacctaagggcccatccggtcttccccccgnggccaccctgcctccgaaggngcnccgtaccgagagcacgngcgtcccctgggctgccgtggcaaaggtactacttctagtgtactacgtctagagcgggcgtcgacaacggtcgcaagtagngnngcagtnacgtngngnnnnnngannnnnnnnnnnnangnnnnnnnnnnnnngn

SEQ ID NO: 127032 - DNA, 866 bp, Homo sapiens
  misc_feature: GYAE6OF01BF4R5.48.59.F04.1.454.CMB.1.raw
tcagagtatacatacacgaccggtgctcgatttagtacacacacttagggattgggggctttctgagagtcatggatctcatgtgcaaagaaaatgaagcacctgtggttcttcctcctgctggtggcggcctcccagagtgggtcctgtcccagctgcagctgcgagggacgtcgggacccaggacgtggtagaacgtcccgttacggacgtaccctcgtcccctccacctcgctactgtcctcgtggtcggtcctccagtacagcgacgactagttaccttacgttcgtcggggtactggaccgtcccggacccgaccgggaccccccgggaagggggtaacgggggccgtaggggtacggttagggtaggtttacggggtaacgttaaccgtttaaccgaacggtaagggtacgggggaaccgtacccgtaaaccccgttaacccgtaaaccccgtaaccccccggttaacccgtaaaccgaaaaaccgggttacgggaaccggtaaccgaaacccgtaaagttacccggttaacccggtaaaccggtaacctaaacccggtaacccgtaaaaccggtaaacctaacccgtttaccccgtacccgtaggaaaccgtccgtaacgacggttaccctacggttcggtaccggaccccggtccggaacctccggaaccgtaccggtcgttaccgttacgttacgtttacctcgggttacggacccggtccggacccggaaggtccggtacctagggttcgttagttttacgacgtttcggttaccgtttaggtaggttacggacggggtaccgggaaccggtaacggttaccgtaagggttcccgttacccggtacccgttacccg

SEQ ID NO: 127033 - DNA, 554 bp, Homo sapiens
  misc_feature: GYAE6OF01ATRMB.48.59.F04.1.454.CMB.1.raw
  modified_base (378)..(378): a, c, t, g, unknown or other
  misc_feature (378)..(378): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacggcccccgagggaacggggctgggacgtggattgggagttactttaccacgtagtgggagcacctacaccacccgtccacaaagtcgaggccaccatatccgtanaccacgtccaagaacccaattcctccctagaacgctgacgctctcgtacgcccggccgcacgacacggctgtctattcngtcgcgacggcccgngcgcaggtgtcttttgattcgtccgtttgacttggtgggtcggggaccgaacggggactaagttccggtcctcccggttccg

SEQ ID NO: 127034 - DNA, 603 bp, Homo sapiens
  misc_feature: GYAE6OF01AGBU2.48.59.F04.1.454.CMB.1.raw
  modified_base (339)..(339): a, c, t, g, unknown or other
  misc_feature (339)..(339): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
  modified_base (595)..(595): a, c, t, g, unknown or other
  misc_feature (595)..(595): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtccttaccaacgactactagcctggtaccatcagaacctggccaggctcccaggcctctcatctacgtgcatccagcagggccacgtggcactcccagacaggttcaggtgcagtgggtctgggacngacttcactcgacaccgtcacgcacgtactcggacccctaggtaaacgttnttttggctaggttnttagttactgtcagtacaggttagtggtacnctaccaccgtctaccgtaccgttacggaccgtaaacgggaccacggaacgtcggaacgtaacgttaacccgacgtcggtacgacctcggacctaccgtattccgttcgttaccttacgtcccttaccttaccccgaccttactcgtacgtaacttagttnttaaaccg

SEQ ID NO: 127035 - DNA, 732 bp, Homo sapiens
  misc_feature: GYAE6OF01EZEWL.48.59.F04.1.454.CMB.1.raw
  modified_base (615)..(615): a, c, t, g, unknown or other
  misc_feature (615)..(615): n is a, c, g, or t
tcagagtatacatacacgaccggtgctcgatttagtacacacacttagggattgggggctttctgagagtcatggatctcatgtgcaaagaaaatgaagcacctgtgttcttcctcctgctggtggcggctcccagagtggtcctgtcccagctgcagctgcgaggaggtcgggcccaggacgtgggtagaacggtcccgttcggacgtacccgtcgtcccctcgtacccgtgacctactgtccttcgtggtcgtctccatcagcgacgactacgttacttacgttcggtacgggtcctcggtacctccgaccgtaccggcccccggaagggggacggggtcgtggggacggttgggtagttacggggtacgttaactttacccgaggtagggtacgggtacgaccctaacccgttaacgtaaaccccgtaacccccggttacctaaccggtaaaaacggttccggaaccggtacccaaacccgtaagttaaccgtaccggttaacgaaccccgtaacgtaacccggaaactaacccgttactttaccctcccgttaacgaacggtctaacggtacgttcctaggtccggtaccgcccggaccgtagaccgtacnccggtgtttaccatttacgtcgttgtccggaccgtacggcccgaggctacgtggtcgttcttgcttgtctttagacgtgtacggcgggaactacggtactagtccggtacctcgttc

SEQ ID NO: 127036 - DNA, 713 bp, Homo sapiens
  misc_feature: GYAE6OF01CZOMG.48.59.F04.1.454.CMB.1.raw
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (639)..(639): a, c, t, g, unknown or other
  misc_feature (639)..(639): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtgcggctcccagatgggtcctgtcccagctgcagctagcgaggcgtccgggcccaagggctgggtagaacgtcccgttacgggactaccctcgtccctcacctgacctactgtcctcgtggtcgctccatcngcagctagtacttacgtgngggtctggacgtccgccgaccggaccccgaggggacggtcgtggtagtggaggttggaacgttacgttaccgagtagggttcggaacgccctaaccgtaccgtaaccgtaaccccgttacctaaacgaaaacgtcggacgacctaactacgtaccgttacccgtacgtaaccgtaccggtaaccaaaaccgtaacctttaacttacccgttacccgtagaacgtcgtacgtaaccgtcctacgttacggacccgacccgacccgtacgtaacggaccgtaccggtcgtttacgtaccttagtttccgtaggtacccgaccggtacccggcccgaggtccgtcgtaacggttcggtttagtttcgngtttcgttcgttagaggttcgtcgggtaccgggacgttaacgggaattccggttacggtcccgttaccgttccg

SEQ ID NO: 127037 - DNA, 653 bp, Homo sapiens
  misc_feature: GYAE6OF01BKJB4.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccgttcggacgaccctgtcccctcaccctgccactcgtctctgggtcggctccatcgagcagcagttacttacgttcgtggggctggctccgccacgccccgagggacgggcgtggagtggattggggattagtttaccacgtaggtgggacgccgtacctacgtaaccaaccccgtacctacgaaacgtcgaggtccacatacgtaccgacacgtacgtaccaaacgaacctaattccctacctacggaacgtccttagacgtcgtacgttcgtaccgacccgtccgaccacggaccgaccggtcttgtaccgttaacttcgtggtacggaccgtaccgggaccccggacgccgtacgtacggttcggttccgtttttgacgttcggttaccgtttaggtagttggttacgggtccggggaacggtaaacgggtacgtaggtaccggttccgacccggttaccg

SEQ ID NO: 127038 - DNA, 482 bp, Homo sapiens
  misc_feature: GYAE6OF01DB7PP.48.59.F04.1.454.CMB.1.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (445)..(482): a, c, t, g, unknown or other
  misc_feature (445)..(482): n is a, c, g, or t
tcagagtatacatacacgaccggtgctcgatttagtacacacacttagggattgggagtatttaccacagtgggagcacctactacaacccgtccctcaaaagtccgaggcaccatatccgtagacacgtccaagaaccaattctcctgagctgagctctgtcgaccgccgcagacacggctgtctattctgtgcgacggcccgagcgctagtcgtnttttcgatcgtcttgactgtggtcggggcaaggctagtcggtctaccgtctctcncgccaccgaacgacggcctacgtcccgttccctcccgcgaccctaccctccgaccgacgacgccgtccgtcggcggaccacgcggccggtccgtcgctcgtacgtacggtactaccgtacttcctcctctcgtactcgtcgcgcggcggtcgacggacgtacgcgtanagngnnnnnnnnnnnnnnnnnnnnnnnnnnnnnnnnnnnnnn

SEQ ID NO: 127039 - DNA, 782 bp, Homo sapiens
  misc_feature: GYAE6OF01CP5RN.48.59.F04.1.454.CMB.1.raw
tcagagtatacatacacgaccggtgctcgatttagtacacacacttagggattgggggcttttctgagagtcatggatctcatgtgcaagaaaatgaagcacctgtggttcttcctcctgctggtggcgctccagatggtcctgtcccagctgcagctgcgaggacgtccgggcccagggacgtgggtgaacgtcccgttacgggacgtaccctcgtcccctcacctgcctacgttcgtccttcgtggtcgtccttaccagtccgagacgacgtactaacgttacctttaccgttcggttacggggtctacggacctccccggacccgaaccggacccccgggaagggggtaacggggtcgttacgggtagggttcggtaagggttacggggtaacgtttaaccgtttaacccggaacggtagggtacgggaccgtacctaaccccgttaacccgtaaaccccgtaaccccggttacctaaaccgtaaaacggtcggaaccggaaccctaaccgtaacgttaccgtaaccgtaacgaacccgtaaacccgtaccaaaacccgtaacctaacctttcccgtaacccgagtaaccgtcgtagtacccgtcttacggtcgtccgacccgtcccgtaagaccggacgtaccgtcgtacgttacgttaacttcggtaggtcgaccggaccgccggtacgccgtagtacgttcggttacttgtacgtcgttcgttagtaggttacggtcggtaacgggacgtaaaggtctacggtcgttccgtcgttc

SEQ ID NO: 127040 - DNA, 843 bp, Homo sapiens
  misc_feature: GYAE6OF01AMJY5.48.59.F04.1.454.CMB.1.raw
tcagagtatacatacacgaccggtgctcgatttagtacacacacttagggattgggggaagacaatgggtttgattcagattacatgggtgacttttctagttgtatttccaatctcagatgcccccggagaattgtgtgacgcagtctcagaccaccctgtctttgtctccgagggaagccgccaccctctcctgtagggccagtcagaatagttaagacgccacctccttacgccgtcggtaccacgaacaaaaccgtcggaccacgccctcccgaggcctcccgtcacgtctagtcggtcgccgtcccgaccgacggggccaccgttcggccacctaccccgacggtaacggtacggttacacggtcgacgtacgggttcgggtcgttacgggactacgtacgttacctaccgttcctacccgacctacgtaccaacccggtaacgtaccgacggtacgtacccgtagtacgttagtttagtttacgtacgttacgggttttacttttcggtcgtttactacggtcgttaacgttacgggttaaggtaaccggtttaccgacccggttaaccgggtaaccttacccgggtttacccggggaccccggggtaacgggggtaaccggtaacggggtaaacggtaaacccggttaaaccggaaaccggtttaaaccggttcgggtaccggttaccgttaccggacccgtacccgttaggtttacccgtacgttttaccctaccggttccctttacccccgttaccccggtaccgttacccgttaacccggtagtttaaccgttaaggttaccccgtttacttaaccggtccggttaaccgggg

SEQ ID NO: 127041 - DNA, 766 bp, Homo sapiens
  misc_feature: GYAE6OF01BIPBE.48.59.F04.1.454.CMB.1.raw
  modified_base (257)..(257): a, c, t, g, unknown or other
  misc_feature (257)..(257): n is a, c, g, or t
tcagagtatacatacacgaccggtgctcgatttagtacacacacttagggattgggggctttctgagagtcatggatctcatgtgcaagaaaatgaagcacctgtggttcttcctcctgctgggtggcggctcccagatgggtcctgtcccagctgcagctgcaggacgtcgggcccaggactggtgaagcccgtttcggaagaccccttggtcccctacacccgtggccaccttgtcctcgtggtcgcctccatcngctagctagttacttacttcgtggggctggactccgccaccgcccccgaggggaacgggccgtgggacgttgggtacgttagggtagttacgtttaccgaggtacgggtagggtacgacctaaccctaaccgtaaccgaaccccggttaccctaacgtaaaacggttccggaacggacctaacccaagttactacccggtacaaccgtaaccgtaccaaaccggtaacctaactttaccctacccgtacggaacgtaccgtacgaacgtcctttcgtacggtaccgtacccggccggtaccgacgtaccgaccggtcgttacggttaccttaacggtttctacgggtccgtaccgggcccgggacccggttacggacccgttgtacgggttccggtttacgtttttaacggccgttacggtttccgtttacgtaggttcgggttaacggtccgggggtaaccgaacggggttaacgttaccggtttccggtaccgttcccggttacccg

SEQ ID NO: 127042 - DNA, 640 bp, Homo sapiens
  misc_feature: GYAE6OF01B6N2R.48.59.F04.1.454.CMB.1.raw
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
  modified_base (582)..(582): a, c, t, g, unknown or other
  misc_feature (582)..(582): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (611)..(611): a, c, t, g, unknown or other
  misc_feature (611)..(611): n is a, c, g, or t
  modified_base (614)..(615): a, c, t, g, unknown or other
  misc_feature (614)..(615): n is a, c, g, or t
  modified_base (617)..(618): a, c, t, g, unknown or other
  misc_feature (617)..(618): n is a, c, g, or t
  modified_base (620)..(620): a, c, t, g, unknown or other
  misc_feature (620)..(620): n is a, c, g, or t
  modified_base (622)..(627): a, c, t, g, unknown or other
  misc_feature (622)..(627): n is a, c, g, or t
  modified_base (629)..(631): a, c, t, g, unknown or other
  misc_feature (629)..(631): n is a, c, g, or t
  modified_base (633)..(635): a, c, t, g, unknown or other
  misc_feature (633)..(635): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaccaattctccctgaagctgagctctgtgaccgccgcagacacggctgtctattactgtgcgaggccccgagcgcagtggtctttttgatgcctttgatatgtggggccaaggacagtcggtcaccgtctcgttcacgtccctccaccaacgggcccatcccgggtccttccccccgtgggtcccacccctccttaccgaacgacgcccgtaacccgtcggttcggggggcccaaccggacggtaccccggccccggtttcgggggacccttcgggtcccgttacgggggtacccgaaaacgggttacccgttacccgtttaccgtttaacgtacggtttaacttaacccgttcgggttaacggaccggggttaccggggtaccgttaccggggaaccgtaacggggccggtaacgtaacggttaacggctcgagtncgnaacttcgntacgcgtntacntcgancngnagnctacngtnngnngngnnnnnncnnncnnncngnc

SEQ ID NO: 127043 - DNA, 775 bp, Homo sapiens
  misc_feature: GYAE6OF01EZL58.48.59.F04.1.454.CMB.1.raw
  modified_base (186)..(186): a, c, t, g, unknown or other
  misc_feature (186)..(186): n is a, c, g, or t
  modified_base (293)..(293): a, c, t, g, unknown or other
  misc_feature (293)..(293): n is a, c, g, or t
tcagagtatacatacacgaccggtgctcgatttagtacacacacttagggattgggggaagacaatgggtttgattcagattacatgggtgacttttctgttgtatttccaatctcagatcgcccccggagaaattgtgttgacgcagtctccagaccaccctgttctttgtctccgaggggaaancgccaccttctcctgcaggtccagtcagagtctaccaacgactacttagcctgtaccatacacgaacctggccaggtcctcccaggtcctcctctactcgtacggtncactccagcgacggaccacgtcggaccacctcccgaacggtacgtacggttacgaggtaggccgtaggtcgggtcgtagggaaccagtaccttcactcctaccgccgtacacgctaacgtacgtacggtaccctagtaagttacgtttcgacgttaggttagttaactttacgtcgttaccacgggtacttaagggttacggttcggtacgtccgttacccgtaacccggtaccgttacccgttaaccccggtttccgggaaccccggtaaggggtaacccgaaccgggttaaaccgggtaacggtaaaccggttaaacccggtttaaacccgggaacgggtttaccggtccgggtaacccgtacgtacccgttaaccgtacctttcggtttccggttacccgtttaaccgttacccgtttacccgttacccccggtaccttaccgtttacgttaacgttacctttacgttagtttaacccg

SEQ ID NO: 127044 - DNA, 873 bp, Homo sapiens
  misc_feature: GYAE6OF01BGJZT.48.59.F04.1.454.CMB.1.raw
tcagagtatacatacacgaccggtgctcgatttagtacacacacttagggattgggggctttctgagagtcatggatctcatgtgacaaagaaaatgaagcacctgtggttccttcctcctgctggtggcggctccagagtcggtcctcgtccagctgcagctgcgaggacggtccgggaccaggtcgtgggtacgaacgtccgttcggacgtaccctcgtccctccaccgtgctacgttcgtcctcggttgggtcgtcctaccatcgacgcacgtactacgtttacctttacgttccggtgggtctacggtacctcccggaccgacccggaccccggaagggggacggggtcgtaggggaggttaggggtacggttacggggttaaacgtttaaccgtttaacccggaacgggtaacggggtaccgggtaaccgtaacccttaaaccccgttaaaccccgttaaaccccgtaaaccccccgttaaccgtaaaacgtaaaaacggggtaccggaaaccggtacctaaaccgtaaacgtttaaccggttaacccggtaaaccgaaacccgtaacccgtaaacccgaaaacgtaaacccttaaccgttacccttacccgtacgtacgtaccgtacgtacgtacgtcgtacgtaccgaccgccgaccgacgaccgacgtcgttacgttacgttacgttacgtacggtcggaccggaccggacccgacggacgtaccgtacggttacggtttcgtttacgtacgttacgcgtttttttttttttttttttttttttttttttagtacgttcggttacgggttacgggtaaccggtaacgggtaacgttacggttacggttaccgttaccggttaccg

SEQ ID NO: 127045 - DNA, 754 bp, Homo sapiens
  misc_feature: GYAE6OF01EDKDQ.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagagtgggtcctgtcccagctgcagctgcgaggacgtccgggcccaggactgggtgacggtccgttcggacgtaccctcgtcccctcgacctgcctacgttgtctcgtggtcgcctccatcagcagctagttacttacgttcgtcgggctaggactcccgaccgaccggcccccggaagggggtacggggtcgtaggggtaggttcgggtaggttacggggtacttacgtttaccgagtagggtacggaccgacctaaccttaaccgtaacccgtaacccgtacccgtaacgaaacggtcgacgacctaacgtaacgttacgtaccggaacgtaccgtaaccgtaaccctaaacgtaaccttaacttcccgtaccctaaggaacgtcgtacgtacgtctacgtcggtaaccgcccgcgtacgacgtacgtcggtcttagtacttacgttcgcggtaccgaccggacccgggtcccgaggtccgtacgtagggtttccggttttacgttttaacgccggttttaccggttacgtttagtaacggtttgggtaccgggggtaaccggaaccgggtaaacgggaactttacgggttcccggttaccgttcccccggtttaccg

SEQ ID NO: 127046 - DNA, 803 bp, Homo sapiens
  misc_feature: GYAE6OF01BXR4B.48.59.F04.1.454.CMB.1.raw
tcagagtatacatacacgaccggtgctcgatttagtacacacacttagggattgggggctttctgagagtcatggatctcatgtgcaagaaaatgaagcacctgtggttccttcctcctgctggtggcggctcccagatgggtcctgtcccagctgcagctgcaggacgtccgggcccaggactgggtagaacgcccgttcgggacgaccccttcggtcccctaccacccgttcgacctaccgttgttccttcgtcgggtcggtcctccactccgagccaacggtcctaacgttacctttacgtttcggtggggtctaggacctccccggacccgacccggaccccccggaagggggaacggggtcgtacggggtagggttagggtaacggtttaggggtaacgtttaaccgtttaacccggaaggtaacgggtcgggaaccgtaccctaacccttaacccgttaaaccgtaacccccggttacccgtaaaccgaaaaacggtccggaacggacctaaaccgtaacgttaccgtaccggtaacgaccgaaccgtaaccgaaaacgaaccctaacttcctaccgtagaacgctaggacgtccgttcgtcgtacccgacccgccgtaccgacgaccggtaccgtacgttacgttacgttacgttcgtcggtccggaccggaccgggtaccccggtaggacccggtagtaccggttgtttccgttttacggacttccggttcgttttagaaggtttcggtacgggtacggtaccgtaaggtaccgtaagttcggtacgtcccgttc

SEQ ID NO: 127047 - DNA, 724 bp, Homo sapiens
  misc_feature: GYAE6OF01A9B8X.48.59.F04.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (545)..(545): a, c, t, g, unknown or other
  misc_feature (545)..(545): n is a, c, g, or t
tcagagtatacatacacgaccggtgctcgatttagtacacacacttagggattgggggctttctgagagtcatggatctcatgtgcaagaaaatgaagcacctgtgttccttcctcgtgcgtggtggccggcctaccgagtagtgggtcctgtcccagctgcgagctgcaggcgtccggccaggctggtanacgtcctaggacgtcctgtccncactgctactgtcgtgtggcacctntactcngctacgcttaacgttccgttacgtcggtggtccgtaggtacctacccgccgtaaccggccccgggaggggtaccgggtcgtagggtacggttgggtaggttacggtacgttaactacccggtaggtacggtacgggataccccgtaaccgtaaccgttacccccgaaccgtttaccgaaacgtaaccggtcccgaagaccgtaacctacgtaacccgtcgtaagacccctaaacgtaaccgaaatacccttacgttcctaaccgtgaccgtacgtacgactaccgtgtaccggtcccgacncccggtaacgccgtaaccgtcgtcgtttaactccttaagttccgaacggttcccggacgacccggccgacgtccggtctaacggttgttaaacctttcgtaaccgtttgaccgtttactaggttcgggcccggtaagggttaccgaaacggcttaggaaccctcccgttaacgttcccg

SEQ ID NO: 127048 - DNA, 769 bp, Homo sapiens
  misc_feature: GYAE6OF01D73OW.48.59.F04.1.454.CMB.1.raw
  modified_base (619)..(619): a, c, t, g, unknown or other
  misc_feature (619)..(619): n is a, c, g, or t
  modified_base (660)..(660): a, c, t, g, unknown or other
  misc_feature (660)..(660): n is a, c, g, or t
tcagagtatacatacacgaccggtgctcgatttagtacacacacttagggattgggagtatttaccacagtgggagcacctactacaacccgtccctcaaaaagtcgaggcaccatatccgtagacacgtccaagaaccaattctccctgaagctgagctctgtgaccgccgcagacacggctgtctattactgtgcgaggccccgagcgcgagtggtctttttgatcgtcctttagatatggtggggaccgaaagggacaagttcggtcctaccggttcttctttaccgacgtccctacccgaaccgaacggggaccctaagtcccggttccctttccccccgtacggccctaccccctcccgttaccgaaacggtacgacccgacccttacgggtacgggggacctaaccggacggcccggggccccggttacggggtccttacggtcccggttaacggggtaacccgtaaaaggggtaacccttttaacccgtttaccttaaacggttacggttaaacctttaacccgttaccgggtacgggtaaacgggggttcccgggggtaacggtttaccggggaccggtaaaacggggtcccggacttaaacgggttaggntacggttcacggatcaagtggacgtactacgacgaaggagngtatactacgacgtacgtacgtactagtactactacgtacgacgtacgtacctacggtcgtacgtacgtactacgtaacgtagtacgtacgacgtagtcgtagaggtag

SEQ ID NO: 127049 - DNA, 853 bp, Homo sapiens
  misc_feature: GYAE6OF01BXNFQ.48.59.F04.1.454.CMB.1.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
tcagagtatacatacacgaccggtgctcgatttagtacacacacttagggattgggggctttctgagagtcatggatctcatgtgcaagaaaatgaagcacctgtgttcttcctctgctggtggcggcctccgagagtcgggtcctgtcccagctgcagctggcagggcgtccgggcccaagggactggagacgtccgttcggacgcccttcgccctcaccgtnctactcgtctcggtcggtcgcctacngtacgngtccgagtctacgttacgtttacgttcggtacgggtcgtacgggtcctacccggccgaacccggcccccgggaagggggacggggtacggtagggtacggttgggtacggttacgggtacgttaaccgtttaccgaaccggtaaggggtacggtaccgtacctaacccggttaaccctaaccggtaccccgaaccgtaaacgtaaacggtcccgaacggtaccaacgtaacgttaccgaacggttaacgaaccgttaccgtaaccgaaaaccgtaacttaacccgttctaccggtaacgaaccgtcgtttaacgcgtacccgtcggtaacgtaccgacccgggtccacggtaacccggtaacgtcccggtaacgttcggttaacccgttacggttaccgttccgggtacccggacccggggtacccccggaccggggtctccgggaaccggtttaggttccccgggttttagttttaccggtaggtttcccgttaacggtttacgggttaacgtacgggtttacgggggaacccgggttaaacgggaacggtttaaccggttaaaggttccccggggtaactttacccgggttccgg

SEQ ID NO: 127050 - DNA, 797 bp, Homo sapiens
  misc_feature: GYAE6OF01BY6H7.48.59.F04.1.454.CMB.1.raw
  modified_base (133)..(133): a, c, t, g, unknown or other
  misc_feature (133)..(133): n is a, c, g, or t
  modified_base (269)..(269): a, c, t, g, unknown or other
  misc_feature (269)..(269): n is a, c, g, or t
tcagagtatacatacacgaccggtgctcgatttagtacacacacttagggattgggggctttctgagagtcatggatctcatgtgcaagaaatgaagcacctgtgttcttcctcctgctggtgcggctccagngtgggtcctgtcccagctgcagctgcaggacgtcgggcccaggctggtagacgccgttcggactaccctcgtcccctacaccgtgacctacgtgtctcgtggtcgcctcatcagcagctagttaccttacgtcggngggtctcggactcccgaccgtaccggaccccggaggggacgggtcgtagggtagtggtacggttcgggtaagttacttaccgagtacgggtacgggacctaccgtaccgttaaccgtaacccgtaaccccgtaccgtaaacgtaaaaccggtcggaaccggtacctaaaccgtaacgttaccggtaacccggtaacgaaccccgttaaaccggtaaacccgtaaaaccgtaaccccgttactttacccgtacccgtaaggtaaccgtcggtaacgtaccgtccgttacgtaaccggtcccggacccgtaccggtacggaacccgtaccggtaccggtcgtttaaccgttacgttacgttccggtacggtccggaccgggtaccccggaccgtacgggtgtaccccggttaggttccgttttccggtttaggtacgtttccggttcgtttagtacggtttcgggtaccggggtacgggtaaacccgtagggttaccgttacggttacccggtccccggttactttcccg

SEQ ID NO: 127051 - DNA, 654 bp, Homo sapiens
  misc_feature: GYAE6OF01DGT29.48.59.F04.1.454.CMB.1.raw
  modified_base (183)..(183): a, c, t, g, unknown or other
  misc_feature (183)..(183): n is a, c, g, or t
  modified_base (463)..(463): a, c, t, g, unknown or other
  misc_feature (463)..(463): n is a, c, g, or t
tcagagtatacatacacgaccggtgctcgatttagtacacacacttagggagttgggggaagacaatgggtttgtattcagattacatggtgacttttctgttgtatttccaatctcagatcgcccccggagaaattgtgttgacgcagtctccagacaccctgtcttgtctccgaagggaanagccaccttcgtcctagctaggtccagtcagtagtctaccacgactactagcctggtaccatcagaacctgcctagcctccaggctcctcatcgaggtcacactcagcacggccacgtcggctactacccagtacgtaggttccagtggacgtaggttcgggtactgggaacctaggtcttcaccgttctccgtaccgctagcaacgtacgtacggaccctaggacgttactttggactagttagtacttacgtggtacagtcgtagtagtacgggtacnctacaacccggtatccggttaacccgtcgggaacccaaggggtacctcgtaacgttacgggaacgttaacgttaaaccggacgttgtaccggtcctacggaccaccgtattccccgtagttccctaccttaccgttcccgtttacccgcccgttaagtaccctttacgtaaacgttgttacggtttaaccc

SEQ ID NO: 127052 - DNA, 811 bp, Homo sapiens
  misc_feature: GYAE6OF01EZ7KT.48.59.F04.1.454.CMB.1.raw
  modified_base (132)..(132): a, c, t, g, unknown or other
  misc_feature (132)..(132): n is a, c, g, or t
  modified_base (154)..(154): a, c, t, g, unknown or other
  misc_feature (154)..(154): n is a, c, g, or t
  modified_base (165)..(165): a, c, t, g, unknown or other
  misc_feature (165)..(165): n is a, c, g, or t
tcagagtatacatacacgaccggtgctcgatttagtacacacacttagggattgggggctttctgagagtcatggatctcatgtgcaagaaatgaagcactgtgttcttcctcctgctggtggcgctccagngtggtcctcgtcccagctcgcngctgacgaggngtccgggcccaggacgtggtagaacgtccgttacggaaccgtacccttcgtcccctcaccgtgcctacgtcgtcgtcgtcggtacgtcctcgagtcgacgacgacgccgtaagttacctttacgttcggtacgggtccgtacggaccgtcccggaccgaccccggaccccgggagggggacgggtcgtacgggtaggttagggtacggttaggggtacgtttaaccgtttaccggacggtaggtacgggtaaccgttaccctaaccccgttaaccgtaaacccccgtaccccgttaacccgtaaaacggtaaaacggtaccgggtaacgtaacccgaacccgttaaagtcccgtaaacgttacgaaacccgtaacccggtaaccaaaacggtaaccttaacccgtttaccgaacccgtttaggaaccgtcgttaacgagttaccgtacgtacggtaccgacccgtacccgacgtaccgacgtccggtacttcgttaaccgttcgtaacgggttcctacgggaccgttacccggaccggtgaccgtacggttacgttcggtttacttcgtaacgttcgttacgttaggttacgtcggttccgggaggtacggtaaacggtacgtaacggtcgttacgccgttacccg

SEQ ID NO: 127053 - DNA, 841 bp, Homo sapiens
  misc_feature: GYAE6OF01C7I8D.48.59.F04.1.454.CMB.1.raw
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
tcagagtatacatacacgaccggtgctcgatttagtacacacacttagggattgggggaagacaatgggtttgattcagattacatgggtgacttttctgttgtatttccaatctcagatcgcccccggagaaattgtgttgacgcagtctccagacaccctgttctttgtctccgaggggaaagcgacctaccttctcctgacgnggtccagtcgagtacgtccttaccaacgtacttactacgcctggtaccataccacgaaccgtggccacggcctccgaggcctcctacntccgtaggtcgcactacccgagccgtaacgggacccctacggtcgggcctaaccgtaccccgacggaacgttacgggtttcgaacggttggtacgacggggtttcggggtaccgttacggggaaccgtacgtaccctttacaccgtttacccgtaccgaacccgtttccgaacgggtccgtaacggtaccgtacccgggtaccgtttaaggtaagtttaccgtttgaacgttaggttacgtttactttaccgttcgttacggagtaccgtaagttacggtcggttaccgtcgttaaccgaaccttaccgtacccgttaacgggttaccccgggaaccggtaaaccggggtaaccgtaccggtaaacggttacgggttaaccttaaccggtaaaccggttacggttacgggttccgaacggttacccgtaaccctccgtttaaaccgtcggttttccgttacctttccggttacccctttacccgttacccccggtttctacccgggtttacttaaggttaaaccggttccgtttaaagtttacccgg

SEQ ID NO: 127054 - DNA, 702 bp, Homo sapiens
  misc_feature: GYAE6OF01BCMTR.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcctacgtgtctcgtggtcgcctccagtcagcagcagtacttacttcgtgggctggactccgccgacggcccccgaggggaacggggtcctgggagtggagttggggattacgtttaccgacgtagggtcgggacgcctacctaactaccgaacccgttcctaacgaaacgtcgacggaccacgtactacgtaccgaacgacgaccgtaccaaacgtaacctaacttccgtccgtagaacgtcgttagaacgtcctacgtcggtaccgacccggaccgacgacgtaccgccggtcttacggttacttaacgtttacgcggttacgaccgggtaccggacccggtaacgccggtacgtacgggttcggtttaccgtttttaggacgtttccgggttcccgttttaaggtacgtttacgggttcggggttaccggggaaccggtaaacggggacttaaacgggttccggtacccgttaacccggtttcccg

SEQ ID NO: 127055 - DNA, 679 bp, Homo sapiens
  misc_feature: GYAE6OF01AJ4ZU.48.59.F04.1.454.CMB.1.raw
  modified_base (152)..(152): a, c, t, g, unknown or other
  misc_feature (152)..(152): n is a, c, g, or t
  modified_base (626)..(629): a, c, t, g, unknown or other
  misc_feature (626)..(629): n is a, c, g, or t
  modified_base (632)..(634): a, c, t, g, unknown or other
  misc_feature (632)..(634): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (647)..(648): a, c, t, g, unknown or other
  misc_feature (647)..(648): n is a, c, g, or t
  modified_base (650)..(651): a, c, t, g, unknown or other
  misc_feature (650)..(651): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(660): a, c, t, g, unknown or other
  misc_feature (659)..(660): n is a, c, g, or t
  modified_base (663)..(667): a, c, t, g, unknown or other
  misc_feature (663)..(667): n is a, c, g, or t
  modified_base (669)..(670): a, c, t, g, unknown or other
  misc_feature (669)..(670): n is a, c, g, or t
  modified_base (672)..(673): a, c, t, g, unknown or other
  misc_feature (672)..(673): n is a, c, g, or t
  modified_base (675)..(677): a, c, t, g, unknown or other
  misc_feature (675)..(677): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaanctgagctctgtcgaccgccgcagacacggctcgtctattacgtgtgcgacggcccgagcgcagtggtctttttgatcgtcctttgattagtggtcggggaccgtaaagggactaagttcggtaccgtaccgttccttccgttacgacgtcccttacccgaacccgtaaacgggcccctagttacccggttccccttccccccggttcggacccctacccccttccccgtacccgtaacggacccgccctaccccggttccggttcggggggaccctaaccggtccggacccgggtccccggtcgggcctccggtccggttcggtaaccggaaccggttaaaccttcccttaccgttaagtttacggttaacccgttaccttccggtaggtaaccggggtcccggggtacgttcggggaaccggttaacggggcccgttataacccggtaggtcgcgtaagtcagcgtgctcgannnnctnnncgcgcngngcgcnncnncncncncnncgnnnnngnncnncnnncg

SEQ ID NO: 127056 - DNA, 681 bp, Homo sapiens
  misc_feature: GYAE6OF01DEK5O.48.59.F04.1.454.CMB.1.raw
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
  modified_base (598)..(598): a, c, t, g, unknown or other
  misc_feature (598)..(598): n is a, c, g, or t
  modified_base (618)..(618): a, c, t, g, unknown or other
  misc_feature (618)..(618): n is a, c, g, or t
  modified_base (633)..(633): a, c, t, g, unknown or other
  misc_feature (633)..(633): n is a, c, g, or t
  modified_base (639)..(639): a, c, t, g, unknown or other
  misc_feature (639)..(639): n is a, c, g, or t
  modified_base (650)..(650): a, c, t, g, unknown or other
  misc_feature (650)..(650): n is a, c, g, or t
  modified_base (659)..(659): a, c, t, g, unknown or other
  misc_feature (659)..(659): n is a, c, g, or t
  modified_base (669)..(669): a, c, t, g, unknown or other
  misc_feature (669)..(669): n is a, c, g, or t
tcagagtatacatacacgaccggtgctcgatttagtacacacacttagggattgggggctttctgagagtcatggatctcatgtgcaaagaaaatgaagcactgtgttcttcctctgctggtgcgctccagagtgggtcctcgtccagctgctgctagcgaggacggtccggacccgtaggactcgggtanacgtccgttacgggaccaccttcgtacccncaccgtgacctgttcgtccttcgtacgggtcacctacctagtccgagtacacgtccttaagttaccgttgtcggcggtactcggacctccgacccgaccggcccgggaaggggtacggtccgaggtaggtcgggttaagttacggggtacttaaacgtacccgaggttaggcgggaccaccttaaccgaccctaacgacccgtttacaaggtaaaccgtcggacaaccgtaacaccgtacgttacaacgacctaaccggtacaaaccgtactaacctttccgacgtaagtactacgtagactccttactacgggccaacccgtcgactaacggccgtacgtcttaagtcctaagttcgacgcggaccgaccgcggancggtacgtgttcgttacgtnaaccttccggtaatntacggngtccggggtanaccggtaancgttaccggntaccgtctaacg

SEQ ID NO: 127057 - DNA, 663 bp, Homo sapiens
  misc_feature: GYAE6OF01AQ0LY.48.59.F04.1.454.CMB.1.raw
  modified_base (212)..(212): a, c, t, g, unknown or other
  misc_feature (212)..(212): n is a, c, g, or t
tcagagtatacatacacgaccggtgctcgatttagtacacacacttagggattgggggaagacaatgggtttgattcagattacatgggtgacttttctgttgtatttccaatctcagatcgccccggagaaattgtgttgacgcagtctccagacacctgtctttgtctccgaggggaaagacgcctaccttctcctgcagtccagtcagngtcttaccacgactactagcctgtaccatcagaaccgtggccaggcctccgaggtctcctacacgttcgtacggtcgactactccgagcgtacgggcctacgtcggaccaccgttacccgaggtaccgtacggtttcgacggttcggacgtaggttcggggtccgtaggggactacggtacttcgtacctcgtaccacgtcgaacgctaggtaccgtacggaccgttaggaacgttgtttcggactacggttagttaactttcgtcgtacgtacgtagttaacgtagtacggtacgtccgtaccgaacgtccgtacccgtaccggttacggaaccgaacgggtacacggtaacgtacggacgttaacgtaaccgtacggtgtcgtacgtcgtaccgactctcgttactcttactcgttccgtcccgtactctcgtactattacgtgtaacg

SEQ ID NO: 127058 - DNA, 785 bp, Homo sapiens
  misc_feature: GYAE6OF01BQK9L.48.59.F04.1.454.CMB.1.raw
  modified_base (287)..(287): a, c, t, g, unknown or other
  misc_feature (287)..(287): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcgagggagtccgggcccagggactgggtacgacgtcccgttcgggaacgaccccttcgtcccctcacctgcctactgtcctcgttgggtccgcctaccatccgagcagctagttacttacgttcgngggctggacgtcccgcaccggaccccggtagggacgggtcgtagggacggtggtaggttacgggtatttaccgtttaaccgaccggtagggtacggggtacctaacccggtaacccttaacccgtaacccgtaacccccggttacccgtaaacgtaaaaccgggtaccggaaccggtaccctaacccgtaaacgttaacgttaccccgggtaaaacgtaacccgtaaacccgtaacccggtaaaaccgtaacccttaacgtttacccctacccggttaaggaaccgtccgttacggaccgtccgttacgtaccgggtaccgtacccggaccggacgacggtaccgaccgtacgttgttaccttacgtcgtggaccgcggtccggaccgcgcgtcggttagttcggtttccgtttgtacgtttccgtcgtttagacggttcgtacggggttcgggaaacggtaacggttactacggtaccggtcccgtttacggtcccg

SEQ ID NO: 127059 - DNA, 870 bp, Homo sapiens
  misc_feature: GYAE6OF01BUJTS.48.59.F04.1.454.CMB.1.raw
tcagagtatacatacacgaccggtgctcgatttagtacacacacttagggattggggctttctgagagtcatggatctcatgtgcaaagaaaatgaagcacctgtgttcttcctcctgctggtggcgctccagagtcggtcctcgtcccagctgcagctgacgaggtacgtccgggcccaaggtacgttggtagtaacgtcccgttacggaccgaccccgttcgttccccctacgacccgttgacccgtagttccgttcctccggttggtaccggtaccctcccgtaacgttaccgaacgaccgtacggaccttaacggtttaacccgttttaccggttcggtacggggtcttacggacccgtccccgtaccccgaacccggcccccgggtaaagggggtaccgggtacggtagggtacggtaaggtacggttaacgggttaactttaaccgtttaaccgaacggttagggtacggtacaccgtaacccgtaccttaaccccgaacccgttacccgtaacgtaaacggtccgaacgaccgtaaacctacgtaacttaccgaaaccgaccgtaaccgtaaccgtaaacgtaacctaaccgttttcccgaacgttaacgaacgtccgttacggtaacgttccgtaccgttcggacccgtacccgtaccgacgaacgtacggtcggttaccttacgttaacgtttcctaacggttccggtacggacccgggtacccgaccgtacgaccgttacccgttgggtttacgttttcttcgtacgtttcccggacgttttacgaaggtttccgtggggaaccccggttaacgtaacgggtaccgttaacggtttacccggtcccgtaccccgtttacg

SEQ ID NO: 127060 - DNA, 791 bp, Homo sapiens
  misc_feature: GYAE6OF01BQVWO.48.59.F04.1.454.CMB.1.raw
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
  modified_base (653)..(653): a, c, t, g, unknown or other
  misc_feature (653)..(653): n is a, c, g, or t
tcagagtatacatacacgaccggtgctcgatttagtacacacacttagggagttgggggctttctgagagtcatggatctcatgtgacaaagaaaatgaaacgcctaccgttgttcggtttcctttcccgtcctggcgtgggtcggccggtcctccgagtacgtcgggtccctcgcccngctgacgngcgtgacgtacggcggtccgggccgagggtacgttagggtacgaacggtcccgttaccggaccgtcccgtcgtacccgtacgtaccgtcgactacgttcgttcgtacggtcggtccgtcctaccgatcgcgtacgtacgtaccttaacgttacgtttcggttcggtcgggtacttaccggaccgaccggccggtaacccggacccggggtaagggggacgggtcgtacgggttaggtcgggttacgttaggttaccgttacgttacgaagggtcgtacgacctacctaccgtaaccgtaacccaccgttaccgaacggtacggaccgtaacaccgtactacggtaccgtacgaacgtaaaccgcgtaaaccgtaactaccgttaacgttcccgacttacggacttcgaacgttcgacgtccgacggtcgacccgtatacggcgtacggtacgtcttacgttcgttntccggtaggaccgtccggtacggcccgtgtaccgtcggttacggttcttacggttgtaaccgtttcggtacgttgcgggttaccggaccgggttacgggaactacggtaacggtctccgggtcccttaacggttaccc

SEQ ID NO: 127061 - DNA, 815 bp, Homo sapiens
  misc_feature: GYAE6OF01C3RV8.48.59.F04.1.454.CMB.1.raw
  modified_base (185)..(185): a, c, t, g, unknown or other
  misc_feature (185)..(185): n is a, c, g, or t
  modified_base (347)..(347): a, c, t, g, unknown or other
  misc_feature (347)..(347): n is a, c, g, or t
  modified_base (403)..(403): a, c, t, g, unknown or other
  misc_feature (403)..(403): n is a, c, g, or t
tcagagtatacatacacgaccggtgctcgatttagtacacacacttagggagttgggggcttttctgagagtcatggatctcatgtgacaaaagaaaatgaagcctaccgtgttcggtttccttcctccgtggcgtgggtcggccggcctacccagtagtcgggtcctcgtacccagcgtcgacngcgtgacgagggtaccggcccggccgaaggtagtggtacgacgtccggttaccggaaccgccccgttccgtccccactaccgtcgcctacgttcgttccgtcggtcggccgtacctaccacgtcgaacgtcgaacgtacgtacgtttaccgttcggtcgggnggtcgtaccggaccgtcccggaccgacccgggaccggagggggtacggcggtaggnggtacggtagtacggttacgttaacctacgaggtaggacgactaccgtaaccgtacctaacccgtacccgtacgaaacgaacggcggacacgacgtataccgtacgtacgactaacgtaccaaagtaaccctacgtactcccgaaggtacgcgtacgtacgtcctacgggtaccggccgaaccccgtcgaacgaacccggtcgaccgttggtttcctaacgtttaccgccggttacgggtaccggaccccgggacccgggttacccgaccggacggtttacggtccggttttcggttttaaccgtttagaccccgttttagttcggtaaggttacggtccggggtacggggttaacccggaaacgggtaccgggaaagttcccggttacccgttaccgtccgtttaacccgg

SEQ ID NO: 127062 - DNA, 440 bp, Homo sapiens
  misc_feature: GYAE6OF01BL6WI.48.59.F04.1.454.CMB.1.raw
  modified_base (406)..(408): a, c, t, g, unknown or other
  misc_feature (406)..(408): n is a, c, g, or t
  modified_base (410)..(411): a, c, t, g, unknown or other
  misc_feature (410)..(411): n is a, c, g, or t
  modified_base (413)..(440): a, c, t, g, unknown or other
  misc_feature (413)..(440): n is a, c, g, or t
tcagagtatacatacacgaccggtgctcgatttagtacacacacttagggattgggagtatttaccacagtgggagcacctactacaacccgtccctcaaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggggccaagggacaatggtcacgtctcttcagcctcaccaagggcccatcggtctccccctggcaccctcctccaagacgcacctctgggggcacagcggccctgggctgcctggtcaaggactacttcctatcgtatactctgagcggctggcaaggcgcagtagnnngnncnnnnnnnnnnnnnnnnnnnnnnnnnnnn

SEQ ID NO: 127063 - DNA, 858 bp, Homo sapiens
  misc_feature: GYAE6OF01CKNQE.48.59.F04.1.454.CMB.1.raw
  modified_base (153)..(153): a, c, t, g, unknown or other
  misc_feature (153)..(153): n is a, c, g, or t
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
tcagagtatacatacacgaccggtgctcgatttagtacacacacttagggattggggctttctgagagtcatggatctcatgtgacaagaaatgaagcactgtgttctccgtctgcgtggtgcgctccaagagtcggtcctacgtcccagtcncgcgacgcgtacgaccggaagggtaccggtccggtaccgacggtcgtagggtacgacggtccgttacggaacgtccctccggtacctacggacncgtccgtacgttaccgttcgtacgtcgtcgacctaccggtnaccgaagcgtaacgcttaacggtacctttagtccggtaggggtacctacggttccgacccggtaacccgtacccggtaaccccggtaagggggtaaccggtcggtaaacgggtacggttaagttacggggttacgtacgtttaaacgttccggaagttaacgggcgaacctacgaaccgtacgtaacccgtaacccgttagaaaccgtacggacgtaccaaacggtctaacggtactaacggaacctacgttaacggacctaaaggtaaccttccgtaccggtacacgtaacgtcgagtacgtcctacggtacgtaccggaccgaacgtaacgtaccgtaccgtacgtaaccgttacgggtaacttcggtttaacggaccgttacgggtaacccggtcccggtaacccggtagttaaccgggtacgtttaccgggttaccgtttacggttaaacccggtggtttaacccgtacgtttaggtaaccggttacgggttaaccgggttaacgtaaccccggggtaaacgtaacggttaacggttaacccgttccgtaaccccggttttaccgg

SEQ ID NO: 127064 - DNA, 409 bp, Homo sapiens
  misc_feature: GYAE6OF02H1VH2.48.59.F04.1.454.CMB.1.raw
  modified_base (404)..(409): a, c, t, g, unknown or other
  misc_feature (404)..(409): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggctacttcctatgtatactctgagcgggctggcaaggcgcatagnnnnnn

SEQ ID NO: 127065 - DNA, 502 bp, Homo sapiens
  misc_feature: GYAE6OF02G7D2P.48.59.F04.1.454.CMB.1.raw
  modified_base (476)..(476): a, c, t, g, unknown or other
  misc_feature (476)..(476): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattggggagtatttaccacagtgggagcacctactacaacccgtccctcaaagtcgaggcaccatatccgtagacacgtccaagaaccaattctccctgaagctgagctctgtgaccgccgcagacacggctgtctattactgtgcgaggccccgagcgcagtgcttttgatgctttgatntgtgggcaagggcaagtggtcacgtc

SEQ ID NO: 127066 - DNA, 556 bp, Homo sapiens
  misc_feature: GYAE6OF02H3K3G.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcacgcagactggaccctgaacgtattttgctagtgtattactgtcagctagtagtggtagctcgaccgatctaccttcggaccaagggacacgacgtggacgtacgttaaccgagtcgtaggccgtagaccactacttcgtcgttccttacacttcccgttaccccgccttactccttacggacttacgtacgttaaccg

SEQ ID NO: 127067 - DNA, 551 bp, Homo sapiens
  misc_feature: GYAE6OF02IBY6C.48.59.F04.1.454.CMB.1.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
tcagagtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctnatctacggtncatccagcagggccactggcatcccagacaggttcagtgcaggtggtctgggacaggacttcactctcaccgtnagcagactggaccctgaagattttgctagtgtattactgttcagcagtatggtagctcaccgactcctaccgttcggaccaaagggaccaacgtacgtaggacgtacgttaaccgaacgtacggtacggtcgtacgaccgaccgtacttccgttacgttccttacctattaccccg

SEQ ID NO: 127068 - DNA, 452 bp, Homo sapiens
  misc_feature: GYAE6OF02G6CPX.48.59.F04.1.454.CMB.1.raw
  modified_base (422)..(452): a, c, t, g, unknown or other
  misc_feature (422)..(452): n is a, c, g, or t
tcagagtatacatacacgaccggtgctcgatttagtacacacacttagggagttggggagtatttaccacagtgggagcgacctactacaacccgtccctcaaaagtcgaggccaccatatcccgtagacacgtccaagaaccaattctccctgaagctgagctctgtgaccgccgcagaccacggctgtctattactcgtgcgaggcccccgagcgcagtggctttttgatgcctttgatatgtggggaccaagggacaagtggtcaccggtctcttcagcctccaccaagggccccatcggtcttccccctggcaccctcctccgaagacgccaccgtctcgggggcacgagcggccctgggctgcctggtcaaggactacttcctctctcgactctgagcgggctggcaggcgcatagnnnnnnnnnnnnnnnnnnnnnnnnnnnnnnn

SEQ ID NO: 127069 - DNA, 501 bp, Homo sapiens
  misc_feature: GYAE6OF02HISHM.48.59.F04.1.454.CMB.1.raw
  modified_base (464)..(464): a, c, t, g, unknown or other
  misc_feature (464)..(464): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgctagtgtattactgtcagcagtatggtagctcaccgatcaccttcgccaagggacacgactggagattaaccgactgtagcngcacatctgtcttcatcctccgcatctgactatgtac

SEQ ID NO: 127070 - DNA, 665 bp, Homo sapiens
  misc_feature: GYAE6OF02G1D4D.48.59.F04.1.454.CMB.1.raw
  modified_base (212)..(212): a, c, t, g, unknown or other
  misc_feature (212)..(212): n is a, c, g, or t
  modified_base (569)..(569): a, c, t, g, unknown or other
  misc_feature (569)..(569): n is a, c, g, or t
tcagagtatacatacacgaccggtgctcgatttagtacacacacttagggtagtttggggggctttctgacgagtctagtggtactactctatgtgcaagaaaatgaagcactgtgttcttcctcctgctggtggcggtcgtccagatgggtcctgttcccagctgctagtactgcaggagtcgggccaggactggtgaagccgttcggganacctgtccctgacctgcactgtctctggtgctccatccagcagctagtacttacttcgtgggtcttcggactccgcccacggacccccggaagggggaacgggtcgtagggtacggttgggacgttacgggtaacgttaaacgtttaccgaacggtaggtacgggacgtacgtaacctaaccgttaaccgaaccccgttacccgtaacgaaaaacggtcggacggactaacgtactactaccgtacgaccaacgtaccaaacgtaacctaactttccaccgtagaaacgtctagactctctagtacgtaccgacgacacgacacggctacgtcttactacgtgtcgtcgacgtcccngtccgacgaggtcgtcgttttcgacgttcgtacttagtacgtaacgttggttacgggaccgtagggtaacctaaggtccggtacctacccgttccg

SEQ ID NO: 127071 - DNA, 849 bp, Homo sapiens
  misc_feature: GYAE6OF02J24EQ.48.59.F04.1.454.CMB.1.raw
  modified_base (177)..(177): a, c, t, g, unknown or other
  misc_feature (177)..(177): n is a, c, g, or t
  modified_base (247)..(247): a, c, t, g, unknown or other
  misc_feature (247)..(247): n is a, c, g, or t
tcagagtatacatacacgaccggtgctcgattagtacacacactagtatggtaagacaatgggtttgattcagattaccatggtgacttctgttgtattccaatctcagactcgccccggagaacttgtgttgacgcagtcctccagaccaccctgtctttgtctccgagggaaacncgcctaccttctcctgcaggtccagtcagtacgttaccttaccaacgtacttactacgccctggtacccntaccgaacgtaacccgtggacccaggccctcccgaggtcctcctcactcctacggtcgctacacccgagccgtaacgggccctacgttcggacctaccgtaccccgtaaggtaaccgttaggttcgtaaggttcgggtacccgtaagggttcggggtaccgtacggggtaaccctacggtaccctttaccgtacccgttacccgtacccgtaaccccggttccgaaccggtacccgtaacggtaacccgttaccggggtaaaccccctttaggtaaaccggtttacttttacggaccgttagggtttaacgtttaaccgttttaacgttccggtaaccgaacggttaccgtaagggtttaacgttacgggtaccctaccgtaacccgtaaccggttacctacccggtaacccgtacccgggaaccgtaacgggaccgtaacgtacggttacgaacgttaaccgttaacccggacgttacggccggtctacccggaccctactaccgtttccgtaccgttacccttcccgtaaaccgtttccccgttacccgtccgtttaacgttacccggttagtttaaccttacggtaccgtttaacccgg

SEQ ID NO: 127072 - DNA, 408 bp, Homo sapiens
  misc_feature: GYAE6OF02I6N4X.48.59.F04.1.454.CMB.1.raw
  modified_base (403)..(408): a, c, t, g, unknown or other
  misc_feature (403)..(408): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggctacttcctctctcgactctgagcgggctggcaaggcgcatagnnnnnn

SEQ ID NO: 127073 - DNA, 524 bp, Homo sapiens
  misc_feature: GYAE6OF02GHP3S.48.59.F04.1.454.CMB.1.raw
  modified_base (375)..(375): a, c, t, g, unknown or other
  misc_feature (375)..(375): n is a, c, g, or t
  modified_base (465)..(465): a, c, t, g, unknown or other
  misc_feature (465)..(465): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggacgtcgggcccaggactggtgaaggccttggagaccctgtccctgacctgccactgtctcgtggtgctccatcagcagcagtacttacttctgggctggactccgccacgccccgagggagggctggagtggagttgggagtatttaccgacaggtgggagcaccgtactaccaacccgtccctacaaaagtcgaggcacatatccgtanacacgtacaacgaaccatcctcctagaagctgagctctgtcgaccgccgcagacacgctcgtctattacgtgtcgcgcggcccgagcgcngtgctttttgattgtctttgattgtggtgggacgaagggacgagtcggtactaccgttc

SEQ ID NO: 127074 - DNA, 415 bp, Homo sapiens
  misc_feature: GYAE6OF02IN6GR.48.59.F04.1.454.CMB.1.raw
  modified_base (318)..(318): a, c, t, g, unknown or other
  misc_feature (318)..(318): n is a, c, g, or t
  modified_base (405)..(415): a, c, t, g, unknown or other
  misc_feature (405)..(415): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagngcacctctgggggcacagcggccctgggctgcctggtcaaggactacttcctctctcgactctgagcgggctggcaaggcgcatagnnnnnnnnnnn

SEQ ID NO: 127075 - DNA, 557 bp, Homo sapiens
  misc_feature: GYAE6OF02G8RXV.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacaggacttcactctcaccgtcagcagactggaccctgaagtattttgctagtgtatttactgtcagctaagtatggtagctcaccgtatccaccgttcgaccgaacgggaccaacggacgtagggaacgtaacgttaaacccgaacttcggtacggctcgaccaccgtactccgttgtccttacacttccttcccgacctacttctagtacttatgttaac

SEQ ID NO: 127076 - DNA, 566 bp, Homo sapiens
  misc_feature: GYAE6OF02GOXES.48.59.F04.1.454.CMB.1.raw
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
tcagagtatacatacacgaccggtgctcgatttagtacacacacttagggattggggaagacaagtgggtttgattcagattacatgggtgacttttctgttgtatttccaatctcgacgatgccccccggagaaacttggtgttgacgtcagtctccagacaccctgtctttgctccagggaanagccaccttcncctgcaggtccagtcagagtcttaccaacgactacttagcctggtaccatcagaacctggccaggctccaggctcctcatctacggtgcatccagcagggccacgtggccatcccagacagttcagtgcagtggtctgggacagtacgttcactctacaccgtcagcagactgaccctggaacgtattttcgctagtgtacttacttgtcagcagtatggtagctcacgattcaccttcgaccaagggacacgacgtggaatacgttaacccgaacttcgtacggtcgtacgaccgtaccaacgtcgttcggtaccttacgaacttcccgttacccgacctacgttcctacggtacttacgtagtttaac

SEQ ID NO: 127077 - DNA, 415 bp, Homo sapiens
  misc_feature: GYAE6OF02F6YCN.48.59.F04.1.454.CMB.1.raw
  modified_base (409)..(415): a, c, t, g, unknown or other
  misc_feature (409)..(415): n is a, c, g, or t
tcagagtatacatacacgaccggtgctcgatttagtacacacacttagggattgggagtatttaccaacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggccaccctcctccaagagcacctcgtcgggggcacagcggccctgggctgcctggtcaaggactacttcctatgtatactctgagcgggctggcaaggcgcatagnnnnnnn

SEQ ID NO: 127078 - DNA, 421 bp, Homo sapiens
  misc_feature: GYAE6OF02GDFZ8.48.59.F04.1.454.CMB.1.raw
  modified_base (407)..(421): a, c, t, g, unknown or other
  misc_feature (407)..(421): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggccaccctcctccaagagcacctctgggggcacgagcggccctgggctgcctggtcaaggactacttcctatgtatactctgagcgggctgggcaggcgcatagnnnnnnnnnnnnnnn

SEQ ID NO: 127079 - DNA, 408 bp, Homo sapiens
  misc_feature: GYAE6OF02GUYXJ.48.59.F04.1.454.CMB.1.raw
  modified_base (405)..(408): a, c, t, g, unknown or other
  misc_feature (405)..(408): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatactctgagcgggctggcaaggcgcatagnnnn

SEQ ID NO: 127080 - DNA, 516 bp, Homo sapiens
  misc_feature: GYAE6OF02IIALS.48.59.F04.1.454.CMB.1.raw
  modified_base (416)..(416): a, c, t, g, unknown or other
  misc_feature (416)..(416): n is a, c, g, or t
  modified_base (460)..(460): a, c, t, g, unknown or other
  misc_feature (460)..(460): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgagattttgcagtgtattactgtcagcagtatggtagctcacgntcaccttcggccaacgggacacgactggacgacttaacgactgnggctgcaccatcctgtcttcctacttccttccccgcacttcctgtactactgttac

SEQ ID NO: 127081 - DNA, 791 bp, Homo sapiens
  misc_feature: GYAE6OF02IQ3NL.48.59.F04.1.454.CMB.1.raw
  modified_base (283)..(283): a, c, t, g, unknown or other
  misc_feature (283)..(283): n is a, c, g, or t
tcagagtatacatacacgaccggtgctcgatttagtacacacacttagggattgggggctttctgacgagtcagtggatctcatggtgcaagaaagtcgaagcacctgtcgttcgtcctcctgctggtgcggctcccagagtgggtccctgtcccagctgccagtctacgcgaggcgtccgggccccaggacttggtgaacgccctttcggagacccgtgtcccctgacctgcctactgtctcgtaggtgctaccgatcagctagtcacgtacgttacttcgngggcctggaactccggaccaacgcccccgaaggggaacgggtcctaggagtcggtaagttgggaattactttaccgacgtaggttagggagtccgtaaccggtacctaacgtaaccccggtaccgtacgaaaacggtccgacggacctaccgaatacgttaccggacgaacgtaccgttaccaaacgtaacctaactacctacccgtacgaagtacccgtaggaccgtacgtccgtacggtaccggtaacccgaccggtaccgttaacggaaccgtaaccgggtccttacggttaccgttaacgttaaacccgttacggttaccgtaacccggtaaccggtacccccgtaaagtacccgggtacgttaaccggggttaccgttaccggtttttaccgggaacgtttacccgggttaacccgtttacggtaacgttaacggttcgggtaccggggtaaccgtaacggggtaaccttaaacgggtcccggtttagaccccggttttaccg

SEQ ID NO: 127082 - DNA, 559 bp, Homo sapiens
  misc_feature: GYAE6OF02GOPJU.48.59.F04.1.454.CMB.1.raw
tcagagtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcactccagcgagggccacgtggcactcccagacgtaggttcaggtcggcaggtgggtcgtgggacagacttcgactctcaccgtcacgcagacgtcggaccctagaacgtattttcgcgtagttagttacttacgttgtacagctagtagtggtagctacgaccgtactacctaccgttcggaccgaacggacgacgacgtaggagtacgtaaccggaacgtcggtcggcgtcgcacctatctgtcttcacttcccg

SEQ ID NO: 127083 - DNA, 510 bp, Homo sapiens
  misc_feature: GYAE6OF02F5O4Y.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtaggctgcaccatcgtgtcttcattcttcccgctactctgactatgtaac

SEQ ID NO: 127084 - DNA, 577 bp, Homo sapiens
  misc_feature: GYAE6OF02HZ2WI.48.59.F04.1.454.CMB.1.raw
  modified_base (480)..(480): a, c, t, g, unknown or other
  misc_feature (480)..(480): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccacgcccccagggaagggctggacgtggattgggagttatttaccacgtaggtggggagacacctacctaactaacccgtccctacaaaagtcgaggccaaccatactcgtagacacgtccaaagaaccaattcctccctagacgtctgagtctctgtcgaccgccgcacgacacggctcgtacttatacgtgtcgcgacggccccgagccgngtacgtaggtctttttgacttcggtaccttttggattaacggttcggtacggggtaccgaaggggaactaacggtttcggtaccgtaccgttacccg

SEQ ID NO: 127085 - DNA, 539 bp, Homo sapiens
  misc_feature: GYAE6OF02HXDRV.48.59.F04.1.454.CMB.1.raw
  modified_base (474)..(474): a, c, t, g, unknown or other
  misc_feature (474)..(474): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcagactggaccctgaagtattttgctagtgtattactgtcagcagtatggtacgctcaccgtatccaccgttcgaccgaagggaccacgacgtggaagtacgtaaccgaattcggnggcgtagaacctatcgtcgtcttactacgttccttcccgcctactcctgtatacttgtattaccg

SEQ ID NO: 127086 - DNA, 534 bp, Homo sapiens
  misc_feature: GYAE6OF02G93BE.48.59.F04.1.454.CMB.1.raw
  modified_base (302)..(302): a, c, t, g, unknown or other
  misc_feature (302)..(302): n is a, c, g, or t
tcagagtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtncatccagcagggccacgtggcatcccagacaggttcagtgcagtgggtctgggacagacttcactctcaccgtcagcagactcggaccctagaagtatttgctagttgtattactgttcagcagtagtggtagctcaccgactcctaccgttcggaccgaacgggaccacgacgtaggagtaacgtaaccgtaacgtgtcggctgacaccgattcctgtcttctacttcccg

SEQ ID NO: 127087 - DNA, 666 bp, Homo sapiens
  misc_feature: GYAE6OF02IOAK0.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtgggctggatccgccacgcccccgagggaacgggctggagtggtatgggagttactttaaccgacgtaggtagggagctaacctactaaccgaacccgtccctacgaaaagtccgaaggaccaacctatacttaccgtaagaccacgtacccaaagtaacccaattccgtaccctagaacgtacctagacgtcctcgtgtacgacccggaccgacacgaccgaccggtcttacggtaccttaactttaccgtcgtaggcccgaacgggtcccccgaagcccggtacaacggttcgggttcgtttttacgacgttcggttcccgttttaggtacgtttaacgttcgggtttacgggggaaccccgtaaggggtaaccgttaaacggtcgggttacccgtaacccgtttcccgg

SEQ ID NO: 127088 - DNA, 574 bp, Homo sapiens
  misc_feature: GYAE6OF02IFHH4.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggactccgccacgccccccgaggggaacggggctgggaggtggtaagttgggtagttactttaccacgtagtgggagcacctactacaacccgtcctacgaaacgtcgacgcaccatactccgtagacacgtaccaagaaccaatttcctaccctgaacgctagagtctctcgtcgaccgccgacgagaccgacggctagtactattacgtgtcgcggacggaccccgagccgctacgtcgtctttttcgattgtccctttgattagtcggtacgggtaccgaagggtacgtaagtcggtccctaccggttcc

SEQ ID NO: 127089 - DNA, 605 bp, Homo sapiens
  misc_feature: GYAE6OF02HK16R.48.59.F04.1.454.CMB.1.raw
  modified_base (330)..(330): a, c, t, g, unknown or other
  misc_feature (330)..(330): n is a, c, g, or t
  modified_base (375)..(375): a, c, t, g, unknown or other
  misc_feature (375)..(375): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagcagtacttacttcgtggggctggactccgccacgccccgaggggacgggctggagtggagttgggattactttaccacgaggtgggacncacctactaccaccgtcctacaaagtcgacgcacatactacgtanacacgtaccaaagaaccaacttcctaccgtagaacgtctagacgtctctggtcgaccgccgacacgacgacggcttcgtacttacttacgtgtcgaccggaccggcccgagccggacgtacggttgggttccgtttttagactttcgggttcccttttaggaacgtttggttcgggtacggggtaccgtaaacggggaccttaaggttcggttacccgtaccggtttccg

SEQ ID NO: 127090 - DNA, 527 bp, Homo sapiens
  misc_feature: GYAE6OF02F1CPC.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtcctacaaacgtcgagcaccatactccgtagacacgtccaagaaccaattcctaccctagaacgctgacgctcgtgtcgaccgccgcacgacgacgctgtctattactgtgcgcggcccgagcgcagtgtcttttgatgtcctttgattagtcggtgggaccgaagggtactaagtcggtacctacgtc

SEQ ID NO: 127091 - DNA, 408 bp, Homo sapiens
  misc_feature: GYAE6OF02G4W1J.48.59.F04.1.454.CMB.1.raw
  modified_base (404)..(408): a, c, t, g, unknown or other
  misc_feature (404)..(408): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttcccccctggcaccctcctccaagagcacctctgggggcacagcgcctgggctgcctggtcaaggactacttcctatgtatactctgagcgggctggcaaggcgcatagnnnnn

SEQ ID NO: 127092 - DNA, 524 bp, Homo sapiens
  misc_feature: GYAE6OF02I0L08.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaacggggctggagtggattgggagtatttaccacagtgggagcacctactacaacccgtccctacaaaagtcgagcaccatatccgtagacacgtccaagaaccaattcctccctgaagctgacgctctgtcgacccgccgcagacacggctgtctattactgtcgcgacggcccgagccgcagtgtcttttgatcgtcctttgatgtggtgggaccgaagggacaagtcggtccaccgttccg

SEQ ID NO: 127093 - DNA, 515 bp, Homo sapiens
  misc_feature: GYAE6OF02G09T8.48.59.F04.1.454.CMB.1.raw
  modified_base (320)..(320): a, c, t, g, unknown or other
  misc_feature (320)..(320): n is a, c, g, or t
  modified_base (405)..(405): a, c, t, g, unknown or other
  misc_feature (405)..(405): n is a, c, g, or t
  modified_base (482)..(482): a, c, t, g, unknown or other
  misc_feature (482)..(482): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggagggctggagtggagttgggagtatttaccagagtgggancacctactacacccgtcctacaaagtcgaggcaccatactccgtagacacgtaccaaagaacctaattcctaccctgaagctganctctgtcgaccgccgcagacacggctgtctattactgtcgcgacggcccgagcgcagtcgtcttttgctgtccgttnatgtcggtgggacagggtacagtggtcaccgtc

SEQ ID NO: 127094 - DNA, 633 bp, Homo sapiens
  misc_feature: GYAE6OF02GSBNH.48.59.F04.1.454.CMB.1.raw
tcagagtatacatacacgaccggtgctcgatttagtacacacacttagggagttgggggctttctgagagtcatggatctcatgtgcaagaaaatcgaagcacctgtggttcttccgtcctgctggtggcgctccagatgggtcctgtcccagctgcagctgcaggacgtcgggcccaggactggtgaagccttcggagaccctgtccctcacctgcactgtctctggtcgctccatcagcagcagtacttacttctagggtctggactccgccacggcccccgagggaacgggcctgggagtggagttggggagttactttaccacgtaggtcgggagctaaccgtaactaaccgaacccgttccctacgaaaacggtcgaggcaaccgatacgtaccgtagaccacgtacctaaacgaaccctaactttcctaccctagaacgctagacgtctctcggtcgaccgcgacacgacgacggctgttctattcgtgtcgcgacggcccgagtccgcgtacgttcggttctttttacggacgtttcggtaccgttttaggacgttacggtacgggttacggggtaaccgtaaacgggggtaacctaagggtttcggtaccgtacccggttacccg

SEQ ID NO: 127095 - DNA, 547 bp, Homo sapiens
  misc_feature: GYAE6OF02GBE7L.48.59.F04.1.454.CMB.1.raw
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggacggggctgggagtggagttgggagtatttaccacgagtgggagcactactaccaccgtcctacaaagtcgagcacatatcgtagacacgtaccaacgaaccacttcctccctagaacgctagagctctgcgaccnccgacagacncggctgtactattacgtgtgccgacggccccgagccgcgagtggtctttttagagttcgtccgtttgattagtggttcggggtacccgaagggtaccgtaagtcgggtaccaccggttccg

SEQ ID NO: 127096 - DNA, 526 bp, Homo sapiens
  misc_feature: GYAE6OF02GHCEB.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgcagcccccgagggaagggctggagtggagttgggagtatttacacgagtgggagcacctactacaacccgtcctacaaagtcgaggcaccatactcgtagacacgtccaagaaccaattctccctagaacgctgagctctgtcgaccgccgcacgacacggctgtctattactgtgcgacggcccgagcgcgagtggtcttttgatcgtcctttgattgtggtcgggacctaagggaccaagtcggtaccgtacgttccg

SEQ ID NO: 127097 - DNA, 585 bp, Homo sapiens
  misc_feature: GYAE6OF02GZ6VF.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggatcccgccacgcccccgaggggaacggggctgggagtggagttgggagttactttaccacgaggtgggagcaacctactaccaacccgtaccctacaaacgtcgacggacaccatactaccgtaagacacgtaccaaacgaacctaactttcctaccctagaacgtctagacgtctcgtggtccgacccgccgacgacgacaccggctgtctattactgtcgcgacggcccgagccgacgagtgtcttttagagttcgtcctttagacgttagtgggttacgggaccgtaacgggtactaacggtcggtaccgtaccggttc

SEQ ID NO: 127098 - DNA, 537 bp, Homo sapiens
  misc_feature: GYAE6OF02G2NH3.48.59.F04.1.454.CMB.1.raw
  modified_base (325)..(325): a, c, t, g, unknown or other
  misc_feature (325)..(325): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagccccccagggaacggggctggagtgggattggggagtatttaccacagtgggancacctactacaacccgtccctcaaaagtcgaggcaccatatccgtagacacgtccaaagaacccaattcctaccctgaaacgctgagctctgtcgacccgccgcagaccacggctgtctattactgtgcgaggccccgagccgcagtggtcttttgattgtcctttgattatggtggggccaaggggactaagtcgggttaccaccgttccg

SEQ ID NO: 127099 - DNA, 425 bp, Homo sapiens
  misc_feature: GYAE6OF02GZNL6.48.59.F04.1.454.CMB.1.raw
  modified_base (415)..(425): a, c, t, g, unknown or other
  misc_feature (415)..(425): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggccaccctccctccaagacgccacctcgtcgggggcacgagccggccctgggctggcctggtcaaggactacgttcctatgtatactctgagcgggctggcaaggcgcatagnnnnnnnnnnn

SEQ ID NO: 127100 - DNA, 539 bp, Homo sapiens
  misc_feature: GYAE6OF02JBJCG.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcgccgtcagcagactcggaccctgaagattttgctaggtgtattactgtcagcagtatggtagctcaccgatccacctcggaccaagggaccacgacgtgggagtacgttaaccgactgtcggctgccaccatcgtcgtacctttcacttccgttacccggctacttaccgtgtaacttcgttagttaac

SEQ ID NO: 127101 - DNA, 613 bp, Homo sapiens
  misc_feature: GYAE6OF02IXDA1.48.59.F04.1.454.CMB.1.raw
  modified_base (375)..(375): a, c, t, g, unknown or other
  misc_feature (375)..(375): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccacgcccccgagggagggctggaggtggtagttgggagtatttaccagaggtgggacgcaccgtactaccgaacccgtccctacaaaagtcgaggcacatactcgtanacacgtaccaacgaacctaattcctacccgtagaacgctagacgtcttcgtgtacgaccgccgacgacgacaccggcttcgtacttaattacgtacgtgtaccggacggaccccgtagccgcgtaacgttcgggttcctttttaggacgtttgtacccgtttttaggaactttacgtcggggttacgggaacccgtaaacggggtaacgtaaggttcggttaccgtacccgtttcccg

SEQ ID NO: 127102 - DNA, 531 bp, Homo sapiens
  misc_feature: GYAE6OF02HR4SR.48.59.F04.1.454.CMB.1.raw
  modified_base (320)..(320): a, c, t, g, unknown or other
  misc_feature (320)..(320): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtgggctggatccgccacgcccccgagggacgggctggagtggagttgggatattaccagagtggancacctactacacccgtccacaaagtcgaggcacatactcgtagacacgtaccaaagaacctaattcctaccctagaacgtctgacgctcgtgtcgaccgccgcgacgacacggctgtactattacgtgtgcgacggcccgagccgacngtcgtnttttgacgttcgtctttgatgtggtcgggaccgagggtactagtcggtcaccgttcg

SEQ ID NO: 127103 - DNA, 557 bp, Homo sapiens
  misc_feature: GYAE6OF02GZ4UF.48.59.F04.1.454.CMB.1.raw
  modified_base (378)..(378): a, c, t, g, unknown or other
  misc_feature (378)..(378): n is a, c, g, or t
tcagagtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcactcccagacaggttcagtcggcaggtgggtctgggacagacttcactctcaccgtnagcagctcgaccctgtaagtatttgctagtgtattactgtacagctagtagtggtacgctacgaccgtatccgtaccgttcggaccgaacgggacaacggacgtaggacgtaacgttaaccggtaacgttacggtacggtcgtcgacaccgtattccgttcgttacttcgtacttcccg

SEQ ID NO: 127104 - DNA, 514 bp, Homo sapiens
  misc_feature: GYAE6OF02HZW5W.48.59.F04.1.454.CMB.1.raw
  modified_base (423)..(423): a, c, t, g, unknown or other
  misc_feature (423)..(423): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccaactggcatcccagacaggttcagtggcagtggggtctgggacaggacttcactctcaccgtcagcagactgaccctgaacgattttgcagtgtattactgtcagcagtatggtagctcaccgtancaccttcggccaaagggcacgactggagattaaccgaatgtggctgactaccatctgtcttcactcttcccgcctactctagatatgtaac

SEQ ID NO: 127105 - DNA, 525 bp, Homo sapiens
  misc_feature: GYAE6OF02G2IN2.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagacccctgtccctcacctgcactgtctctggtggctccatcagcagcagtacttacttctggggctggatccgccagccccccagggaaggggctggagtggattggggagtatttaccacagtgggagcacctactacaacccgtccctcaaaagtcgaggcaccatatccgtagacacgtccaagaaccaattctccctgaacgctgagctctgtgaccgccgcagacacggctgtctattactgtgcgaggccccgagcgcgagtgtctttttgattgtcctttgattagtggtgggccgaagggacctaagtggtccaccgttcc

SEQ ID NO: 127106 - DNA, 567 bp, Homo sapiens
  misc_feature: GYAE6OF02IPS1I.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccagcccccaggggacgggctggagtggagttgggagtatttaccgacgtaggtgggagcgaacctactaaccaacccgtccctacaaaacgtcgacggcaaccatactccgtagacacgtccaagaaccaattcctccctagaagctgacgctctgtcgacccgcgcagaccacggctgtcttattacgtgtcgcgacggccccgagccgctagtcggttctttttggacttcggtccttttaggacttagttcggttcggggaccaaggggtaccaaggttcggtaccgtacccgttcg

SEQ ID NO: 127107 - DNA, 508 bp, Homo sapiens
  misc_feature: GYAE6OF02FJW64.48.59.F04.1.454.CMB.1.raw
  modified_base (390)..(390): a, c, t, g, unknown or other
  misc_feature (390)..(390): n is a, c, g, or t
  modified_base (446)..(446): a, c, t, g, unknown or other
  misc_feature (446)..(446): n is a, c, g, or t
  modified_base (480)..(480): a, c, t, g, unknown or other
  misc_feature (480)..(480): n is a, c, g, or t
tcagagtatacatacacgaccggtgctcgatttagtacacacacttagggattgggggaagacaatgggtttgattcagattacatgggtgacttttctgttgtatttccaatctcagatgccccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactcggaccctgaagtattttgcagtntattatgtcagcagtatggtagctcaccgatcaccttcgcaagggacacgatgganacttaaccgaatgtggctgcaccatctgtcttcncttccttcccgctatcctgactatgtac

SEQ ID NO: 127108 - DNA, 637 bp, Homo sapiens
  misc_feature: GYAE6OF02GNSFM.48.59.F04.1.454.CMB.1.raw
tcagagtatacatacacgaccggtgctcgatttagtacacacacttagggattgggggctttctgagagtcatcggatctcatgtgccaagaaatgaagcacctgtgttcttcctcctgctggtgcggctcccagatgggtcctagtccagctgcagctgcaggacgtccgggcccaggactggtgaacgccgttacggagaccctgtccctcacctgcactgtctctggtgctccatcagcagcagtacttacttactgggctggactccgcacgcccccgagggaacgggctggagtggagttgggacgtacgtttaccgacgtaggtcggggtagcctacccgtaacgtaccgtaaacccggtccctacgaaaaacggttccgaacggtaccaccgaataacgtccgtaacgacctaccgtacccaacgaaacctaacttacctacccgtagaacggtctacggtacgtctacgttgttcggaccgtccgtacacgacgtacggctgtactacttactgtcgcgcggcccgagcgtcgagtcgtcgttttagacgttggtacccgtttagtaacgttagttcgggtacggggtaccgtaagggtaccctaaggttcggtaccgtaccgttcccg

SEQ ID NO: 127109 - DNA, 565 bp, Homo sapiens
  misc_feature: GYAE6OF02FYBX7.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccacgcccccagggacgggctgggagtggagttgggagtactttaccgacgaggtgggagcacctactaccgaacccgtccctacaaacgtcgaggcaccatactccgtagaccacgtaccaaacgaaccaacttcctacccgtgaacgctaggacgtcctcgtgtcgacccgccgacgagaccgacggctagtccttattacgtggtcgcgacggccccgagccgctagtcgtcttttgattcggtcctttagacttgtggtcgggaccgaagggtacaagtcggtaccaccgttccg

SEQ ID NO: 127110 - DNA, 736 bp, Homo sapiens
  misc_feature: GYAE6OF02JKSTK.48.59.F04.1.454.CMB.1.raw
  modified_base (200)..(200): a, c, t, g, unknown or other
  misc_feature (200)..(200): n is a, c, g, or t
tcagagtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccagggaaangccaccttctcctgcaggtccagtcagacgtcttaccaacgtactacttagcctaggtaccatcagaaacctggccaggcctccaggctcctcatcctacggtgcacttccagtccacgggcctacgtcggaccacgtccccgaagtaccgacggtttaccaggtacggctaacgggttcggggtccgtggggtaacctacggtaacctttcgaccttaccgtaccgaacccggttaccgaaccggtccaacgggtaccgtaccgggtaacccgttaggaaacggttacttttacggaccgtagttacggtttaacgtttacgttacggttacgagttaccgtaagttacgtagggttacgtacgttaccgtacccgtaacttcccgtaacccgtttacccgggaccgtaaaccgggtaacgtaaccggtacgttaacggacggttaaccgttaaccggtaacgttaaggttcggaaccgtcgacctaccgtaccgttaccggttacgtttacccgttcgttaccctttaccccgg

SEQ ID NO: 127111 - DNA, 539 bp, Homo sapiens
  misc_feature: GYAE6OF02FJP3P.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagccccccgaggaaggggctggagtggattgggagtatttaccacagtgggagcacctactacaacccgtcctacaaacgtcgaggcaccatactccgtagacacgtcccaagaacccaattcctccctagaacgctgagctctgtcgacccgccgcacgacacggctgtctattctgtgcgacggcccgagcgcagtgtcttttgatcgtcctttgattagttcggtggggtaccgaacgggtaccaagtcggttaccacccgttccg

SEQ ID NO: 127112 - DNA, 411 bp, Homo sapiens
  misc_feature: GYAE6OF02GELKH.48.59.F04.1.454.CMB.1.raw
  modified_base (406)..(411): a, c, t, g, unknown or other
  misc_feature (406)..(411): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttcccccctggcaccctcctccaagagcacctctgggggcacagcggccctgggctgcctggtcaaggactacttcctatgtatactctgagcgggctggcaaggcgcatagnnnnnn

SEQ ID NO: 127113 - DNA, 536 bp, Homo sapiens
  misc_feature: GYAE6OF02GRBR8.48.59.F04.1.454.CMB.1.raw
  modified_base (412)..(412): a, c, t, g, unknown or other
  misc_feature (412)..(412): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccacgcccccagggaacgggctgggagtgggattggggagtatttaccacgagtgggagcacctactacaacccgtcctacaaaagtcgacggcaccatactccgtagacacgtccaagaaccaattcaccctgaacgctagacnctctcgtcgaccgccgcacgacacggctcgtctattactgtgccgacgccccgagcgcagtgtcttttgattcgtcctttgattacgttgtgggaccgaagggtacaagtcggtaccacgttcc

SEQ ID NO: 127114 - DNA, 570 bp, Homo sapiens
  misc_feature: GYAE6OF02HXJV7.48.59.F04.1.454.CMB.1.raw
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccacgcccccgagggaagggctggaggtggagttgggattatttaccacgagtgggagcaacctactaccaacccgtcctacaaacgtcgagcaccatactccgtagacacgtaccaagaaccctaattcctaccctagaacgctgacnctacngtcgacccgccgacacgaccgaccggtctcgtccttaattaccgtaggtcgaccgacgggccccgagccgcgtacggtgtcctttttgacgttcgtcctttagattacgtggtcgggaccaagggactagtcggtaccaccggttaccc

SEQ ID NO: 127115 - DNA, 548 bp, Homo sapiens
  misc_feature: GYAE6OF02FF0MG.48.59.F04.1.454.CMB.1.raw
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (501)..(501): a, c, t, g, unknown or other
  misc_feature (501)..(501): n is a, c, g, or t
  modified_base (506)..(508): a, c, t, g, unknown or other
  misc_feature (506)..(508): n is a, c, g, or t
  modified_base (510)..(514): a, c, t, g, unknown or other
  misc_feature (510)..(514): n is a, c, g, or t
  modified_base (516)..(548): a, c, t, g, unknown or other
  misc_feature (516)..(548): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatcgtcctttgatagtggtcggggaccaagggacaagtcggtcaccgtctccctcacgccctccaccgacgggcccagtccggtccttcccccgtggccncccgtgcctccgaggtacnccaccgtcgagacgccacgtcggccggcccgtgggcctcgccgtagggtaccaacgggtacctttaccgtttcctaagttcgttaacttacccgttcggtacggacggggtacccgggtcgtacggggtaacccgaaacgggcctaccaaggttacggnacgcnnncnnnnncnnnnnnnnnnnnnnnnnnnnnnnnnnnnnnnnn

SEQ ID NO: 127116 - DNA, 572 bp, Homo sapiens
  misc_feature: GYAE6OF02JBK1T.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactcccgccacgcccccgagggaacggggctggagtggagttgggatactttaccgacgaggtgggacgcaccgtactaccaacccgtccctacgaaagtccgaggacaccatactaccgtagaccacgtaccaaagaaccctacttcctccctagaacgcgtgacgctcgtgtcgacccgccgacagaccacggctgtctacttctgtcgcgcggcccgagccgcgtgtcgttcttttgacttcgtccgtttgacttaggtcggtacgggaccgaacgggtacctaaggtcggtaccgtaccgttccg

SEQ ID NO: 127117 - DNA, 592 bp, Homo sapiens
  misc_feature: GYAE6OF02GOSIM.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagcccttcggagaccctgtccctcacctgcactgtctctggtgctccatcagcagcagtacttacttcgtgggctggactccgccacgccccccgaggggaacggggctggaggtggagttgggagtagtttaccacgaggtggacgcaacctactaaccgaaccccgtacctacaaaacggtcgacggaccaccgatactaccgtagacaccgtaccaaacgaacctaacttcctaccctagaacgctagacgtctcgtgtcgacccgccgcacgaccgacggctgtactattactgtcgcgacgccccgagccgcgagttcgtcgttttgatttcgtccgtttagtattaggttcggtacgggtaccgaacgggtactaacggttcggtaccgtacccggttcc

SEQ ID NO: 127118 - DNA, 535 bp, Homo sapiens
  misc_feature: GYAE6OF02FHEM6.48.59.F04.1.454.CMB.1.raw
  modified_base (470)..(470): a, c, t, g, unknown or other
  misc_feature (470)..(470): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagccccccagggaacggggctgggagtggagttgggagtatttaccacagtggggagcacctactaccaacccgtccctacaaagtcgaggcaccatactccgtagacacgtccaagaaccaattcctacctgaagctgagctctgtcgaccgccgcacgacaccggctggtctattactgtgcgacggcccgagcgcgngtgtcttttgagtcgtctttgattagtggtaggggccaagggaccaagtcggtacaccgttaccg

SEQ ID NO: 127119 - DNA, 574 bp, Homo sapiens
  misc_feature: GYAE6OF02HJWG5.48.59.F04.1.454.CMB.1.raw
  modified_base (438)..(438): a, c, t, g, unknown or other
  misc_feature (438)..(438): n is a, c, g, or t
  modified_base (464)..(464): a, c, t, g, unknown or other
  misc_feature (464)..(464): n is a, c, g, or t
tcagagtatacatacacgaccggtgctcgatttagtacacacacttagggagttgggggctttctgagagtcatggatctcatgtgcaagaaaatgaagcacctgtggttcttcctcctgctggtggcggctcccagatgggtcctgtcccagctgcagctgcaggagtcgggcccagggactggtgaagcccttcgggacgaccctgtccctcacctgcactgtctctggtgctccatcagcagcagtacttacttcgtgggctggactcccgccacggcccccgagggacggggctggagtggtagttggggagttagtttaccgacgtaggtgggacgccacccgtaccgtaccgaacccgtaccctacgaaaacgtcgaggaccaccagtactccgtagacacgtaccaagaaccattaccgtccctagtaacncgtagacgctcgtgtacgaccgccgnacgacacggctgtctatactgcgacgacggcccgtagcgcagtcgttctttgagtgtcctttagtactagttggtacgggacgacgggactaggtcggtacgtccgttcg

SEQ ID NO: 127120 - DNA, 533 bp, Homo sapiens
  misc_feature: GYAE6OF02HGWAH.48.59.F04.1.454.CMB.1.raw
  modified_base (424)..(424): a, c, t, g, unknown or other
  misc_feature (424)..(424): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggactccgccacgcccccgagggaacggggcgtggagtggagttggggagttactttaccgacgagtgggagcacctactaccaacccgtcctacgaaacgtcgaggcacatatccgtagacacgtcaagaaccatctcctagagctgagctctgtcgaccncgcagacacgctgtctattacgtgtcgacgcggcccgagccgcgagtcgttctttgatcggtctttgatagtgtacgggcgtaagggactaagtcggtaccaccgttcg

SEQ ID NO: 127121 - DNA, 597 bp, Homo sapiens
  misc_feature: GYAE6OF02G7HB0.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcggctccatcagcagcagtacttacttcgtggggctggactccgccacgcccccgaaggggaacggggcgtggaggtggtagttgggagtagttaccagaggtgggagccacctacgtaaccacccgtaccctacaaacgtcgaggacacatactccgtaagaccacgtaccaacgtaacctaacttcctaccctagaagcgtagacgctcgtgtcgaccgcgcgacgacaccggtctcgtcttacttacgtcggtcgcggtacggcccgacggccgcgtacggtcggttctttttagacgttcgtcctttgtagttagttcggtacgggacggtaacgggtactaacggttcggtaccgtacccgttcg

SEQ ID NO: 127122 - DNA, 675 bp, Homo sapiens
  misc_feature: GYAE6OF02JVK2I.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagctagtacttacgttcgtgggctggactccgccacgccccgagggaggtctggagtggagtgggtagttacgttaccgacgaggtggacgtcctaaccgtaccaaccgtaacccgtacctaacgaaacgtcgaacggacaacctacttacgtaccgtaacgaacctaccgtaccaaacgtaacctacgttccgtacccgtagaacgcgtagacgtccttacgtcgtacgacccgccgacgacgaccgccggtctcgtaccttacgttacgtacggtcgaccggtaccgggaccccgtgcccggtacgtacgggtttcggttcttttacggagtttaccggttccgtttttacgaagtttcggttacggggttaccgggtaacccggtaaacgggtaccgttaacggtcccgggttacccgttaacccggtttccg

SEQ ID NO: 127123 - DNA, 416 bp, Homo sapiens
  misc_feature: GYAE6OF02F9Q18.48.59.F04.1.454.CMB.1.raw
  modified_base (406)..(416): a, c, t, g, unknown or other
  misc_feature (406)..(416): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaaggggacaatggtcaccgtctcttcagcctccaccaaggcccatcggtcttccccctggcaccctcctccaagagccacctcgtgggggcacagcggccctgggctgcctggtcaaggctacttcctatgtatactctgagcgggctggacaggcgcatagnnnnnnnnnnn

SEQ ID NO: 127124 - DNA, 561 bp, Homo sapiens
  misc_feature: GYAE6OF02I4TFG.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactcccgccacggcccccgagggaaggggcgtggagtggagttgggagttatttaccacgaggtgggacgcaaccgtactaccaacccgtcctacaaagtcgacggcacatactccgtagacaccgtacaaacgaaccaacttcctaccctagaacgtctgagctctgtcgacccgcgacgagaccgacgctgtctacgttacgcgtagcgacggacccgagccgcgtacgtcgttcttttgattgtcctttgattacgtggtcgggaccgaggtacgtagtcggtacctccggttcc

SEQ ID NO: 127125 - DNA, 736 bp, Homo sapiens
  misc_feature: GYAE6OF02JYI6A.48.59.F04.1.454.CMB.1.raw
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
tcagagtatacatacacgaccggtgctcgatttagtacacacacttagggattgggggcgtttctgagagtcatggatctcatgtgcaagaaaatgaagcacctgtggttcttcctcctgctggtggcggctcccagatgggtcctgtcccagctgcagctgcaggagtcgggcccaggactggtgaacgtccttcggagaccctgtcccctcacctgccactgtctctgggngcctcccatcagcagcagtacttactgnggctgactccgccncgaccccgagggacgggccgtggacgtggacgttgggtaagttacgttaaccgacgtaggtacgggacgtaccaccgtaaccgtaccgtaaaccccgtcccgtaacgtaaaacggtccggaacgtacccgaacccgacgttaccgttacccggtaagaaccgtaccgtacccgaaaaccgtaaccctaaacgttaccctacccgtagaaaccgtcgttaacggacgttacctcgttaccggtccggaaccccgaccggtaccgacggtaacccgaccgggtaccttacggtaacccgttagtttaaccgttggtaccgggtacccgaccgggtacccccgaaggcccgtacgacggttacggttccgtttttagacgttttacggtccgtttagacggttacgtaccgggttaggaacccggtacgggaacgtacgtacggttacccggtccctttaccgg

SEQ ID NO: 127126 - DNA, 788 bp, Homo sapiens
  misc_feature: GYAE6OF02IDEJ9.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgccccggagaaattgtgttgacgcagtctccagacaccctgtctttgtctccgaaggggaaagagccaccttctcctagcaggtccagtcagatctaccaacgactacttagacctggtaaccagtcaacgaaacctcgggaccagggcctacccgaggtcctccctctataccgtacggtgaccactaccacgacgacggcctaccgtggacctactcccgagtactacggttacacggtcggacgtagggtcgggtccggtggggacctaacggtaccttttaccgaaccgtttcctaccggtaaaccccgtcgaaccggaccgtaacggtaccgttaaccggtacccccgttaaggtaaaacggtttacgttttcggaccttacggttacgtttaacgttaaccgtttacggtacgtaacgtacgttacggttaacggtaggtacgtaccgttaccgtaaccgtacctaccgttacccgttaccggtaccggtaacggtaaccgtaacggtaaccccccggtagggtaaccgtaaacggttaaccgtaaccggttacggtcgtacgtacgtaccgtaccgtacgttacgttacgttaccgttaccttacgttacccgttacccgtaccgttacctaccgtacgttaacgtacgttacgttaaccg

SEQ ID NO: 127127 - DNA, 504 bp, Homo sapiens
  misc_feature: GYAE6OF02FJ8UA.48.59.F04.1.454.CMB.1.raw
tcagagtatacatacacgaccggtgctcgatttagtacacacacttagggattgggggaagacaatgggtttgattcggattacatgggtgacttttctgttgtatttccaatctcagatgcccccggagaaattgtgttgacgcagtctccagacaccttgtctttgtctccagggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgattttgcagtgtattactgtcagcagtatggtagctcaccgatcacttcgcaaggacacgactggagattaaccgaactgtgctgcacatctgtctcactccttcccgctatctgtatatgtatac

SEQ ID NO: 127128 - DNA, 693 bp, Homo sapiens
  misc_feature: GYAE6OF02GDZN1.48.59.F04.1.454.CMB.1.raw
tcagagtatacatacacgaccggtgctcgatttagtacacacacttagggattgggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtcgctccatcagcagcagtacttacttctgggctggactccgccacgcccccgagggacgggctgggagtggagttgggagttatttaccgacgtaggtgggagccacctaactaccaaccccgtcctacaaaacgttcgacggcaaccatactaccgtagaccacgtaccaaacgaacctaattcctaccctagaacgtctaggacgtaccttcgttcggtaccgtaccccggacccgtcgaaccgaacccgaccgggtctcgttaccttaatttaaccgtggttcgaccggaccgggacccccgagggcccgtcgtaacgggtttcggttccgtttttttaggactttccggttaccgtttttaggttaacgttttaacggttcggggttaccgggggtaacccggtaaacgggggtaaccgttaaacgggtttccgggttacccggttacccgtttacccgg

SEQ ID NO: 127129 - DNA, 708 bp, Homo sapiens
  misc_feature: GYAE6OF02IHAAX.48.59.F04.1.454.CMB.1.raw
  modified_base (520)..(520): a, c, t, g, unknown or other
  misc_feature (520)..(520): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtgggctggactccgccacgccccgagggacggctggagtggtagttggtagtacgttaccacgtaggtagggacgtaccaccttaacgtaaccgtaacccgtaccctaacgtaaaacggtccggaacggaccaacctaacgtaacgtacccgtaagtaacccgaaccggttaaccaaaacgtaaccctaaactttacccgtcccgtaaggaacgtcttacgacgttctacgtacggtaccgaccgccgtacgaccgacgtaccggnttacgtacttaacttacgtgacggaccggaccggacccggagccggtacgtacgggttcggttactttttacggacgtttccggttaccgttttaggaacgtttaacgggtttacgggtaacccggggggtacctaaaacgggggtaccttaaacgggtttcccggtacccggtaaccggtttccccg

SEQ ID NO: 127130 - DNA, 598 bp, Homo sapiens
  misc_feature: GYAE6OF02HNGRT.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagttacttacttcgtgggctggactcccgccacgcccccgagggaacggggctggagtggagttgggagtacgtttaccacgaggtgggacacacctacctacctaacccgtccctaacgaaacgtcgaacgccaacgatactccgtacgaccacgtaccaaacgaaccctaacttccgtaccctagaacgtcgtagacgtcctcgtgtaccgacccgccgacacgacgaccgtctcgtactattacgtagtcggccgacggccccgagccgcgagttcgtattttcgacttcgttactttgacgttagtcgggtacgggaccgaacgggtaactaggtcggtacctaccggttccg

SEQ ID NO: 127131 - DNA, 602 bp, Homo sapiens
  misc_feature: GYAE6OF02H1EJR.48.59.F04.1.454.CMB.1.raw
  modified_base (323)..(323): a, c, t, g, unknown or other
  misc_feature (323)..(323): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctcatcagcagcagtacttacttcgtggggctggactccgccacgccccgagggagggctggagtggagttgggattattaccacgagtgggancacctacaccaaccgtcctacaaagtcgagcactatactcgacgacacgtacaacgtaacctacttcctacgtagacgtcgacgactctcgtcgtacgccgacgcgacgacgcgtctacgtacttacgtcgtcggtcgaccggtaccggcccgacgccggtacgtacgggttcgttttcgtttacgtacgttcggtttaccgttaggtacttggttacggggaccgggtaaccgggtaacggtaacgtacggtttccggtacccgttacccgttacccg

SEQ ID NO: 127132 - DNA, 513 bp, Homo sapiens
  misc_feature: GYAE6OF02FYW6I.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccaggaggggctggagtggattgggagtatttaccacagtgggagcacctactacaacccgtccctcaaaagtcgaggcaccatatccgtagacacgtccaaagaaccaattctccctgaagctgagctctgtgaccgccgcagacacggctgtctattactgtgcgacggccccgagcgcagtggcttttgatgtctttgatagtgtggggcctaagggacaagtggtcaccgtccg

SEQ ID NO: 127133 - DNA, 677 bp, Homo sapiens
  misc_feature: GYAE6OF02IVBLH.48.59.F04.1.454.CMB.1.raw
  modified_base (288)..(288): a, c, t, g, unknown or other
  misc_feature (288)..(288): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccgagggaagagccaccttctcctgcaggtccagtcagagtcttacaacgactacttagcctggtaccatcagaaacctgccaggctcccaggctcctcatctacggtgcatcgacncgacgggccactcggcactccacgacgaggttacagtcggctaggtcggtcgtcgggacagacgttcactctcacgtcagacacgaccgtcgacccgtagaacgtacttttcgacgtacgtagtattacgtgtacaggtcctaagttagtcgggttacacgtacgtaccgtacgtaccgttacccgttccgggaaccgtaaccgggtaccgaaccggtaaccggttacgggtacgttaaaccggttaacccgtaaaacggttcggttacggtaccgtacggtacccgaccctaacgttacgttacggttacctttaccgtaacctttacccgttaccccggtaccttaaccgttaccggttacgtaaccgtttacgttaggtttaaccc

SEQ ID NO: 127134 - DNA, 417 bp, Homo sapiens
  misc_feature: GYAE6OF02GHHC0.48.59.F04.1.454.CMB.1.raw
  modified_base (407)..(417): a, c, t, g, unknown or other
  misc_feature (407)..(417): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaaagggacaatggtcaccgtctcttcagcctccaccaagggcccatcggtcttccccctggcaccctcctccaagagcacctctgggggcacagcggccctgggctgcctggtcaaggactacttcctatgtatactctgagcgggctgggcaaggcgcatagnnnnnnnnnnn

SEQ ID NO: 127135 - DNA, 546 bp, Homo sapiens
  misc_feature: GYAE6OF02GE77A.48.59.F04.1.454.CMB.1.raw
  modified_base (377)..(377): a, c, t, g, unknown or other
  misc_feature (377)..(377): n is a, c, g, or t
  modified_base (419)..(419): a, c, t, g, unknown or other
  misc_feature (419)..(419): n is a, c, g, or t
  modified_base (441)..(441): a, c, t, g, unknown or other
  misc_feature (441)..(441): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccgagggaagggctggagtggattggggagtatttaccacgaggtgggagcacctactaaccaacccgtccctacaaaagtcgaggcaccatacgtccgtanaccacgtaccaaagaaccaacttcctaccctgaagctagacnctcgtgtgacccgcgcacgacncgctgtctattctgtgcgacggcccgagccgcaggttgtcttttgattcgtcctttgactgttcggtagggaccgaagggtacaggtcggtaccgtaccgttccg

SEQ ID NO: 127136 - DNA, 620 bp, Homo sapiens
  misc_feature: GYAE6OF02IJD7K.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccctttcggagaccctgtccctcacctgcactgtctctggtcgctcatcagcagcagtacttactcgtgggctggactccgccacgcccccgaggggacgggcgtggaggtggagttgggagtttactttaccgaacgtaggtaggggagaccaaccgttaactaaccgtaaaccccgtccctaacgaaaacgtccgaacggaccaaccattaccgtaccgtaacgacctaaccgtaccaaaggtaaaccctaatttaccctacccgtacgaacgtccgtagacgtctcgtgtaccgaccgccgacacgacgaccgctcgacttattactgtcgcgcgacccgagccgacgacgttgtcttttagacgttcgtcctttagtagttagtggtacgggacgaacgggacctaagttcggtaccgtaccgttccg

SEQ ID NO: 127137 - DNA, 552 bp, Homo sapiens
  misc_feature: GYAE6OF02FKKUJ.48.59.F04.1.454.CMB.1.raw
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (421)..(421): a, c, t, g, unknown or other
  misc_feature (421)..(421): n is a, c, g, or t
tcagagtatacatacacgaccggtgctcgatttagtacacacacttagggattgggggaagacaatgggtttgattcagattacatgggtgacttttctgttgtatttccaatctcagatgccccccggagaaattgtgttgacgcagtctccagacaccctgtctttgtctccaggggaaagagccaccttctcctgcaggtccagtcagagtcttaccaacgactacttagcctggtaccatcagaaacctggccaggcctcccaggctcctcatctacggtgcatccagcacgggccactggcatcccagacaggttcagtggcaggtgggtcgtgggacagacttcactctcnccgtcacgcagactcggaccctgaagtnttttgctagtgtattactgtcagctagtatggtacnctcaccgatcctaccgttcgaccgaagggaccacggacgtggaacgtacgttaaccgaacgtggtacgcgtcgaccacatcgtcgtccttcacttcccttcccgcctacttccttagacttgtagttaacg

SEQ ID NO: 127138 - DNA, 698 bp, Homo sapiens
  misc_feature: GYAE6OF02IPZ5Q.48.59.F04.1.454.CMB.1.raw
  modified_base (234)..(234): a, c, t, g, unknown or other
  misc_feature (234)..(234): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccntcagcagcagtacttacttctggggctggatccgcccagccccccgaggggaacgggggctgggacggtgggagttggggagttactttaccactaggtgggagccactactaacacccgtcctacaaacgtcgaggcaccatataccgtagacacgtaccaacgaacctaacttacctccctacgaacgtctacgacggtcctacgttcgtcggaccccggtcccggaccgtaacggacccgaacgggtcccgttagttacccgttaagtttaccgttcgtacggtccgggaaccgggtccccggaaccggtccgacgtacgggttaccgggttcgttttttacggaacgtttcgggttcccttttaggtaacggttacggtttacgggtttcggggggaaccccggtaaagggggtaaccgttaaacgggtttcgggttacccggtacccgggttttacccg

SEQ ID NO: 127139 - DNA, 554 bp, Homo sapiens
  misc_feature: GYAE6OF02HZQZE.48.59.F04.1.454.CMB.1.raw
  modified_base (378)..(378): a, c, t, g, unknown or other
  misc_feature (378)..(378): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagactcgactctcaccgtcagcagactgaccctgaacgtnttttgctagtgtattactgtcagcagtatggtagctccaccgatccaccttcggaccaacgggacacgactggaacgtagtaaccgaacgtgtcggtactgactaccgatccgttgttccttctacttcccgttccccgtcctacgttaccgtacgtaacttacgtagtttaaccg

SEQ ID NO: 127140 - DNA, 561 bp, Homo sapiens
  misc_feature: GYAE6OF02ICHCJ.48.59.F04.1.454.CMB.1.raw
  modified_base (254)..(254): a, c, t, g, unknown or other
  misc_feature (254)..(254): n is a, c, g, or t
  modified_base (374)..(374): a, c, t, g, unknown or other
  misc_feature (374)..(374): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcctcacctgctactgtctcgtggtcgctcatcagcagcagtacttactgngggctggactccgccacgccccgaagggagggctggagtggagttggattattaccacgtaggtggacacacctactaccaaccgtcctacgaaaagtcgagacaactatacgtcgtaanactacgtaccaaacgtaacctacgttactacccgtagaacgtctagacgtctcgtacgtcgaccgccgacacgacgacgtctcgtactacttacgtgtcgcgacggtcccgaagcgtacgagtgttcttttgattcgtcttagagtagttggtcggacgaaggtactaagtcgtaccgacgttaccg

SEQ ID NO: 127141 - DNA, 587 bp, Homo sapiens
  misc_feature: GYAE6OF02IIY41.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgccactgtctctggtcgctccatcagcagcagttacttacttcgtggggctggactcccgccacgcccccgaggggaacgggctgggagtgggtagttggggagttatttaccgacgaggtgggagctacctactacacccgtcctacgaaacgtcgagcaacatactccgtagacacgtaccaagaaccctattcctccctagaacgtctagacgtctcgtgtacgaccgccgacacgacgacgtctcgtcttacgttccgtgtcgccggtacggccccgagccgcgtaggtcgttactttttgacgttcgtccttttgacgttagttcgggcggggtaccgtaagggacctaagttcggtaccgtaccgttc

SEQ ID NO: 127142 - DNA, 787 bp, Homo sapiens
  misc_feature: GYAE6OF02GGYOT.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgcctccatcagcagcagtacttacgttcgtgggctggactccgccaccgaccccggagggacgggtcgtggaggtggtaggttgggtaacgttacgttaccgagtagggtacgggacgtaccgtacccttaaccgtaacccgtaacccccgttaccgtaacgtaaaccggtcggaaccggtaccaacgtacgttaccgtaccgtaacgaacctaccgtaaccaaaaccgtaacctaactttccctacccgtaggaaaccggttctacggtacgttccttaccggtacggttacccggaccccgttccggaacaaccggtaccggaaccgggttcttaccggtttaaccttacgttaccggttacgggtacccggtaccggggaaccccgggtccccggaaggtccccggtaggttaaccggggtttccggtttaccgtttttcgggaccgtttccggtttacggtttacgtaacgtttacgggttaccggggtacccggggaaccggttaacggggtaaccgttaagggtttcccggtaacccggtacccgtttacccgg

SEQ ID NO: 127143 - DNA, 758 bp, Homo sapiens
  misc_feature: GYAE6OF02IQE53.48.59.F04.1.454.CMB.1.raw
  modified_base (209)..(209): a, c, t, g, unknown or other
  misc_feature (209)..(209): n is a, c, g, or t
  modified_base (249)..(249): a, c, t, g, unknown or other
  misc_feature (249)..(249): n is a, c, g, or t
tcagagtatacatacacgaccggtgctcgatttagtacacacacttagggattgggggctttctgagagtcatggatctcatgtgcaagaaatgaagcacctgtggttcttcctctgctggtgcggctccagatgggtcctgtccagctgcagctgcaggagtccgggcccaggactggtgaacgtccttcggagtaccctgtcccctnacctgctacgtcgtcttcgtaggtcgcctaccatcagcanctagtacttacgttcgtcgggtctaggactccgcccgacgccccgaggggacgggtcgtaggtaggtggtagttcgggtaacttacttaaccgacgtaggtcggaatccgtaacctaacgtaacccaacccggttacccaacgtaaaacggtccgaacggtaccgtaacctaacgttaccgtaaccgtaacgtaaaccgtaaccggtaaccctaaaaacgtaacccgtaactttaccccgtaacccgtaaggtaaacgtccgtaaggacgtaccttacgtacggttacccggacccgtacccggacgaaacgtacccgtaccgtcgtaggtaaccttaacgttacccgtaggtacgacccggtaaccgggtacccgacggtccggacgttacggttacggtttaccgtttggtaaccttcggttaacctttgggtaccttagggttacgggttacggaaccggtacggttaaccgtaaggttacccggttacccgacccgtttacccgg

SEQ ID NO: 127144 - DNA, 542 bp, Homo sapiens
  misc_feature: GYAE6OF02HSABF.48.59.F04.1.454.CMB.1.raw
  modified_base (368)..(368): a, c, t, g, unknown or other
  misc_feature (368)..(368): n is a, c, g, or t
  modified_base (410)..(410): a, c, t, g, unknown or other
  misc_feature (410)..(410): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccagcccccagggaagggctgggagtggagttggggagtatttaccacagtgggagcacctactacaacccgtcctacaaaagtcgaggcacatactcgtanacacgtaccaaagaaccaattcctccctagaacgtctagacnctctgtcgaccgccgcacgacgacggctgtctattactgtcgcgacggcccgagccgacagtcgttcttttgattcggtcctttgattagtggtcggggaccgtaagggactaaggtcggtaccaccgttcg

SEQ ID NO: 127145 - DNA, 617 bp, Homo sapiens
  misc_feature: GYAE6OF02G81VL.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgcctccatcagcagcagtacttacttcgtggggctggactccgccacgcccccgaggggagggctgggagtggagttgggagtactttaccgagaggtgggagcacctactaccacccgtcctacaaacgtcgagacacatactaccgtagacacgtaccaaacgaacctaacttcctacccgtaggaacgcgtagacgtctcgtcggtaccgacccgcccgtacgacgtacccgacggtcctcgtacttacgttacgtgtcggaccggaccggccccgagccgacgtacgttcggttccgtttttacggacttcggttaccttttagacgtttaggtcgggtacggggaccgtaagggtacctaaggtcggttaccgtacccgttccg

SEQ ID NO: 127146 - DNA, 554 bp, Homo sapiens
  misc_feature: GYAE6OF02HV4WF.48.59.F04.1.454.CMB.1.raw
  modified_base (383)..(383): a, c, t, g, unknown or other
  misc_feature (383)..(383): n is a, c, g, or t
  modified_base (489)..(489): a, c, t, g, unknown or other
  misc_feature (489)..(489): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagcccttcggagaccctgtccctcacctgcactgtctctggtcgctccatcagcagcagtacttactcgtgggctggactccgccacgcccccaggggacgggctggaggtggagttgggattactttaccgacgtaggtggagcaacctactacctaacccgtaccctacaaaacgtcgagccacatactccgtanacacgtaccaaagaacctaattcctccctagaacgctagactctctcgtcgaccgccgcacgacacggctcgtacttattactggtcgaccggacgcccgagccgngacgtgtcttttgattcggtctttgattagtggtacgggacgaggtactaggtcgtcctacgtcc

SEQ ID NO: 127147 - DNA, 675 bp, Homo sapiens
  misc_feature: GYAE6OF02HTL11.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccttcggacgaccctgtcccctcacctgccactgtctcgtggtcgcctccatcagccagcagttaccttacttcgtggggctggactcccgccacggcccccgaggggaacggggctgggagtgggagttggggagttacgttaccgacgaggtagggacacgacctacctaaccgaacccgtaccctacgaaacgtcgacggaccaacatacgtccgtaagacacgtaccgaaacgaaccctaattccgtaccctaagacgtctagacgtcttacgtcgtacggacccgccgactacggaaccgtaccgggtctacgttacctagtttaccgttcggtacggccggtaccgggccccgagcccggtagtaccgggtttgtttccgtttttagacgttcggttcctttaggtacgttacggttacgggttaccggggtaaccgtaaggggtaaccctaggttacccgggtaccctaccgtttcccg

SEQ ID NO: 127148 - DNA, 592 bp, Homo sapiens
  misc_feature: GYAE6OF02G73SK.48.59.F04.1.454.CMB.1.raw
  modified_base (401)..(401): a, c, t, g, unknown or other
  misc_feature (401)..(401): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgccccccgagggaacggggctgggagtggattgggagtatttaccgacaggtgggagcgacctacgtaccacccgtcctacaaagtcgagcacatactcgtagacacgtccaacgaacctaacttccnccctagaacgctagacgtctacgtgtcgacccgccgacacgacacggtctcgtactattacgtgtcgcgacggacccgagtccgacgtaggttcggttactttttgacgttacggttccgtttgtaacttgttacgggtacggggacccgtaaggggtacctaaggttcgggttaccctaaccggtttccg

SEQ ID NO: 127149 - DNA, 838 bp, Homo sapiens
  misc_feature: GYAE6OF02I2HCQ.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcgggacgaccctgtcccctcacctgcactcgtctcgtgggtcgctccatcagcagctagtaccttactcgtgggctggactcccgccacgcccccggaggggaacgggtcgtgggagtgggtacgttgggggtattaactttacccgacgtagggtcgggacgtaccgtaacctaaccgtaaccaacccccggttaccctaaacgaaaaacggttaccggaacgggacccaaaccctaacgttaaccgtacccggtaaacgtaaccctaacccggttaaacccaaaccggtaaaacccttaacgtttacccctaaccccgttaaggaaccgtccggtaggtaacgtccttacggtacggtacccgggaacccccggtccgaaccgtaacggaacccgtaccgggtactttaccggttaacttaaccgtttaccggttacgggttaccggacccggggaacccgggtacccccgggaaacgtcccgggtaccgtaaaggggtttccggttttacgttttttacgggaccgttttccgggtttacccgttttacggtaacgtttacgggttacggggtaaccggggtaacccggtaaacggggtaacctaaacgggtttccgggttaaccccgtcccgggttttaccc

SEQ ID NO: 127150 - DNA, 574 bp, Homo sapiens
  misc_feature: GYAE6OF02H2KA4.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgcctctggtgctccatcagcagcagtacttacttcgtggggctggactccgccacgccccgagggacgggctggagtggagttgggagttacttaccacgagtgggacgcacctactaccacccgtcctacgaaacgtcgacgcacatactccgtaagacacgtacaaacgaacctacttcctacccagaacgcctgacgtctcgtgtcgaccgccgacgacgacgaccggtctgtaccttattacgtgtcgaccgaccggccccgagccgacgtggttcgttcgttttgacgttcgtccttttgacttagtggtacgggactaacgggtactaaggtcggtaccgtaccgttccg

SEQ ID NO: 127151 - DNA, 659 bp, Homo sapiens
  misc_feature: GYAE6OF02I59D6.48.59.F04.1.454.CMB.1.raw
  modified_base (165)..(165): a, c, t, g, unknown or other
  misc_feature (165)..(165): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
tcagagtatacatacacgaccggtgctcgatttagtacacacacttagggattgggggctttctgagagtcatggatctcatgtgcaagaaaatgaagcacctgtgttcttcctcctgctggtggcggctcccagatgggtcctgtcccagctgcagctgcaggngtcgggcccaggctggtgaagccgttcggacgtaccctcgtccctcacctgccactgtctcgtggtcgcctccatcagcagcagtacttcgtcgngggctgctccgcgccgcccgagggaggctggngtggtagtggatacgttcgagtaggtggacgcaccgtactaccgaccctacctacgaaacgtcgacgcaactatactcgaacacgacaccaacgtaaccacttcctaccgtacgacgtacgtaggctctacgtacggtaccgaccggccgacgaaccgtacgaccggtacgtcgttacgttagttaccgtggttccggaccggtacgggtacccccggaggtcccgtacggttacgggttcggttttccgttttacgtacgtttccgggtttcttttacggttacgttagggttacgggtaccggggttaaccgggtaacgggttaaccggtaacgttacccggggttaccgttacccggtttccgg

SEQ ID NO: 127152 - DNA, 801 bp, Homo sapiens
  misc_feature: GYAE6OF02GVH6N.48.59.F04.1.454.CMB.1.raw
  modified_base (256)..(256): a, c, t, g, unknown or other
  misc_feature (256)..(256): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagtacttacttcgngggctggactccgccacgcccccgaggggaacggcgtggagtggacgttgggacgttaacgtttaccgacgtggtagggtagaccgtaacctaccgtaacccgtaaccccgttaccccgtaacgtaaaacggtccggaaccggtaccaacccgtaacgttaaccgtaccgtaacgtaaccaaccggttacccgaaaaacgtaaccccgtaaactttcccgtaccctacggtaaacgtccgttacgaacgttccgtacgttacgggtaccgaacccggtcccgaacgtaacggacccgaccggtacgtcgtttaaccttaagtttccgtacggttacggcccggtaacccgggtcccccggaaggtcccgtaccggtacggttttccgggttaccgttttttaggacggttttacccgggttacccgttttttaggaaccggtttcgggtttaaccggggttaccgggggtaaccccgggtaaaccgggggttaaaccgttaacggggtttcccgggtttaaacccggtttaccccggtttcccgg

SEQ ID NO: 127153 - DNA, 557 bp, Homo sapiens
  misc_feature: GYAE6OF02I0YSK.48.59.F04.1.454.CMB.1.raw
  modified_base (424)..(424): a, c, t, g, unknown or other
  misc_feature (424)..(424): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgcctccatcagcagcagtacttacttctgggctggatccggccacgcccccagggaagggctgggagtgggattgggagttattaccacgaggtgggagcacctactaaccaacccgtccctacaaaacgtcgacggtccaccatactaccgtagaccacgtaccaaacgaaccaattcctcctagaacgctagacnctctcgtcgaccgccgcacgaccgacggtctcgtacctattactgtcgcgacggcccgagcgcacgtgttcttttgacttggtcctttgactgtcggtacgggacaagggactaagtcggtacgtaccgttcg

SEQ ID NO: 127154 - DNA, 622 bp, Homo sapiens
  misc_feature: GYAE6OF02IDQRW.48.59.F04.1.454.CMB.1.raw
  modified_base (182)..(182): a, c, t, g, unknown or other
  misc_feature (182)..(182): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaanagccaccttctcctgcaggtccagtcagagtcttaccaacgactacttagccctggtaccatcaagaaacctggccaggcctcccaggcctcctcatctacggtgcatccagcagggccactggcactcccagacaggttcagtggcaggtcgggtcgtgggacagtacttcactctccaccgtcacgacagacgtcggaccctagaagtagttttgactagttagtatttacgtgtcagtctaggttacgtaggtacgtccgtaccgtaccgtacttccgtaaccgttccggaccgaacgggacgaaccgtacggtaggaacgtaacgttaaccgaacgttcggtacggtcgtacgacctaccgtattccgttcgttcctttaccgtactttcccgttaccccgtcctacgttccgttagtaacttacttagttaaccg

SEQ ID NO: 127155 - DNA, 650 bp, Homo sapiens
  misc_feature: GYAE6OF02J2L80.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagcccttcggacgaccctgtcccctcaccgtgccactgtctcgtggtgctaccatcagcagctagtacttacttcgtgggctggactcccgccacgccccgaggggacgggcgtagggacgtggagttgggagttacgttaccgacgtaggtcgggacgtccgtaacctaccgtaaccacccgtcctacgaaacgtcgagtccactagtacgtaccgtacgacaccgtaccaacgtaactacttcctaccgtagactcgtagcgaccttcgtgtaccgaccgtccgtacgacgacgtaccgtctgtaccttagttcgtacgtcggaccgaccggcccgacgaccggtcgtacggttcggttaccgtttttagacgtttaccggtcttttaggacgttacggttcgggtacgggtacccggtaacgggtaccttaacgggtccggttaccgtacccggtttaccg

SEQ ID NO: 127156 - DNA, 579 bp, Homo sapiens
  misc_feature: GYAE6OF02F9N9O.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggactccgccagcccccagggaagggctggagtggattgggagtatttaccacagtgggagcacctactacaacccgtcctacaaaacgtcgaggcacatatcctagacacgtaccaagaaccaacttctaccctgaacgctagacgctctggtcgacccgccgacacgaccgacggctcgtacttattacgtgtcgacgacggccccgagccgacgtaggtcggttctttttggacttcggtcccgtttgtaagttacgttcgggttacggggtaccgtaacggggtacctaaggttcggttaccgtacccggttaccg

SEQ ID NO: 127157 - DNA, 604 bp, Homo sapiens
  misc_feature: GYAE6OF02HVP82.48.59.F04.1.454.CMB.1.raw
  modified_base (537)..(537): a, c, t, g, unknown or other
  misc_feature (537)..(537): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcacttgtctctggtcggctccatcagcagctagtacttacttcgtggggctggactccgccacgcccccgagggacgggctggagtggagttggggattacgttaccaacgaggtcgggtagaccgtaaccgtaacctaaccgaaaccccgttcccgtaacgtaaaacgtccggacggtaccaacctaatacgtaccgtaacgactaaccggtaccaaacgaacctaacgttcctacccgtagaacgtctaggacgtctcgtggaccgaccgccggacacgacgtcgctcgtacttactcgtagtcgcgaccgccgagcgcgngttcgttcgttgtatcgtcttagtatcgttcggcgggtacgaaggtacaggttcgtacgtccgttcg

SEQ ID NO: 127158 - DNA, 679 bp, Homo sapiens
  misc_feature: GYAE6OF02I458J.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccttcggacgaccctgtccctcacctgcactgtctcgtggtgcctccatcagcagctagtacttacttcgtgggctggctccgccacgccccgagggacgggcgtggacgtggtagttgggtagttactttaccgacgtagggtagggacgactaacctacgtaacccgtaaccccgttaccctaacgaaaacggtccggacggaccaacctatacgtaccgtaacgaccgtaccgtaccaaaccgtaacctaacttcctaccgtagaacgtcgtagacgtcgtacgtcgtacgacccgccgacacgaccgtaccggtctcgtacttaacttacgtgtcggacccggtaccggccccggtagccgtacgtacggttcggtttaccgtttttaggacgtttaccggttcccttttaggaactttacggttcgggtaccggggtaaccgaaacggggtactaacgggttacggtacccgtaccggtttcccg

SEQ ID NO: 127159 - DNA, 629 bp, Homo sapiens
  misc_feature: GYAE6OF02GBRLK.48.59.F04.1.454.CMB.1.raw
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactgggtgaacgccttcggacgaccctgtccctcacctgccacttgtctcgtggtcgcctccatcagcagcagtaccttacttcgtgggtctggactccgccacgcccccggaggggacgggcgngggaggtggagttgggagttacttaccacgagtgggagctacctactaccaacccgtaccctanaaacgtcgaggacctacatactacgtagactacgaccaacgaacctacttccctaccgtagaaccgtcgtagacgtccgttacgtcggtaccgacccgccgtacgacgaccgaccgtacgttcgtactaacttcgtggtcgtaccgtcggaccccgagccgtacgtagggtcgtttacgttttgacgtttcggtcctttagtacgtcggttcgggtacggtaccggtaagggtaccgtaggtcggttaccgtaccgttaccg

SEQ ID NO: 127160 - DNA, 754 bp, Homo sapiens
  misc_feature: GYAE6OF02JLVRC.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctccagatgggtcctgtcccagctgcagctgcaggagtcgggccaggactggtgaagccttcggacaccctgtccctcacctgcctactgtcctcgtaggtcggccttccgatcagcagcagtacttacgttcgtcgggctggactcccgcccacggccccccgaaggggtaacggggccgtagggacggttgggagttcggggtaagttaacgtttacccgaacgtagggtcgggacgccgtaaccgtacgtaacccgtacccgtacccgtaacgaaaacgttcgaacggtacctaaccgtatacgtacccgggtaagacccgttaacgtacccgaaaccgtaaccgtaacgttccgtacccaggtaaacgccgttagacgtcctcgttcgtacggacccgaccggctaacggccgaaccggtctacggttccgttaactttacggtacgtaccggtaccggggtccgggtaacccccgaggtccggacgttaacgggttccggtttacgttttacggacgtccgggtttccttttaacggtaacgtttcggttacgggtaacgggggtaccgttaaacggggaacccttaacgggtttccggaacccgtttacccggttcccg

SEQ ID NO: 127161 - DNA, 690 bp, Homo sapiens
  misc_feature: GYAE6OF02G8YVG.48.59.F04.1.454.CMB.1.raw
  modified_base (235)..(235): a, c, t, g, unknown or other
  misc_feature (235)..(235): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtgcggctcccagatgggtcctgtcccagctgcagctgcaggagtcgggccaggactggtgaagccttcggagaccctgtcccctcacctgcctactgtctctgggtcgctcntcagcagcagttacttcttcgtgggctggactccgccacgccccgagggacgggcgtggacggtggtagtgggagttacgttacacgtaggtggacgtacctacctactaccacccgtacctacgaaacgtcgacggaccacgtactacgtacccgtaacgaaccgtaaccgtaccgaaaccgtaaaccctacctttacccgtaccccgttaacggaacgtacctaaggaaccgtccgttacgttaccggtccgaaccccggccgtaaccgacgacccgtaccggtccttaccggtacctttacgttaaccgttcggtaccggaccgggtcccggaccccgacggtaccgtaccggttaaggttcggtttaccgtttttgacgtttcggttaccgtttgacgttggtacgggtacgggacgtaagggcgttaggtccggtccgtacccgttaccg

SEQ ID NO: 127162 - DNA, 598 bp, Homo sapiens
  misc_feature: GYAE6OF02I4TG5.48.59.F04.1.454.CMB.1.raw
  modified_base (209)..(209): a, c, t, g, unknown or other
  misc_feature (209)..(209): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctnacctgcactgtctcgtggtcgctccatcagcagcagtacttacttcgtgggctggactccgccacgcccccgaggggaacgggcgtcggagtggacgttggagtatttaccgacgaggtggacgcactactacaaccgtcctacaaagtcgacgacaccatactacgtacgacacgtacaacgaacctaatcctcccgtagagctagacgtactcgtgtacgaccgccgacacgaccgacgctgtaccttacttacgtacgtcgacgtaccggaccccgagccgcgacggttcggttcttttgtaacgttcgtccgttttgtacgttagttcgggtacgggtaccggaagggtaacctaacggtacggttaccgtacccggtttacccg

SEQ ID NO: 127163 - DNA, 537 bp, Homo sapiens
  misc_feature: GYAE6OF02FVG3G.48.59.F04.1.454.CMB.1.raw
  modified_base (451)..(451): a, c, t, g, unknown or other
  misc_feature (451)..(451): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgcagccccccgagggaggggctggagtggagttggagtattacacgagtggagcacctactaccaaccgtcctacaaagtcgaggcaccatactaccgtagacaccgtaccaaagaaccaacttcctacccgtgaacgctagacgctactgtgacccgtcgcacgacgacgctgtctagttacnggtcgcgacggcccgaagccgacagtcgtcttttgatcgtctttgatagttgtacgggacgtaacgggacaagtcggtacacgttc

SEQ ID NO: 127164 - DNA, 699 bp, Homo sapiens
  misc_feature: GYAE6OF02GK31H.48.59.F04.1.454.CMB.1.raw
  modified_base (185)..(185): a, c, t, g, unknown or other
  misc_feature (185)..(185): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtnaagccttcggagaccctgtccctcacctgcactgtctcgtggtcgctccatcagcagctagtacttacttcgtgggctggactccgccacggccccgagggagggcgtgggagtggtagttgggtagttactttaccgagtaggtgggacgtccaaccgttaccgtaaccgtaaccccgtacccgtaacgaaaacggttcggaacggaccaaccgtaatacgtaccgtaacgaccgtaaccgtacccgaaacgtaaaccctaacgtttcccacccgtagaacgtctacgacgtcttcgtggtaccgacccgcgtacgacgacgacggtctacgtacttacgttacgtcggtacgaccggtaccggaccccggtagccgtacgtacgggttacgtttcgtttttacggacgtttccggttacccgttttaggaacgtttagggttcgggttacggggtaacccgtaaaggggttaccctaacgggtttaccgggtacccgttacccggtttcccg

SEQ ID NO: 127165 - DNA, 752 bp, Homo sapiens
  misc_feature: GYAE6OF02IQRY9.48.59.F04.1.454.CMB.1.raw
  modified_base (166)..(166): a, c, t, g, unknown or other
  misc_feature (166)..(166): n is a, c, g, or t
  modified_base (249)..(249): a, c, t, g, unknown or other
  misc_feature (249)..(249): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggngtcgggcccaggactggtgaagccgttcggacgaccctcgtcccctcacctgctactgtcctcgtggtcgcctccatcagcanctagtacttacgttcgtgggctggactccgccgaccggccccgaaggggacgggcgtaggaggtgggtagttgggacgtttacgtttaccgacgtaggtcgggacgaccgtaaccgttaacctaacccgtaacccgtaccctaaacgtaaaacgtccggaacggacctaacccgtaattaccgtaccgtaacgaccgtaaccgttaaccgaaaacgtaaacccttacgtttacccgtacccgtaacggaacgtcgttacggacgtccttccgttacgtaccggacccgaccgacgtaaccgaccgacgtccgtagtacctttacgttaccgtcggtacgccggtaccggacccggtgcccggtacggtacgggttacggttttaccgtttttacggacgttttccgggttctttacgggtaagtttaccgggttacgggttaccggggaaccggtaaacggggtaccgtaacgggtttccggttacccggtaccgtttacccg

SEQ ID NO: 127166 - DNA, 735 bp, Homo sapiens
  misc_feature: GYAE6OF02FPUX5.48.59.F04.1.454.CMB.1.raw
tcagagtatacatacacgaccggtgctcgatttagtacacacacttagggagttgggggcgtttcgtgaagagtcatggatctcatgtgcaagaaaatgaagcacctgtggttcttcctcctgctggtggcgctccagatgggtcctgtcccagctgcagctgcaggagtcgggcccaggactggtgaacgcccttacggagaccctgtccctcaccgtggccacgtcgtactcgtcggtggcctccgatccgagctagcgagtacttacgttcgtggggcttcggactcccggaccacggtccccccagggaacgggcgtacgggagtgggtaggttcgggtaacgtaacgtttaccgacgtagggttacgggtacgtaccgtaccgtacgtaccgtaacccgtacccgtaacgtaaaacgttcggtacggtaccgtaaccgtaacgttacgtacccggtaacgaaccgtaccgtacccgaaacgtaacctacgttaccgtacccgtacggtaacgcgtacgacgccttacgttcgacgtacccgaccgtaccgacgtaccgaccggtcgtacgttaccgttaacgttacgtcggttacgacggtaccggacccgtacgtccgacgtaggtcgttacgttttgaacgttcggttacgtttacgtaacgttcggttacgggtaccgggtacgtaacgggtaccgtaacggtccggttacccgtacccgttacccg

SEQ ID NO: 127167 - DNA, 819 bp, Homo sapiens
  misc_feature: GYAE6OF02H4GTQ.48.59.F04.1.454.CMB.1.raw
  modified_base (116)..(116): a, c, t, g, unknown or other
  misc_feature (116)..(116): n is a, c, g, or t
  modified_base (118)..(118): a, c, t, g, unknown or other
  misc_feature (118)..(118): n is a, c, g, or t
  modified_base (123)..(123): a, c, t, g, unknown or other
  misc_feature (123)..(123): n is a, c, g, or t
  modified_base (134)..(134): a, c, t, g, unknown or other
  misc_feature (134)..(134): n is a, c, g, or t
  modified_base (238)..(238): a, c, t, g, unknown or other
  misc_feature (238)..(238): n is a, c, g, or t
tcagagtatacatacacgaccggtgctcgatttagtacacacacttagggattgggggctttctgagagtcatggatctcatgtgcaagaaaatgaagcacctgtgttcttcctcngngtggngcgccaccagngtcggtctcgtaccgagcgtgcgacgtcgtcgacgagggccggtcccgggacccgaagggtcgtggtagaacgttcccgttacgggacctacccgtccgtcccncctaccgcgtactcgttcgttcgtcggttagggccgtccttacacgtacgacgacgactcgtaacgtttaacctttcgttccggggcgggtacgttaccggaccgttcccggacccccgtacccggaccccgggtaaggggtaacgggtccggtaggtacggttacggttagggtagggttaacttttaaccgttaccgaacgggttagggacggacctaaccgttaacccgtaaccgtaaccccgtacccgtacccgtaaacgtaaaacggtccgggacacccaaacgtactaacgttacccgaaagttacccgaaccgtaaacccgaaaacgttaaccctacctttcccgtaaccggaacgtaccgtacgtacgtacgttctaccgggtaccggaccgtacccggccgtacgaacgaccggtaacgttccgtacgttaccgttaacgtttccggaccgttcggaccggtaccccggacccggtagcccgtaaggtcgttcgtttacgttgacgttcgtcttagacgtacggttggtaccggaaggtaacggtacctacggtttaccgcccgtacgttcg

SEQ ID NO: 127168 - DNA, 686 bp, Homo sapiens
  misc_feature: GYAE6OF02HTR6O.48.59.F04.1.454.CMB.1.raw
  modified_base (208)..(208): a, c, t, g, unknown or other
  misc_feature (208)..(208): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcccncacctgcactgtctcgtggtcgctccatcagcagcagtacttacttcgtgggtctggactccgccacgccccgagggacgggctggaggtggacgttgggagttacttaccgagtaggtggggacaccgtaacctacgtaccaacccgtcctacgaaacgtcgaggccacgatacgtcgaacactacgtaccaaacgtaacctaattacctacccgtagaacgtctagagtcctcgtcgtacgacccgccgaccgacgacgaccggacgtcgttacgttaacttacgtggtcgtaccggaccggtaccccggacggcccggtaccgttacgggttcgggtttacgttttttacggtacgtttacggttaccccgttttaggttaacgtttacggttacggggttaccggggggtaacccggtaaacgggggaaccttaaacgggtttacccgggttacccggtacccggttttacccg

SEQ ID NO: 127169 - DNA, 672 bp, Homo sapiens
  misc_feature: GYAE6OF02GZEQU.48.59.F04.1.454.CMB.1.raw
  modified_base (303)..(303): a, c, t, g, unknown or other
  misc_feature (303)..(303): n is a, c, g, or t
tcagagtatacatacacgaccggtgctcgatttagtacacacacttagggattgggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtcgctccatcagcagcagttacttactcgtggggctcggactcccgccacgccccggaggggacgggcgtagggnggtggtagttgggtattaacgtttaccagtaggtcggggacgacctaacctaacctaacccgaaccccgttcccgtaaagaaaacggtaccggaacgggacctaaccgacttaacgtaccggtaacgtaccaaccgtaaccgaaacgtaaccctacttaccgtacccgtagaacgtctaggactctcgtcgtacgccgccgacacgaccgacggtcttcgtaccttacttacgtcggttcggaccggaccggacccgacggccgtacgtacgggttcgttacgtttttgacgtttaccggttctttaggtactaggttcgggtacgggtaccgaagggtaccgtaaggtccggttaccgtaccgttccg

SEQ ID NO: 127170 - DNA, 568 bp, Homo sapiens
  misc_feature: GYAE6OF02G2RZP.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgccccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcactcccagactaggttcaggtggcaggtgggtcgtgggacagacttcactctccaccgtcagcagacgtcgaccctgaagtatttgctagtgtattacgtgtcagcagtagtggtacgctcgaccgatccacccgttcgggaccaacgggaccacggacgtggaacgtacgttaacccgaagtcggtcggcgtcgcctacctactcgtcgtccttactacttcccgttcccgaccgtacttcgtacgtacttacgtacgttaac

SEQ ID NO: 127171 - DNA, 752 bp, Homo sapiens
  misc_feature: GYAE6OF02HT68M.48.59.F04.1.454.CMB.1.raw
  modified_base (181)..(181): a, c, t, g, unknown or other
  misc_feature (181)..(181): n is a, c, g, or t
  modified_base (363)..(363): a, c, t, g, unknown or other
  misc_feature (363)..(363): n is a, c, g, or t
tcagagtatacatacacgaccggtgctcgatttagtacacacacttagggattgggggaagacaatgggtttgattcagattacatgggtgacttttctgttgtatttccaatctcagatgccccggagaaattgtgttgacgcagtctccagacaccctgtctttgtctccaggggaaangccaccttctcctgcaggtccagtcagagtctaaccaacgactaacttagcctggtaccatcagaaacctggaccaggctcccaggctcctacatctacggtgacactccagcgacgggccacgtgcactccagacaggttcagtcggcagtcggtctagggacagactcactctcaccgtnacgtacacgacgtacggtacctacggtaaagttacgttttagaccgtagttacgttaacgtttacgttacgttaccaggtaccgtaaagttacggttagggttaacgaccgttacccgaacccggttaacgtacccgttaaaccccggtttacccgggaaccgtaaaaccggggtacccgtaaacccgggtaaccgttaacggggaaacgttaaaccgtttaaaacccggtaaaccgtttaccgggtaaggtcccgttacggtaaccctaaccgtaccgttaccgtttacggtttaccctttaccgttaccgtttacccccttacccgggtaccccttaaccggtttacccgttaacggttaactttaacccgtttagtttaaacccgg

SEQ ID NO: 127172 - DNA, 519 bp, Homo sapiens
  misc_feature: GYAE6OF02FUWVV.48.59.F04.1.454.CMB.1.raw
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
  modified_base (443)..(443): a, c, t, g, unknown or other
  misc_feature (443)..(443): n is a, c, g, or t
tcagagtatacatacacgaccggtgctcgatttagtacacacacttagggattgggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattgggagtatttaccacagtgggagcactactaacaacccgtccctacaaaagtcgaggcaccataatccgtaanacacgtccaaagaaccaattctccctgaagctgganctctgtgaccgccgcagacacggctgtctattacngtgcgaggccccgagcgcagtgcttttgatgtctttgtatatgtggggccaagggtaccaagtcggtacaccggtc

SEQ ID NO: 127173 - DNA, 580 bp, Homo sapiens
  misc_feature: GYAE6OF02GULZ0.48.59.F04.1.454.CMB.1.raw
  modified_base (330)..(330): a, c, t, g, unknown or other
  misc_feature (330)..(330): n is a, c, g, or t
  modified_base (505)..(505): a, c, t, g, unknown or other
  misc_feature (505)..(505): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtgctccatcagcagcagttacttacgttcgtgggctggctccgccacgccccgaggacggggctggagtggagttgggagttacttaccacgagtagggacnccacctactaaccaacccgtcctacaaacgtcgagccaccatacgtaccgtagaccacgtaccaaacgaaccctaattacctaccctagaacgtcgtacgacgtcctacgtcgtacgacccggccgacgaacgccacggtctcgtctattacgtgtcgcgaccggcccgagccgngtacggtgttcttttgcgttcgtcgtttagagtgtcggtgggacccgtagggactaagtcggttactcccgttcg

SEQ ID NO: 127174 - DNA, 621 bp, Homo sapiens
  misc_feature: GYAE6OF02J1QK2.48.59.F04.1.454.CMB.1.raw
tcagagtatacatacacgaccggtgctcgatttagtacacacacttagggagttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgctactgtctcgtggtcgctccatcagcagcagtacttactcgtgggctggactccgccacgccccgagggacgggcgtggacgtggacgttgggagttacttaccgacgtaggtagggacgtcctaaccgtactaaccgtaacccgtcctaacgtaaacggtcgacggaccaacctagtactccgtaacgacctaccgtaccaacgaacctaacttccgtacccgtagaacgtcgtagacgtctcgtgtcgacccgcgacgacgacgtaccggtcttacgtacttagttaccgtggtacgtccggtaccgggtccccgagtccgtacgtacgggttcgttcgttttagacgtttcgtcgttgtagtcgttcggacggtacgtaggactagtcggtacctacgttcg

SEQ ID NO: 127175 - DNA, 601 bp, Homo sapiens
  misc_feature: GYAE6OF02FKP58.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaactggccaggctccaggctcctcatctacgtgcatccagcagggccagtggcactcccagacaggttcagtggcaggtggtctgggacagacttcactctcaccgtcagcagcgtcggaccctgtaagtattttgacgtagttgttactttacgtagtacgtacgcgtaagtttacgtagggttagccttacctaccgtacgttaccgtaccgttcggtacccgaacgggtaccacggtaacgtcgggtaacgtaacgttaaccgtaacgttggtcggtacctcggtaccacgtacgtcgttacgttccttactacttcccgtcccgtacctagtcctgtactgttacttaacg

SEQ ID NO: 127176 - DNA, 832 bp, Homo sapiens
  misc_feature: GYAE6OF02JCI19.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctccagatgggtcctcgtcccagctgctagctgcgaggacggtccgggacccaggacgtggtacgaacgtccgttcggaacgacccttcggtccctacaccgtgacctacgtcggtccttcgtggtacgcctaccactcgagccgagtacctacgttacttacgtcggtacggggtctacggtcgtcccgaccgaacccggccccggaaggggtacgggtcgtacgggtaggtgggtaacggttggtaacggtttaccttaccggaacgtagggtacgggaccgtaaccgtaaccgtaaccggtaccccgtaaccccgttaacccgtaacggaaaacgtccggaccgtaacctaaccgtaacggtaccgttaccgtaaacgtaacccgaccggtaaccgtaaaccggtaaccttaaccgttacccgtaacccgttaggaaacccgtcgtaacggtacgtaccgttacgtccggtaccggacccggtaccgacggaaccgtacggtaccggtaccttaccggttaacgttaccgttaacggttccggtaccggtaccgggtacccggacccggtcggtacggtaccgttaacggttcgttaacgtttcgtaccggtttccgttaacgttaggttacgttaccggtagggtacccggtaacggtacggttaaccttacgggtacccggttcccgtaaccgtccgg

SEQ ID NO: 127177 - DNA, 622 bp, Homo sapiens
  misc_feature: GYAE6OF02ICX1V.48.59.F04.1.454.CMB.1.raw
  modified_base (263)..(263): a, c, t, g, unknown or other
  misc_feature (263)..(263): n is a, c, g, or t
  modified_base (400)..(400): a, c, t, g, unknown or other
  misc_feature (400)..(400): n is a, c, g, or t
  modified_base (448)..(448): a, c, t, g, unknown or other
  misc_feature (448)..(448): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtccgggccaggactgggtagaagccttcggagaccctgtccctcacctgccactgtctcgtggtcgctccatcagcagcctagtaccttacttcgnggggctggactccgcctacgccccgaagggacgggctggacggtggtagtgggtagttaattaccacgaggtagggactctaacctacgaaccgaacccgtcctacaaaacggtcgaagacacgatacgtccgtaanacacgtacccaaagtaacctacttaccctacgtacgaagcgtagtacncgtctacggcgtaacccggcgacgacgaacgacgtctacggtaccttattacgtagtcgaccgtacggcccgagccgcgtacggttgttcgtttttgaactttggtcctttaggacggttagtcgggttacgggacgtaagggaccttaaggtcggttaccgttccgttacccg

SEQ ID NO: 127178 - DNA, 577 bp, Homo sapiens
  misc_feature: GYAE6OF02FHNRH.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtgggctggactccgccagccccccgaggggaaggggcgtggagtggagttgggagtactttaccgacgaggtgggacgaccgacctactaaccaacccgtccctacgaaacgtcgacggaccacgatactccgtagacaccgtaccaacgaaccaacttcctacctgaacgtcgtagacgcgtcgtgtcgaccgccgacgacgacgacggtctcgtctacttactgtcgcgacgtcccgagccgacgaggttcgtcttttgacttcggtcctttgatcgtcggtgggaccgtaacgggactaacggtcggtacctacggttcc

SEQ ID NO: 127179 - DNA, 436 bp, Homo sapiens
  misc_feature: GYAE6OF02GA7K1.48.59.F04.1.454.CMB.1.raw
  modified_base (411)..(416): a, c, t, g, unknown or other
  misc_feature (411)..(416): n is a, c, g, or t
  modified_base (418)..(436): a, c, t, g, unknown or other
  misc_feature (418)..(436): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttcccccctggcaccctcctccaagagcacctcgtgggggcacagcggccctgggctgccgtggtcgaaggacctacgttcctctctgtactctgagcgggctgggcaaggcgcatgnnnnnncnnnnnnnnnnnnnnnnnnn

SEQ ID NO: 127180 - DNA, 626 bp, Homo sapiens
  misc_feature: GYAE6OF02F0FMA.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactgggtgaacgccttcggagaccctgtccctcacctgcactgtctcgtggtcgctccatcagcagcagtacttactcgtgggctggactccgccacgccccgagggacgggcgtggagtcggagttcgggagttactttaccgagtaggtacgggacgtaccgaacccttacgtaccgtaaccccgtccctaacgaaacggtccgacgaccactagtacgtaccgtaagacctaccgtaccaaacgtaaccctacttcctacccgtagaacgtcgtagcgtcctacgtcgtccgacccgccgacgacgtaccgaccggtctcggttactacgttacgtggtcgaccggaccggtccccgagccgtcgtacggttcgttcgttttgacgttcgttcgttagtagtgttcggcgggtacgtaggaccgtacgtcgtaccgtaccgttcg

SEQ ID NO: 127181 - DNA, 435 bp, Homo sapiens
  misc_feature: GYAE6OF02IX6KD.48.59.F04.1.454.CMB.1.raw
  modified_base (418)..(418): a, c, t, g, unknown or other
  misc_feature (418)..(418): n is a, c, g, or t
  modified_base (421)..(435): a, c, t, g, unknown or other
  misc_feature (421)..(435): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaaagggacaatggtcaccgtctcttcagccctccaccaaacgggcccagtccggtccttcccccgtggccacccctcctccaagagccacctcgtcgggggcacgagccggccctgggctgctggtacaaggacttacttcctctctcgtctctgaggcggctggcgaggcgcanagnnnnnnnnnnnnnnn

SEQ ID NO: 127182 - DNA, 741 bp, Homo sapiens
  misc_feature: GYAE6OF02JYR3F.48.59.F04.1.454.CMB.1.raw
  modified_base (157)..(157): a, c, t, g, unknown or other
  misc_feature (157)..(157): n is a, c, g, or t
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcngctgcaggagtcggcccaggactggngaacgccttcggganccctgtaccctctacctcgcactcgtctcgtggtcgcctaccgatcgagccacgtctaacgtacttacgttcggtgggctacggactccgcccgacgtcccccggaggggaacgggcggtagacggtgtacgttgggtattaacgttacgacggtaggtggacgcctaaccgtaaccgtaccgtaaccccgtacccgtaacgaaaggtaccggacggtaccacctaagtaccgtacgtaacgacctaaccgtaccgaaacggtaactaacgtaccgtacccgtaggtaacgtactacggtacgtaccgttccgtacgtaccggacccgaccggtaacaccggacccgtaccggttacgtacgttaccgttacgttaaccgttcggaccggtaacccggggtccgggtaacccggacgggtccgacggttaacgttaccgggtttactttcgggttaaccgttcggttcccgtttaggttacgtaccggttcggtaccgggtaacgtagggtaaccgtacggtacgggttcctaccgttaaccg

SEQ ID NO: 127183 - DNA, 868 bp, Homo sapiens
  misc_feature: GYAE6OF02F9JWG.48.59.F04.1.454.CMB.1.raw
tcagagtatacatacacgaccggtgctcgatttagtacacacacttaggattggggctttctgagagtcatggatctcatgtgcaagaaatgaagcactgtggttcttcctcctgctggtggcggcctcccgagatcgggtcctcgtcccagtctgcagctgcaggagtccgggcccaggactgggtagaacgtccctttcggacgtaccctcgtcccctcacccgtgcctacgtcgtccttcgtgggtcggcctcccgatcgacgtccagctacgtaccttacgttcgtcgggctacggctcccgaccgaccgcccccggaaggggaacgggcgtacgggtacggtcgggagtttacgggactttacgtttaaccgccgtaaggtggggaactccgtaaccgttaacccgtaccgaaaccccgttaccccctaaagaaaaccgttacggaccgtaaccgaccctaacgttacgtacgtaacgacctaaccgtaccaaacgtaacctaacgttccctacccgtagtaaacgtccgttaacgtacgtccgttacgtacggttaccggaaccccggtcccgtaacggaaccgtaaccgtaacccggtcgttaccggttacccgttaacgtttaaccggttacggttacccgggtacccgggtaaccggttaccccccggaacgggtacccgtaaccggttaccgggtttaccgggttaccgtttttttaccggaacggttttcccgtttaacccggttttaacgtaccgtttaacggggtttaccggtaacccgggggttaaccgtaaaccggggtttaaaccgtaacgggtttaaccccggttcccgggttaacccggtttaaccccgg

SEQ ID NO: 127184 - DNA, 667 bp, Homo sapiens
  misc_feature: GYAE6OF02HJCZX.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactgggtgaagtccgttcggacgaccctgtccctcacctgctactgtctcgtggtcgcctaccatcagcagcagttacttactcgtcgggctggctccgccgaccggcccccgaggggacgggtctgggagtggtagtgggtattacgtttaccgacggtagtcggggacacctaccgtacctaaccgtaaccccgttaccctacgaaaacggtcgacggaccaccgtataccgtccgtaagacctaccgtaccaaacgaacctactccgtaccagacgtcacgtacgtctacttggaccgacccggtcgactaccggacgtccggacttcgtacttacgtcgtaggtaccgacccggcggtaccccgcgtaccggtccgtaacggttccggtttatttaccggtagttccgttacggtttgtaacgttcgggtacgggtacgggtaccgtaaagggacttaacgggtccggttaccgccgtttaaccg

SEQ ID NO: 127185 - DNA, 719 bp, Homo sapiens
  misc_feature: GYAE6OF02I2PMO.48.59.F04.1.454.CMB.1.raw
  modified_base (136)..(136): a, c, t, g, unknown or other
  misc_feature (136)..(136): n is a, c, g, or t
  modified_base (166)..(166): a, c, t, g, unknown or other
  misc_feature (166)..(166): n is a, c, g, or t
  modified_base (208)..(208): a, c, t, g, unknown or other
  misc_feature (208)..(208): n is a, c, g, or t
tcagagtatacatacacgaccggtgctcgatttagtacacacacttagggagttgggggctttctgagagtcatggatctcatgtgcaagaaaatgaagcactgtgttcttcctcctgctggtggcggcctccagngtgggtcctgtcccagctgcagctgcaggngtccgggccaggactggtgagtccttggacgccctgtccctnacctgacctactgtctcgtcgggtacgcttaccagtcacgcaagctagttaccttacgtcggtgggctaggaactcccgtccgaccgacccggaggggacggtcgtggggagtgggtacgttgggactttacgttaccgacgtaggtcgggacgtccaaccttacgtaaccgtaaccccggttacctaacgtaaacggtcgacgaccactactacgactacgaccacgtaccaataacctacttaccgccgtagaacgtcgtacgtacgtccgtacgtacggaccgtacccggactacgaaccggtaccgtaacggtccttacggttaacttcgtttaacgttcggtcgggtaacccggtacccggtaccccgagtccgggtacttacgggttcgggttttacctttggtaccggtttctttaacccgttggttaaaccgttcgggtttacgggaccgggttaaccggtaacgggtcggtaacccgtttacgggtccccttacggtttccg

SEQ ID NO: 127186 - DNA, 577 bp, Homo sapiens
  misc_feature: GYAE6OF02HZ7NN.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcacgtgtctctggtcgctcatcagcagcagtacttacttctgggctggatccgccacgcccccgaagggacggggctggacgtggattgggagttattaccacgagtagggacgcacctactacaacccgtcctacgaaagtcgagcacatactcgagacacgtcaagaacctaattcctacctagaactctagagtctactgtcgaccgccgtacgagacgacggtctcgtacttagttaacgtgtacgcggaccggtcccgaagtccgactacggttgttctttttaggcttacggtcctttagacttagtacgggtggggacccgaagggtactaaacgtcggttacctaccggttaccg

SEQ ID NO: 127187 - DNA, 927 bp, Homo sapiens
  misc_feature: GYAE6OF02IZ3UB.48.59.F04.1.454.CMB.1.raw
  modified_base (182)..(182): a, c, t, g, unknown or other
  misc_feature (182)..(182): n is a, c, g, or t
tcagagtatacatacacgaccggtgctcgatttagtacacacacttagggattgggggctttctgagagtcatggatctcatgtgcaagaaaatgaagcacctgtgttcttcctctgctggtggcggctccagatggtcctgtcccagctgcagctgcgagacgtcggccaggtactgggtnaacgtccttacgggagacccttcgtccctacgtactcgaccgtactcgtctcgttgggtcgtacccttaccgattcgacgaccgtaacgtacctacggtttaaaccttttaaccggtttccggtacggggggttaccttacggacccgtttcccccggacccgaaccccgggtaaccccccgggaaagggggtaaccgggggtcctaggggggttacggttacggggtaacgggtttacggggggttaaacttttaacgtttaaccccggtaacgggtaagggttaccggggtaacgtaccttaacccggttaaccccgtttaaccggtaaaccccccgttactaaaccgggtaaaacggttccggaacccgggtactaaccgtaaacgttaccgttaccgtaaccgaaacgtaacccggtaaccgtaaaacgtaaacccgtttaacgttacccgtaaccctacggtaaacgtaccgttaccgtacgggtccgttaccgtacggtacccggtaacccggaccgtaaccggaacggtaccggtaaccgggtacggtttacttacgtttaccgtttacggtagttaccgggaaccggtcccgtacccgggacgtaccggacggttacgttacgttaccgtttttcgaccggttttacggtccgtttaagttacggttaggttaccgggttacggggtaaccgtaacgggtaaccgttacggttaccggtaccgttaccgttaacccg

SEQ ID NO: 127188 - DNA, 679 bp, Homo sapiens
  misc_feature: GYAE6OF02IDTUK.48.59.F04.1.454.CMB.1.raw
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
tcagagtatacatacacgaccggtgctcgatttagtacacacacttagggattgggggagagctgctcagttaggacccagagggaaccatggaaaccccagcgcagcttctcttcctcctgctactctggctccagatgcccccggagaaattgtgttgacgcagtctccagaccacctgtctttgtctccgagggaaagagccaccttctcctgcgacggtccagtcagacgtctaccgaacgactacttacgcctgaccatcagaacctggccaggccnccnggctcctctactctacggtgctactccgagccgacggccacgtcggcactcccgagtacgaacggttcgagtcggcacggggttcgggtacgtcggggaaccgtacggtaacctttccgtaccgtccgtactaacccgtcgaaggtacccaacggtaccgtacggtacccgtaggtaacgtaacgttttgacgttaagttaggttaaacgttacttacggtactacgtacgtaacgttaacgtgggtactcgtaccgtaccgtactacccgtaaccggtaccggacccggtaaaggaccgtaacgtacgtaacggtagtaaccgttaaccgaaggttcgtacggtcgtacgtaccctaccgtacgttaccgttacgtcttacgttcttaccccg

SEQ ID NO: 127189 - DNA, 459 bp, Homo sapiens
  misc_feature: GYAE6OF02GISIC.48.59.F04.1.454.CMB.1.raw
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (399)..(399): a, c, t, g, unknown or other
  misc_feature (399)..(399): n is a, c, g, or t
  modified_base (428)..(428): a, c, t, g, unknown or other
  misc_feature (428)..(428): n is a, c, g, or t
  modified_base (433)..(459): a, c, t, g, unknown or other
  misc_feature (433)..(459): n is a, c, g, or t
tcagagtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatcgctttgattatggtggggaccaagggacaagtggtaccaccgtctcttcagccctaccacgaacggccagtccgtccttccccgnggccaccctcctaccaagcgccncctcggcgggacacgacgccggccgtgggctcgctggacaaggcttaccttctatcgtaactctntggacgcgggtctaggacgaacgtcgacngtagnnnnnnnnnnnnnnnnnnnnnnnnnnn

SEQ ID NO: 127190 - DNA, 801 bp, Homo sapiens
  misc_feature: GYAE6OF02JG9H3.48.59.F04.1.454.CMB.1.raw
tcagagtatacatacacgaccggtgctcgatttagtacacacacttagggattgggggctttctgagagtcatggatctcatgtgcaaagaaaatgaagcacctgtgttcttcctcctgctggtggcgctccagatcgggtcctgtccagctgcagctgcgaggaggtccggcccaggaccgtggtagaagtccttcggacgacccttcggtccctccaccgtgactcgtcgtctcgtggcgcctcgactcagcgaagctacgttacttaccgttcgtcggtcgtacggacgtccgccgaaccggacccggtaggggacgggtcgtgggtacggttacggtaggttcgggtaacgttacgttaaccgtacgtaacgggtcgggtaacgtaccgtacccggttaaacctaaccgtaaccccggttaaccccttaaaacggtaaaacccgggttacggaacccggtaaccgtaacccgttaacgtaaaccgtaacccgggtaaacgtaaccgtaaacccggtaaacctaaaccgtaaaccttaacgttacccgttacgaaacgtacgtacgaacggtcgttaccgttacgggttacgccggtaacccggccgtaacgtaaccgggacctaaccggggttctttacggtaaccgttttaacgttacgtcgggaacgttacccgggccgggaacccgtacgtcgaccggtttgttacggttttcgttataccggttcgttcgttaagtcgttagttccggggtacgtacggaacggtcctacgggtacgttccggaccttacccg

SEQ ID NO: 127191 - DNA, 542 bp, Homo sapiens
  misc_feature: GYAE6OF02HVSJU.48.59.F04.1.454.CMB.1.raw
  modified_base (384)..(384): a, c, t, g, unknown or other
  misc_feature (384)..(384): n is a, c, g, or t
tcagagtatacatacacgaccggtgctcgatttagtacacacacttagggattgggggaagacaatgggtttgattcagattacatgggtgacttttctgttgtatttccaatctcagatcgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccacgtggcatcccagacgaggttcagtggcaggtgggtctgggacagtactcactctacaccgtcagcagactcggaccctgaagtntttagctagtgttattacgtgtcagactagtagtggtacgctaccgacgtatactaccgttcggacgaagggacacgacgtgagtacgtaaccgagttgtcgactgacacctagtcgtgtaccttctacttccttacccgctatctgattactagtac

SEQ ID NO: 127192 - DNA, 762 bp, Homo sapiens
  misc_feature: GYAE6OF02I4S8Q.48.59.F04.1.454.CMB.1.raw
tcagagtatacatacacgaccggtgctcgatttagtacacacacttagggattgggggctttctgagagtcatggatctcatgtgcaagaaaatgaagcacctgtgttcttcctcctgctggtggcggctcccagatgggtcctgtcccagctgcagctgcaggacgtcggggcccagggtactgggtgaacgtccgttcggacgtaccctcgtcccctcaccgtgcactcgtctcgtggtcgctccatcagcagctagtacttactcgtggggctggactccgccacggccccgagggacgggtctggaggtcgggtagttggggtaactttacgtttaacccgacgtaagggtcggggaactccgtaacccgttacgttaacccaaccccggttaaccctaacgtaaaacggtccggaacggacctaaaccgtacttaccgttaccggtaacgaacccgtaccggtaaccaaaacgtaacccgttaactttcccgtaacccgtagaaccgtccggtacgtaccgttccgttccggtacgttacccggacccggtacccgtacggtaaccggaccggtaccgggtctttacggttacctttaaccgttacggtcgttcgggaacccggtacccggtccccggaagtacccgcggttaacggttcggttttccgttttagcgttacggtttccgtttacgagttttacgcgggttacgggacgtaaccggtaacgtagggttccgtaccgtacggtttcccg

SEQ ID NO: 127193 - DNA, 859 bp, Homo sapiens
  misc_feature: GYAE6OF02GZ2H3.48.59.F04.1.454.CMB.1.raw
tcagagtatacatacacgaccggtgctcgatttagtacacacacttagggattgggggctttctgagagtcatggatctcatgtgcaagaaatgaagcactgtgtcttctctgctggtggcggctcccagagtggtcctgtcccagctgcagctgcaggagtccgggcccaggtcgtgggtagaacgtcccgtttacgggacgaccccgttgtccccctcaaccgttggacctacgttcgttccttcgtcgggttacgccttacccgatccaggcctacgacctaacggttacctttacgtttcgtggggtcgtacggtacctcccgcccgaccgcccccggaaggggtaaccggggtcgtacgggacggtagggtacggttacgggtaagtttaccgtttaaccgacggtagggttacgggacgaccgtacccttaacgaactaaccgttcccggtaccctaacggtaaacgtccgaacggaccctaacgtaataccgtaccgacgtaccgtaccgtaacccgaaacggtaaaccctacgtttacccgttaacccgtaggtaaaccgtcgtaacgtacgtaccgttccgttaacggtacccggaccccggttacccgaacgggtaaccaaccggttacccggacgtttacgttaaccgttaacttacccgtttcggacgggtacccgaccgggtaccccggtacggtccgaacgttaccgggtttccggtttacctttttacggtaccgtttccggttaccggtttaaccggttaagtttaccgggttaggggttacccggggttaaccggtaaaccgggtaacggttaaacgggtttccgtacccggtttaacccgg

SEQ ID NO: 127194 - DNA, 593 bp, Homo sapiens
  misc_feature: GYAE6OF02FITXV.48.59.F04.1.454.CMB.1.raw
  modified_base (426)..(426): a, c, t, g, unknown or other
  misc_feature (426)..(426): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagtccttcggagaccctgtccctcacctgcactgtctctggtggctccatcagcagcagtacttacttctggggctggatcccgccacgcccccgaggaggggctggagtggagttggagtactttaccgacgagtggggagccacctactaccacccgtccctacaaagtcgagcactatactccgtagacaccgtacaaacgacctaattcctaccctgaacgctgagtctacgttgngtacccgccgcaacgaccacggcttcgtaccttagttactgttacggccgtacggtccccgagtccgactaggtcggttctttttgactcggttcctttacggtacttagttacgggtcgggacccgtaagggggtaactaaggtttacggtacctacccggttacc

SEQ ID NO: 127195 - DNA, 854 bp, Homo sapiens
  misc_feature: GYAE6OF02IN990.48.59.F04.1.454.CMB.1.raw
  modified_base (184)..(184): a, c, t, g, unknown or other
  misc_feature (184)..(184): n is a, c, g, or t
  modified_base (253)..(253): a, c, t, g, unknown or other
  misc_feature (253)..(253): n is a, c, g, or t
tcagagtatacatacacgaccggtgctcgatttagtacacacacttaggattgggggctttctgagagtcatggatctcatgtgcaagaaaatgaagcacctgtggttcttcctctgctggtgcggctccagagtggtcctcgtcccagctgcagctgcaggcgtccgggcccaggtacttggngaacgtccttcggacgtacccttggtcccctcgacctgcctacgtgttccttcgtaggtcgtcctaccngtccaagtccaacgtcacggtttaccttacgttccggtcgggcgtacggtacgtcccgaccgtcccggacccccggaagggggtaccgggtcggtagggacggttaggtagggtttacgggttaacgttaccgtttaaccgacgtaagggtcggggaaccttaccgtaccgttaaccctaaacccggtaacccccgttacccgaaccggttaaaacggtccggtaaccggtacctaaccgtacggttaaaccgttaccgtaaccgtaccgtaaaccggtaacccgtaaaaccgtaaaccttaaccgtttaccctacccgtaagggttaaaccgccggtttaacggacccgttactttacccggttacggttaaccccggccccgttagggaacccgtacgtaacccggacgtttcgttaacgtacctttaacgttaacccgtttggaccgtaccgggacccggttaaccgcgtacggttacgccgggtttatttccggtttaggacccttcgggtttaccttttaaggacgttaccgggttcggttcccgggaaaggtaaccggtaacgttaacgggtttccgaccggttcccgtttaccg

SEQ ID NO: 127196 - DNA, 772 bp, Homo sapiens
  misc_feature: GYAE6OF02H5BDX.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtgcggctcccagatgggtcctgtcccagctgcagctgcaggagtcgggcccaggactggtgaagccttcggagaccctgtccctcacctgcactgtctcgtggtcggctccatcgagcagctagtacttacttcgtcggggctggactccgccacggccccaggggaagggctggagtgggagttggggagttaacgtttaccacgtaggtacgggacgcctaaccgttactaccgaaacccggttccctaccgaaaaaggtccgaagggtaccaaccctaagtacctaccggtaacgaaacctaccggtacccaaaccgaaacctaaactttcctaaccccgtagaaacgtacgtcgtaacggtccttacgtacggttaccgaacccgggtaccgaccgaacggaaccgtaaccgggtccttagggtacccttaacgtttaaccggttcggttacggacccgggtaacgggtaccccccggtaaggcccggtacggttaacgggttcccggggtttacctttttttagggaacttttccgggtacccgtttttaggtaacgtttacggttaccgggttacggggggtacccgttaaacggggtaaccgttaaaggttccgggtttaaccccgtacccggttttacccg

SEQ ID NO: 127197 - DNA, 636 bp, Homo sapiens
  misc_feature: GYAE6OF02HSI8W.48.59.F04.1.454.CMB.1.raw
  modified_base (379)..(379): a, c, t, g, unknown or other
  misc_feature (379)..(379): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccgttcggacgacccctgtccctcacctgcactgtctcgtggtgctccatcagcagctagtacttactcgtgggctggactccgccacgccccgagggacggcgtggaggtggagtgggtatattaccgagtaggtggacgcgacctaactaccgaaccgtcctacgaaacgtcgagcacatactcgtanacacgtaccaaagaacctaacttcctacccgtagaacgtctagtacgtctacgtcgtaccgaccgccggacaacgaccaccggtactcgtaccttacgttaccgttcggtcgaccggaccggaccccggtagccgacggtacgttcgggttactttttcggacgtttcgggttacccttttaggtacgttacgttcggggttaccgggtacccgaagggtaccgttaaacggtttcggtacccgtaaccggttcccg

SEQ ID NO: 127198 - DNA, 681 bp, Homo sapiens
  misc_feature: GYAE6OF02FN1UP.48.59.F04.1.454.CMB.1.raw
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccagggaagagccaccttctcctgcaggtccagtcagagtcttacaacgactactancctggtaccatcagaaacctggcagctccaggctctcatctacgngcatccagcagggccacgtgcatcccagacgagttcagtggacaggtggtcgtagggactagtcgttccatcgtacctaccgttcacgacgagacgtacgacccgttgaaccgttagttttcgacgttacgtcgttaagtttacgtcgttacaggtacgtaaagtaggtacggttacgacgttacgaccgtactccgttaaacccgttcggtaacccaagggtaaccgtacggtaaccgtagggtaacgtaaacgttaaacccgtaacggttcggtaacggttaccgtacggtaccgtacccgttacgtaccgtttaggttccctttacgttacccttacccggttccccgttaaccgttacgttacccggtttaccgtaaacgttttaccggttaccgtttaaccgg

SEQ ID NO: 127199 - DNA, 717 bp, Homo sapiens
  misc_feature: GYAE6OF02IVRVI.48.59.F04.1.454.CMB.1.raw
  modified_base (200)..(200): a, c, t, g, unknown or other
  misc_feature (200)..(200): n is a, c, g, or t
  modified_base (665)..(665): a, c, t, g, unknown or other
  misc_feature (665)..(665): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtccgggcccaggactggagaacgccttcggganacccgtgtccctcacctgctactgtctcgtgggtcgcctccatcagaccagtccagttaccttacgttcgtgggtctggactccgacccgacggccccccggaaggggaacggggtcgtaggggtacggttagggtaaggttggggtacgtttaacgttttaaccgaacgtagggtagggaccgtaccgtaaccccttaaccgtaaaccctaacccccgttacccgtaacgaaaacggtccggacggaccaaccctaagtaaccgttaccggtaacgacccgaaccgtaaccgaaaacgacccgttaacttaccctcccgtaagaactcgtacgacgtctacggtacacgacccgcggacgacgaccgtcgtacttctacgttaacttacggtgaccgaccggacccgggtcccgacggtcgccggttaaggttccggtttattttgacgtttcgttccgtttanacggttagtcggtcgggtactaccggtaccgtcggtactcccgttctcccgg

SEQ ID NO: 127200 - DNA, 694 bp, Homo sapiens
  misc_feature: GYAE6OF02JFX8Z.48.59.F04.1.454.CMB.1.raw
  modified_base (332)..(332): a, c, t, g, unknown or other
  misc_feature (332)..(332): n is a, c, g, or t
  modified_base (653)..(653): a, c, t, g, unknown or other
  misc_feature (653)..(653): n is a, c, g, or t
tcagagtatacatacacgaccggtgctcgatttagtacacacacttagggattgggggctttctgagagtcatggatctcatgtgacaagaaaatgaagcacctgtggttcttcctcctgctggtggcggctcccagagtgggtcctgtcccagctgcagctgcaggagtcggcccaggtactggtagaacgccgttacggacgtacccgtcgtcccctcgacctgcctacgtcgtctcgtggtcgcctccagtcgagcagctacgttcttacgtcgtgggtcgtggtactcccgccgaaccggtaccccggaaggggacgggtcgtacggngtacggtagtacggtagttacttaccgagtacggtgggactaccgtacctaaccgtaccgtaacccgtaccctaacgaaacggtcgaaccggacctaaccgtacgtacgtaccgaacgtaaccgtaccggtaaaccaaacgtaaccctaacgtttaccctacccgtaagaacgtcctacgacgtacttaccgcgtaccgacccgacgtaccgacgtaaccgccgttactacgtacctaacgttacgtgtacccggtagcccggtacccgagtcccggtagtacgttcgttacgtttgacgtttcggtacttgagttaccgnggtaccgggaacgtaacggataccggtagtcctaccggtac

SEQ ID NO: 127201 - DNA, 679 bp, Homo sapiens
  misc_feature: GYAE6OF02G4Q4D.48.59.F04.1.454.CMB.1.raw
  modified_base (167)..(167): a, c, t, g, unknown or other
  misc_feature (167)..(167): n is a, c, g, or t
  modified_base (267)..(267): a, c, t, g, unknown or other
  misc_feature (267)..(267): n is a, c, g, or t
  modified_base (337)..(337): a, c, t, g, unknown or other
  misc_feature (337)..(337): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagagtgggtcctgtcccagctgcagctgcaggngtccgggccaggtactggtgaacgtccttcggacgacccctgtcccctcacctgccacctgtctcgtggtcgctccatcagcagctagttactacttcgngggctggactccgaccacgccccggagggaggcgtggagtaggtaggttgggtattacttacgagtaggnggacgccacctacgtaccaacccgttacctacgaaacggcgacggccaacgtatacgtaccgtacaaccaccgtaccaaacgtaacctacgttccctaccgtagaacgtctacggtacgtcttacgtcggtaccgaccccggacgtaccgaacgtaccgacggtacctttagtaccgtttagtacccggttggtaccggaccgggacccgtaccccggtacgtccggtacctaggggtttcctttacggttttcggacttcggttacgtttacgtagttcggttacggggtaccggtaccggtaaggtaaccgttaacggttcggtaccgttaccgttaccg

SEQ ID NO: 127202 - DNA, 735 bp, Homo sapiens
  misc_feature: GYAE6OF02J2RZI.48.59.F04.1.454.CMB.1.raw
  modified_base (235)..(235): a, c, t, g, unknown or other
  misc_feature (235)..(235): n is a, c, g, or t
tcagagtatacatacacgaccggtgctcgatttagtacacacacttagggagttgggggctttctgagagtcatggatctcatgtgcaagaaatgaagcacctgtgtcttcctcctgctggtgcggctccagatgggtcctgtcccagctgcagctgcaggagtcgggcccagggactggtgaagtcccgtttcggacgaccctggttcccctcaccctgacacttggtccttcncgggtggccttccatccaaggcaaggtcagttaccttaacttccgtggggctggactccgcctacgcccccgagggaagggctggagtcggattcgggacgttactttaccgaacgtagtcgggacgtaccgtacccgtaccgtaacctaaaccccccggttcccgttaacccgtaaaaacggttcccggaacgggaacccgtaacccgtaaactttaacgtacccgttaacgaaccctaacccggtacccaaaacgggtaaacccctaaacgtttccctacccgttacggaaactccgtagtaacgtccgtacgttcgtacgacccggacctcgaacgactaccggactacgtccgtattactggttcgcggacggtccccgaggtccaggtaccttggtccctttttagacgttcggtacccttttggaaccttacgttacgggtacggttaaccggaaggtaaccgttaagttaccgggtacctacccggttacccg

SEQ ID NO: 127203 - DNA, 652 bp, Homo sapiens
  misc_feature: GYAE6OF02G7KFL.48.59.F04.1.454.CMB.1.raw
  modified_base (182)..(182): a, c, t, g, unknown or other
  misc_feature (182)..(182): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccgagggaaangccaccttctcctgcatgtccagtcagagtcttaccaacgactacgttagcctggtaccatcaagaaacctggccaggcctcccaggctcctcatcgtacggtgcactccagcgacggccgacgtcggcctactacccgaagaccgtacggttcgaggtcggcgaggttcgggtcgtgggacgacgtacttcgtactcctccgaccgtcgagcgacgtactacggtaccctagaacgttattttacgactagtagttactttacgtgtacgtagtacaggttacgtggtacgtcctaccgtaccgtacgtacctaccgttccggtaaccgaacgggtaccgtaccggtacgtacgtaacgtaacgttaaccgtacgtcggtacgtcgtacgaccgtacgttacgtccgttgttaccttactaccgtttccgtcccgtacgttacgttccgtaacgttcgttaagttaccg

SEQ ID NO: 127204 - DNA, 648 bp, Homo sapiens
  misc_feature: GYAE6OF02IUBNG.48.59.F04.1.454.CMB.1.raw
  modified_base (60)..(60): a, c, t, g, unknown or other
  misc_feature (60)..(60): n is a, c, g, or t
tcagagtatacatacacgaccggtgctcgattttagtacacacacttagggattgggggntttctgagagtcatgatctcatgtgcaaagaaaatgaagcacctgtggttcttcctcctgctggtggcggctcccagatgggtcctgtcccagctgcagctgcaggagtcgggcccaggactggtgaagccgttcggacgaccctgtccctcactgcactgtctcgtggtcgctcctatcagcagctacgttacttacttcgtgggcgtcggacctcccgccgaccgaccccggaggggaacgggtcgagggaggtggtagttggggacgttacgttaccacgaggtgggacgtactacgtacctaccgacccgtacctaacgaaacgtcggacgaccactacttacgtacgtaagacgtaccgtacgaacgtaacctacgttcccgtacccgtagaacgtcgtcgtacgtctcgtggtaccgcccgcgtacacgaccgtcgtcgttcgtacgtagtacgtgtacgccgaccgcccgaagtccgtcgtacgggttgtttaccgtttgacgtttccgttcgtttacggacgttcggtcgggtaccgggtaacgtaacgggtactaaggttccggtaccgtaccgttccg

SEQ ID NO: 127205 - DNA, 864 bp, Homo sapiens
  misc_feature: GYAE6OF02JVUQH.48.59.F04.1.454.CMB.1.raw
  modified_base (178)..(178): a, c, t, g, unknown or other
  misc_feature (178)..(178): n is a, c, g, or t
tcagagtatacatacacgaccggtgctcgatttagtacacacacttagggagttgggggctttctgagagtcatggatctcatgtgcaagaaaatgaagcacctgtgttcttcctcctgctggtggcggctcccagatcgggtcctgtcccagctgcagctgcgaggacgtcggccgngactggtgagcccttggacgacccgtcgtccctacgtaccctgcctacgtcgttcctcggttcggggtcggtcccttacccgtacttaccgaacggaccaaacggtccgtaacgtttacccttttacgtttccgggtcggggtccgtacggtaccgttccccgacccgacccccgggaccccccggtaaggggggtaaccggggtcggtaggggtacggtttacgggtaacggtttacgggtaacgtttaacgtttaccggaacgtacggggttacgggacgtaacccgttaacccgttaacccgtaaccccgtaaaccccggttacccgtaaaccgtaaaaccgggtcgaacccggtaccgaccgtaactaccggttacgaacgtaaaccgaccgtaaaccgtaaacctaacccgttaacttccccgtaaccgtacggtaacgtacgtacggaaccgttaccgtcgttacggaccgtaacccgccgtaaccgtaacgaccgtaccgtccgttacgttaaccgttacgtttaccgacgggtaccgccggaacccggtcccggaacgggtcccgtaccgtacggttacggttttccgtttacgtacgttaccggttgtttacggagttcggttacggacgggtaaccgtacgggtaacttacggttacccggtacgtacccgttccg

SEQ ID NO: 127206 - DNA, 664 bp, Homo sapiens
  misc_feature: GYAE6OF02FXA6J.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctccagatgggtcctgtcccagctgcagctgcaggagtcgggcccagggactggtgaagcccttaggagaccctgtccctcacctgctactgtctcgtggtcgctaccatcagcagcagtacttacgttcgtgggctggactccgccgacgccccggagggacgggcgtggagtggaggttgggtacgttacgttaccgacgtaggtcggacgccgtaacctacgtaaccgtaacccgtaccctaacgaaaacgtcggaacgtaccaactacgttactaccgtaacgacgtaaccgtacccgaaaacgaaccctaacgttcctacccgtagaacgtcgtagacgcttacgtcgtccgacccgcgacgacgacgacgggtctcgtactacgttacgtgtacggccgaaccggcccgaacgccgtacgtcggttacggttcgttttagacgttcggttaccgtttagtacgttacggtcgggtacgggtaccggtaacgggtaaccgttacggtacggttacctaccggtttacccg

SEQ ID NO: 127207 - DNA, 669 bp, Homo sapiens
  misc_feature: GYAE6OF02I6CU7.48.59.F04.1.454.CMB.1.raw
  modified_base (366)..(366): a, c, t, g, unknown or other
  misc_feature (366)..(366): n is a, c, g, or t
  modified_base (531)..(531): a, c, t, g, unknown or other
  misc_feature (531)..(531): n is a, c, g, or t
  modified_base (642)..(642): a, c, t, g, unknown or other
  misc_feature (642)..(642): n is a, c, g, or t
tcagagtatacatacacgaccggtgctcgatttagtacacacacttagggattgggggctttctgagagtcatggatctcatgtgcaagaaaatgaagcacctgtaggttcttcctcctgctggtggcggctcccagatgggtcctgtcccagctgcagctgcaggagtccgggtccaggactggtgaacgccgttcggacgaccccgttcgtcccctacacccgttgaccgtacttgttcctcgttaggggtcggccttccatccgacgcagctagtacttacgtcgtgggctggatcccgcacgccccgagggaacgggctggacgtggagttgggacgttacgttaccgagtaggtacggganaccgtaccgttaacgtacctaaccccgttccctaacgtaaaacggtccgaacgccgaaccctagttacctaccggtaacgaccgtaaccgtaccgaaacgaaaccctaacgtttcccgtacccgtaagaacgtaccgtagacgtcgttcgtcggtaccggacccnccggtacaacggtaccgaccgggtctcgtaccttaagttaccgtggttccgacgtccggaccccaggtccgacgttagtcgtttactttcgatcggttcgttagattcggnggtcggacgaggtactagcgtcacgtc

SEQ ID NO: 127208 - DNA, 670 bp, Homo sapiens
  misc_feature: GYAE6OF02FYSM0.48.59.F04.1.454.CMB.1.raw
  modified_base (253)..(253): a, c, t, g, unknown or other
  misc_feature (253)..(253): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccagggaaagagccaccttctcctgcaggtccagtccagagtcttaaccaacgactacttagcctggtaccatcagaaaccnggaccaggcctccaggctcctcatctacggtgacatccagcgagggaccactcggacactccagacagtcagtggcagtcggtcgtgggacagacttcaactctacaccgtcgacgcgagacgtcggaccctacgtaagtattttagactagttagttaagttacctagtacgacgactacgttaagtagggtacgtcctaccgtaaccgtactaccgtaaccgttaccgggtaaccgaacggggtaacctaccggtaacgttacggtaacgtaaccgttaaaccgtaacgttacggttacggacttacgggacctaccgtaccgttacgttaccggttaccctttaccgtacccgtttacccgttaccccgtaccgtaccgttaccgttacggttaacttacgttaggttaaaccc

SEQ ID NO: 127209 - DNA, 866 bp, Homo sapiens
  misc_feature: GYAE6OF02FWUA8.48.59.F04.1.454.CMB.1.raw
tcagagtatacatacacgaccggtgctcgatttagtacacacacttagggattgggggaagacaatgggtttgattcagattacatgggtgacttttctgttgtatttccaatctcagatcgccccggagaaattgtgttgacgcagtctccagacaccctgtctttgtctccgaggggaaagagccaccttctcctgcaggtccacgtcaggagtccttaaccgaacgtacttaaccttacgtccttcgggtaacctactaccgaaacgtaaacccgtcgggacccgtaacgggccctaccccgacgggtccttcccgtactaactttaccggttaacgggttcaacctactaccccggtaaggacccggtaacgggggcccctaaccggttcgggacctaacccgttccccggaaacggtaacccgttaacggggtttccgtaaacgggttcggggtaccgtacggggttgggggttaccggttaggggaaccgttaacggtaccttacctaaccgttccgtaaccgtacccgtcgacgtaccgaacggtaccgtaccgggtacctaaagggttaacgtttacgttttcggacgttacggtttacgttacgttacgtcggtactacggtacttaacggtacgttggtaacgtccgtacgtaaaccgtaccgttaccgtaccgttaccggaaccggtaacgggtaccgtaaaccgggagtaacgggtaaacttaacggtaacccgttacggtacggtaccggtactaccgggtacctacgttaccgtagttcccgttaccgttactaacccgtttccccgtacccgttaccgtaccgttacgtagtacttaccgttagttaaccg

SEQ ID NO: 127210 - DNA, 772 bp, Homo sapiens
  misc_feature: GYAE6OF02FPPSR.48.59.F04.1.454.CMB.1.raw
  modified_base (166)..(166): a, c, t, g, unknown or other
  misc_feature (166)..(166): n is a, c, g, or t
tcagagtatacatacacgaccggtgctcgatttagtacacacacttagggattgggggctttctgagagtcatggatctcatgtgcaagaaatgaagcacctgtggttcttcctcctgctggtggcggctcccagatcgggtcctgtcccagctgcagctgcaggngtccggcccaggactggtgaacgcccttacggagaccctgtccctcaccgtgctactcgtactcgtggtcgcctaccatccgagcagacgtacgtactttacttcgtagggtctggtacgtccgacccacggaccccccggaggggacggggtcgtagggtagttgggtacggttggggaacgtttaacttttaccgaacggtacgggtaggggtaacgtacccgtaacccgttaaccgttaacccgtaaacccccggttacccgttaacgtaaaaaccggtccggtaacggtaccaaccgtaacttacgtacccggttaaacgacccgtaccgtaaacccgaaaccgtaaacccttaacgttcccgtacctacggaaacgtcgtaggtacgtccttcgtaccggtaccgacccgtacgaccgacgtaccgaccgtccgtacgttaccttacgttacggtgtaccgggcggacccgtacccggacgtaccgtacgttaagggttcgtttcgttttacgacggtttccgtccgttttaggtacgttcggtagggttcgggtaaccggacgggtacccttaaggttccggttaccgtacccgtttccg

SEQ ID NO: 127211 - DNA, 934 bp, Homo sapiens
  misc_feature: GYAE6OF02GPW6A.48.59.F04.1.454.CMB.1.raw
tcagagtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtccgggcccaggactggtagaacgtcccttacgggacgtaccccttggtccccctcaccgtggacctaccgtgtaccttcggtgggtcgtccttccgatccgaggtaccagcctagttacctttacgttcggtacggggccttaggactcccggtaccgaccggacccccggtaaggggtaacggggcgtaggggacggtagggtaggttagggtaacgtttactttaaccgacggtagggtacgggacgtacctaacccgtaaccgtaacccgtaaccccgtacccgtaagtaaaaccggtcggtaaccgacctaacccgtaacgttacgtaaccggttaacgaaccgtaaccgtaaacccgaaaaccgtaaacccttacgtttaccccgtaacccggtaaggtaaaccgtaccggttacggtaaccgtaccgtttaccggttaccggtaaccccggtaaccccgggtaccgtaaccgtaaaccgggtacccgtaccgggttacccgttaaccgtttaaccggtttaaccgtttaaccggttcgggttaccgggtaaccccgggtaaccggtacccccgggtaagtacccggtaaccggttaacgggtttaccgggtttaccgtttttacggggacttttacccggggttttacttttaaccgggttaacgtttcggggtttaccgggtaacggggttaacccggtaacggggttaaaccgttaccgggttttaccgggttacccccgttaacccggttttaccgg

SEQ ID NO: 127212 - DNA, 647 bp, Homo sapiens
  misc_feature: GYAE6OF02I0FF1.48.59.F04.1.454.CMB.1.raw
  modified_base (276)..(276): a, c, t, g, unknown or other
  misc_feature (276)..(276): n is a, c, g, or t
  modified_base (490)..(490): a, c, t, g, unknown or other
  misc_feature (490)..(490): n is a, c, g, or t
tcagagtatacatacacgaccggtgctcgatttagtacacacacttagggattgggggctttctgagagtcatggatctcatgtgcaagaaaatgaagcacctgtggttcttcctcctgctggtggcggctcccagagtgggtcctgtcccagctgcagctgcaggagtccgggcccaggactggtgaacgcccgttacggacgacccttcgtcccctcaccgtgccacttgtctcgtggtcgcctaccatcacgcagctagttacttacgttcgngggctggactcccgccgaccggacccccggaaggggtaacggggcgtagggtaggtgggtacggtttaggggtaacgtttaacgtttacccgaacggtagggtcggggactaccgtaaccgttaaccaacccgtaaccccgtacctaacgaaacgtcgacgacactagtactacgagactacgacaacgaacctacgttcctaccgagtaacgntacgcgtctcgtcgaccgaccgcacgtacgaccgcgtacttgtaccttcgtacgtggaccgccggccgacgcgtcgcgagtttcgtttgttagtcttcgtacgtttgacgttcgggtggaccggacgtaacggacgtaggtccgtaccgttccgtcg

SEQ ID NO: 127213 - DNA, 746 bp, Homo sapiens
  misc_feature: GYAE6OF02G60MK.48.59.F04.1.454.CMB.1.raw
tcagagtatacatacacgaccggtgctcgatttagtacacacacttagggagttgggggaagacaatgggtttgattcagattacatgggtgacttttctgttgtatttccaatctcagatcgcccccggagaaattgtgttgacgcgagtctccagacaccctgtctttgtctcgaggggaagacgccaccttctcctgcaggtccagtcagacgtactaccaacgacttactacgtccgtcggtaccatcaacgaacctcggaccacggcctccgagcctcctctacgtcgtacggtgacacgtccgagaccgtacggaccctacgtggcctacgtaccccaggaccgtacggttacaggtcggaacgtgggtcgggttacggtagggaacgtacggtcctactaccgtcctaccgtaaccgccgtaagaccgaacgtacgtaccgggtaacctaggtaacgttacggttcgaacgttgtacgttacgttacgtagtacgtacggtacgttaagtcgttaggtaaccgtccgtaccgtaaccgtacctaccgttaccggtaaccggaccgggacggtaaaccgacgttaaccgggtaagtaaaccgtaaccgggttaaaccacggttcggtaccggtaccgtaccgaccgtaaccgttcgttaccgttaccgttcctaaccggttccttaccccgttacccgtcgttacccgttccggtaacttaacgttccgtaagttacccg

SEQ ID NO: 127214 - DNA, 798 bp, Homo sapiens
  misc_feature: GYAE6OF02F4DI8.48.59.F04.1.454.CMB.1.raw
  modified_base (278)..(278): a, c, t, g, unknown or other
  misc_feature (278)..(278): n is a, c, g, or t
tcagagtatacatacacgaccggtgctcgatttagtacacacacttagggattgggggctttctgagagtcatggatctcatgtgcaagaaaatgaagcacctgtggttcttcctctgctggtggcggctcccagagtgggtcctgtcccagctgaccagctgcaggagtccggggacccaggtacgtgggtagaacggtccttcggacgtacccttcggtccccttacacccgtcgcctacttggtccttcgtgggtacgtcctaccatccgaagtnacggtactagttaccgtttacttcggtacggggtcgtacgggtaccgttaccccggcccgaacccgggaccccccggagggggggtaaccggggtccggagggtacgggtcggtaaggttcgggtaacgttacgttttaccgaacgagggttacggggacgtccgtaacccgttacgtaaaccccgtaccccgtacccgtaaacggtaaacgtccggaggacccgtaactaccgtacgtaccgtaacgacgaacctaccgaacgtaaccctattaccgtacccgtagaccgcggtactacgtaccgtacgtcgtaaccggacccggtaccgccgaacgacggtacccgtgttaccgtaccgttacgtttacgacggttcgggaaccgtaccggcccgtacgggtccgacccggttagtcggtttacgttttgtacggttccgttcccgtttagtcgttaacggttcgggtaccgggaaccgggaccggtttaacgtacgtccgggtacctaccgttcccg

SEQ ID NO: 127215 - DNA, 743 bp, Homo sapiens
  misc_feature: GYAE6OF02JXCBG.48.59.F04.1.454.CMB.1.raw
  modified_base (344)..(344): a, c, t, g, unknown or other
  misc_feature (344)..(344): n is a, c, g, or t
  modified_base (421)..(421): a, c, t, g, unknown or other
  misc_feature (421)..(421): n is a, c, g, or t
tcagagtatacatacacgaccggtgctcgatttagtacacacacttagggattgggggaagacaatgggtttgattcagattacatgggtgacttttctgttgtatttccaatctcagatgcccccggagaaattgtgttgacgcagtctccagacaccctgtctttgtctccgagggaaagagcctaccttctccctgccgaggtccaggtcgagtacgttcttacccaacggtaccttaacttacggccttacgggtaacccatccgaacgaaaacccgttcggacccaacgggcccttacccccgacgggtcccttccttaccgactccggttaacgggtnacctactccgaaggccgtaacgggcccaaccgttggaccctactccccaaggtaccaaggtttccgaggtcgggacngggttcgggtccgttaggggactagcccgttacgacctccttacgaccgtgaacgtcgagtacctcgggaccttagggaatacgtttcgacgttagtagtttattacccgtgtagtacgacgtaagttaggtacgttacgacgtccgaacggtacttaccgaaccccgttacgggaccctaacgggtaccgaacggtaccgtagggtaaccgtaaaccgttaccggaacgttcgtacgacgttacgccgtaccgtcgttcgcgtttaccctacgtaccttcccgtccgttaccgtacttcgtagtacgttattacgttaacg

SEQ ID NO: 127216 - DNA, 803 bp, Homo sapiens
  misc_feature: GYAE6OF02GWR0Y.48.59.F04.1.454.CMB.1.raw
  modified_base (177)..(177): a, c, t, g, unknown or other
  misc_feature (177)..(177): n is a, c, g, or t
  modified_base (744)..(744): a, c, t, g, unknown or other
  misc_feature (744)..(744): n is a, c, g, or t
tcagagtatacatacacgaccggtgctcgatttagtacacacacttagggattgggggaagacaatgggtttgattcagattacatgggtgactttctgttgtatttccaatctcagatgccccggagaaattgtgttgacgcagtctccagacacctgtctttgctccgagggaangcctaccttctcctgactaggtccaggtcagtaggttccttaaccgaacgtactacttacgccttaggtaccagtcaacggtaacctggaccgtaacggcctacccgaggtccttacccgtacgacttccgtaccgggtgtactacgttaccgagtacgaacgggcctaacggtggacccaacctaccccgtaaggtaaccgtaggtttcgaacggttacgggtaccgtaaggggttcgggtccgttaaggggtaacctaacggttacccttacggaccctttccggaaccgtacgtccggaagtaccgacggtacggtaccgtaaccgtaggtaacgtttcgttcgacgttaggtttacgtaacttacgtggtaactcggtacctaaggttcgggtttaacggacgtacccgtaacggaccgtttaccgtcccgttaaacgggtcccgaaacggttaacggggccctaaacgggtacgttacggggtaaacctaacggtttaaccggacgttcggggttaccacggttacgaccctacttacggtactttacctaccgtttacccncgtttaacccgtcctacccggttatacccgggttaagttaccttacggtccttaaccgg

SEQ ID NO: 127217 - DNA, 873 bp, Homo sapiens
  misc_feature: GYAE6OF02IDBQ8.48.59.F04.1.454.CMB.1.raw
  modified_base (270)..(270): a, c, t, g, unknown or other
  misc_feature (270)..(270): n is a, c, g, or t
  modified_base (360)..(360): a, c, t, g, unknown or other
  misc_feature (360)..(360): n is a, c, g, or t
tcagagtatacatacacgaccggtgctcgatttagtacacacacttagggattgggggaagacaatgggtttgattcagattacatgggtgacttttctgttgtatttccaatctcagatgccccggagaattgtgttgacgcagtctccagacaccctgtctttgtctccgaggggaagacgcctaccttctcctgcaggtccagtcagagtacttaccgaagtactacttacgcctggtacccagtcaaggaaacctggccgacgccnccaggcctccgtcatcgtacggtgaccactaccgagcgacgggacctacgtcggacctacctacccgaacggtaccgtacgggtttaccncggggtacggtacggtaacggggttcgggggttaccggtagggggtaacctaacgggttaacctttaccgtaacccggtttccccttacccggtaacccgttcggaacggtaacccgtaaacggggtacccggttaccggggttaaccccggttaaacggttaaacccgggttttatttttaccggggaactttaacggggtttacggttttaaccgtttaccggtttaaccgggttacctagggtaccgttaacgggtttaaacggttacgggttaaccggttaccctaacccggttaaaccgttaacccttcccgggttaacccgttacccgggtaaacccgggaaacgggtacccgttaaacccggtacggtaacggtaaacccgttaaacgtttaacccgtaaacgttcggggtacgaccgttacggaccacccgttaacgttcgtacgttaccgttccgtaccttacccgttcccaccgttacttcgtacgtactacgttagttaccg

SEQ ID NO: 127218 - DNA, 692 bp, Homo sapiens
  misc_feature: GYAE6OF02FJHVH.48.59.F04.1.454.CMB.1.raw
  modified_base (182)..(182): a, c, t, g, unknown or other
  misc_feature (182)..(182): n is a, c, g, or t
tcagagtatacatacacgaccggtgctcgatttagtacacacacttagggagttgggggaagacaatgggtttgattcagattacatgggtgacttttctgttgtatttccaatctcagatgcccccggagaaattgtgttgacgcagtctccagacaccctgtctttgtctccaggggaanagccaccttctcctgcaggtccagtcagagtcttaccaacgactacttagcctggtaccatcagaaacctggccaggctcccaggctccgtcatctacggtgcataccagcaggccacgtcggcagtcccagacacggttcagtgcgagtgggtctgggacagacgttcacgtctacacgtcgacgcagactggacccgtgaacgtatttgactacgttagtacgttactcgtacgtagataaccccccgtagttacggtacgtaccgttactaacccgtactaccgtacccgtttccggtaccgtaaacggggtaaccgtaaccggtaacgtacgggtacgttaaacgttaaacccgttaaaccggttaacggttacggttaccgtacgtaccgtaacccgtaacggttaccgttaacggttaccgtttacccttaaccggttaccccgtttaccccggtacccgtaccgttaaccgttaccgtaacgttacgttaggttttaaacccg

SEQ ID NO: 127219 - DNA, 768 bp, Homo sapiens
  misc_feature: GYAE6OF02GJ8ZC.48.59.F04.1.454.CMB.1.raw
  modified_base (178)..(178): a, c, t, g, unknown or other
  misc_feature (178)..(178): n is a, c, g, or t
  modified_base (301)..(301): a, c, t, g, unknown or other
  misc_feature (301)..(301): n is a, c, g, or t
tcagagtatacatacacgaccggtgctcgatttagtacacacacttagggagttgggggctttctgagagtcatcggatcgtcactgtgccaaggaaaactgaacgcacctgtggttccttcctcctgtcctggtgacggctccagatgggtcctagtcccagctgccagctgcaggngtcgggcccaggacctggtagaacgccttcggagtacctgtaccctcacccttggcctaactgtccttcaggttcggactacctagtcaggtactagcagtacttacttgtgggactggtacnccgctaccggccccgtaggaaaccgggcgtaggtacggtacgacgttacggggagttaacgttttaccgacgtaacggtacggaggtaccgtaacccgttaccgtaccgtaaccccgttccccgtaaccgtaaacggtccgaagggtaccctaacgaacgtttacgtaccgttacgaacgtaccgttaccgaacggtaaaccttaacgtacgtacccgtagtaacgaccgtacgtaacgtcgtaccgacggttaccgtaacccggacccggtttaccaaacgaaccgtccggtaacgttccgttaaccgttacgtttaaaccgtcgtaccggtcccggtaagggtaccccggaagggtcccgacgttaacggtccgttacgtttaccgagttcccgtcggttagtaccgttaagttcggtaccgggaccggacggttaccgaacgtttacggcctacccgttaccgg

SEQ ID NO: 127220 - DNA, 221 bp, Homo sapiens
  misc_feature: GYAE6OF01DP7FX.44.7.A07.1.454.CMB.1.raw
  modified_base (219)..(221): a, c, t, g, unknown or other
  misc_feature (219)..(221): n is a, c, g, or t
tcagacagtatatacacgaccggtgctcgatttagcacgtgtcgcagggtgctgctgaggctgcggatgctggtgtttattactgcttgcaagctttagaccggtacacttttggccagggacccggctggaggtcaatcgaactgtggctgcaccatctgtcttcatcttcccgccatctgatatatactgtctgagcgggctggcaaggcgcatagnnn

SEQ ID NO: 127221 - DNA, 221 bp, Homo sapiens
  misc_feature: GYAE6OF01B01LU.44.7.A07.1.454.CMB.1.raw
  modified_base (220)..(221): a, c, t, g, unknown or other
  misc_feature (220)..(221): n is a, c, g, or t
tcagacagtatatacacgaccggtgctcgatttagcacgtgtcgcagggtgctgctgaggctgcggatgctggtgtttattactgcttgcaagctttagaccggtacacttttggccaggggacccggctggaggtcaatcgaactgtggctgcaccatctgtcttcatcttcccgccatctgatatatactgtctgagcgggctggcaaggcgcatagnn

SEQ ID NO: 127222 - DNA, 221 bp, Homo sapiens; identical to SEQ ID NO: 127220
  misc_feature: GYAE6OF01BVNWW.44.7.A07.1.454.CMB.1.raw
  modified_base (219)..(221): a, c, t, g, unknown or other
  misc_feature (219)..(221): n is a, c, g, or t

SEQ ID NO: 127223 - DNA, 239 bp, Homo sapiens
  misc_feature: GYAE6OF01A0AUY.44.7.A07.1.454.CMB.1.raw
  modified_base (215)..(215): a, c, t, g, unknown or other
  misc_feature (215)..(215): n is a, c, g, or t
  modified_base (221)..(239): a, c, t, g, unknown or other
  misc_feature (221)..(239): n is a, c, g, or t
tcagacagtatatacacgaccggtgctcgatttagcacgtgtcgcgagggtggctgctgaggctgcggatgctggtgttatactgcttgcaagctttagaccggtacacttttggccaggggacccggctggaggtcaatcgaactgtggctgcaccatctgtcttcatcttcccgccatcgtgatatatactgtctgagcgggctggcaaggcncatagnnnnnnnnnnnnnnnnnnn

SEQ ID NO: 127224 - DNA, 220 bp, Homo sapiens
  misc_feature: GYAE6OF01D33ER.44.7.A07.1.454.CMB.1.raw
  modified_base (219)..(220): a, c, t, g, unknown or other
  misc_feature (219)..(220): n is a, c, g, or t
tcagacagtatatacacgaccggtgctcgatttagcacgtgtcgcagggtgctgctgaggctgcggatgctggtgtttattactgcttgcaagctttagaccggtacacttttggccagggacccggctggaggtcaatcgaactgtggctgcaccatctgtcttcatcttcccgccatctgatatatactgtctgagcgggctggcaaggcgcatagnn

SEQ ID NO: 127225 - DNA, 223 bp, Homo sapiens
  misc_feature: GYAE6OF01BY4D2.44.7.A07.1.454.CMB.1.raw
  modified_base (220)..(223): a, c, t, g, unknown or other
  misc_feature (220)..(223): n is a, c, g, or t
tcagacagtatatacacgaccggtgctcgatttagcacgtgtcgcagggtgctgctgaggctgcggatgctggtgtttattactgcttgcaagctttagaccggtacacttttggccaggggacccggctggaggtcaatcgaactgtggctgcaccatctgtcttcatcttcccgccatctgatatatactgtctgagcgggctggcaaggcgcatagnnnn

SEQ ID NO: 127226 - DNA, 222 bp, Homo sapiens
  misc_feature: GYAE6OF01ERRGK.44.7.A07.1.454.CMB.1.raw
  modified_base (220)..(222): a, c, t, g, unknown or other
  misc_feature (220)..(222): n is a, c, g, or t
tcagacagtatatacacgaccggtgctcgatttagcacgtgtcgcagggtgctgctgaggctgcggatgctggtgtttattactgcttgcaagctttagaccggtacacttttggccaggggacccggctggaggtcaatcgaactgtggctgcaccatctgtcttcatcttcccgccatctgatatatactgtctgagcgggctggcaaggcgcatagnnn

SEQ ID NO: 127227 - DNA, 223 bp, Homo sapiens; identical to SEQ ID NO: 127225
  misc_feature: GYAE6OF01BESQ2.44.7.A07.1.454.CMB.1.raw
  modified_base (220)..(223): a, c, t, g, unknown or other
  misc_feature (220)..(223): n is a, c, g, or t

SEQ ID NO: 127228 - DNA, 222 bp, Homo sapiens; identical to SEQ ID NO: 127226
  misc_feature: GYAE6OF01DHLQV.44.7.A07.1.454.CMB.1.raw
  modified_base (220)..(222): a, c, t, g, unknown or other
  misc_feature (220)..(222): n is a, c, g, or t

SEQ ID NO: 127229 - DNA, 221 bp, Homo sapiens; identical to SEQ ID NO: 127221
  misc_feature: GYAE6OF01AUH1E.44.7.A07.1.454.CMB.1.raw
  modified_base (220)..(221): a, c, t, g, unknown or other
  misc_feature (220)..(221): n is a, c, g, or t

SEQ ID NO: 127230 - DNA, 224 bp, Homo sapiens
  misc_feature: GYAE6OF01CWEP2.44.7.A07.1.454.CMB.1.raw
  modified_base (220)..(224): a, c, t, g, unknown or other
  misc_feature (220)..(224): n is a, c, g, or t
tcagacagtatatacacgaccggtgctcgatttagcacgtgtcgcagggtgctgctgaggctgcggatgctggtgtttattactgcttgcaagctttagaccggtacacttttggccaggggacccggctggaggtcaatcgaactgtggctgcaccatctgtcttcatcttcccgccatctgatatatactgtctgagcgggctggcaaggcgcatagnnnnn

SEQ ID NO: 127231 - DNA, 224 bp, Homo sapiens; identical to SEQ ID NO: 127230
  misc_feature: GYAE6OF01BFTN9.44.7.A07.1.454.CMB.1.raw
  modified_base (220)..(224): a, c, t, g, unknown or other
  misc_feature (220)..(224): n is a, c, g, or t

SEQ ID NO: 127232 - DNA, 221 bp, Homo sapiens; identical to SEQ ID NO: 127221
  misc_feature: GYAE6OF01AO9U3.44.7.A07.1.454.CMB.1.raw
  modified_base (220)..(221): a, c, t, g, unknown or other
  misc_feature (220)..(221): n is a, c, g, or t

SEQ ID NO: 127233 - DNA, 223 bp, Homo sapiens; identical to SEQ ID NO: 127225
  misc_feature: GYAE6OF01D3GJF.44.7.A07.1.454.CMB.1.raw
  modified_base (220)..(223): a, c, t, g, unknown or other
  misc_feature (220)..(223): n is a, c, g, or t

SEQ ID NO: 127234 - DNA, 235 bp, Homo sapiens
  misc_feature: GYAE6OF01AXC8N.44.7.A07.1.454.CMB.1.raw
  modified_base (220)..(235): a, c, t, g, unknown or other
  misc_feature (220)..(235): n is a, c, g, or t
tcagacagtatatacacgaccggtgctcgatttagcacgtgtcgcagggtgctgctgaggctgcggatgctggtgtttattactgcttgcaagtctttagaccggtacacttttggccaggggacccggctggaggtcaatcgaactgtggctgcaccatctgtcttcatcttcccgccatctgtatatactgtctgagcgggctggcaaggcgcatagnnnnnnnnnnnnnnnn

SEQ ID NO: 127235 - DNA, 221 bp, Homo sapiens; identical to SEQ ID NO: 127221
  misc_feature: GYAE6OF01BXX61.44.7.A07.1.454.CMB.1.raw
  modified_base (220)..(221): a, c, t, g, unknown or other
  misc_feature (220)..(221): n is a, c, g, or t

SEQ ID NO: 127236 - DNA, 224 bp, Homo sapiens; identical to SEQ ID NO: 127230
  misc_feature: GYAE6OF01BS3OH.44.7.A07.1.454.CMB.1.raw
  modified_base (220)..(224): a, c, t, g, unknown or other
  misc_feature (220)..(224): n is a, c, g, or t

SEQ ID NO: 127237 - DNA, 225 bp, Homo sapiens
  misc_feature: GYAE6OF01B3MU3.44.7.A07.1.454.CMB.1.raw
  modified_base (220)..(225): a, c, t, g, unknown or other
  misc_feature (220)..(225): n is a, c, g, or t
tcagacagtatatacacgaccggtgctcgatttagcacgtgtcgcagggtgctgctgaggctgcggatgctggtgtttattactgcttgcaagctttagaccggtacacttttggccaggggacccggctggaggtcaatcgaactgtggctgcaccatctgtcttcatcttcccgccatctgatatatactgtctgagcgggctggcaaggcgcatagnnnnnn

SEQ ID NO: 127238 - DNA, 251 bp, Homo sapiens
  misc_feature: GYAE6OF01CQ6VE.44.7.A07.1.454.CMB.1.raw
  modified_base (230)..(251): a, c, t, g, unknown or other
  misc_feature (230)..(251): n is a, c, g, or t
tcagacagtatatacacgaccggtgctcgatttagcacgtgtcgcagggtgctgctgaggctgcggatgctggtgtttattactgcttgcaagtctttagaccggtactacttttggccgaggggaccaagctaggaaatcaaacgaactgtggctgcaccatctgtcttcatccttccgcatctgatatatactgtctggacggcgggctggacgaagggcacagtagnnnnnnnnnnnnnnnnnnnnnn

SEQ ID NO: 127239 - DNA, 222 bp, Homo sapiens; identical to SEQ ID NO: 127226
  misc_feature: GYAE6OF02FPCHX.44.7.A07.1.454.CMB.1.raw
  modified_base (220)..(222): a, c, t, g, unknown or other
  misc_feature (220)..(222): n is a, c, g, or t

SEQ ID NO: 127240 - DNA, 223 bp, Homo sapiens
  misc_feature: GYAE6OF02GSFSY.44.7.A07.1.454.CMB.1.raw
  modified_base (220)..(223): a, c, t, g, unknown or other
  misc_feature (220)..(223): n is a, c, g, or t
tcagacagtatatacacgaccggtgctcgatttagcacgtgtcgcagggtgctgctgaggctgcggatgctggtgtttattactgcttgcaagctttagaccggtacacttttggccaggggacccggctggatgtcaatcgaactgtggctgcaccatctgtcttcatcttcccgccatctgatatatactgtctgagcgggctggcaaggcgcatagnnnn

SEQ ID NO: 127241 - DNA, 248 bp, Homo sapiens
  misc_feature: GYAE6OF02FRK5S.44.7.A07.1.454.CMB.1.raw
  modified_base (220)..(248): a, c, t, g, unknown or other
  misc_feature (220)..(248): n is a, c, g, or t
tcagacagtatatacacgaccggtgctcgatttagcacgtgtcgcagggtgctgctgaggctgcggatgctggtgtttattactgcttgcaagctttagaccggtacactttttggccaggggacccggctggaggtcaatcgaactgtggctgcaccatctgtcttcatcttcccgcatctgatatatactgtctgagcgggctggcaaggcgcatagnnnnnnnnnnnnnnnnnnnnnnnnnnnnn

SEQ ID NO: 127242 - DNA, 221 bp, Homo sapiens; identical to SEQ ID NO: 127221
  misc_feature: GYAE6OF02IS5IB.44.7.A07.1.454.CMB.1.raw
  modified_base (220)..(221): a, c, t, g, unknown or other
  misc_feature (220)..(221): n is a, c, g, or t

SEQ ID NO: 127243 - DNA, 222 bp, Homo sapiens; identical to SEQ ID NO: 127226
  misc_feature: GYAE6OF02GWH7G.44.7.A07.1.454.CMB.1.raw
  modified_base (220)..(222): a, c, t, g, unknown or other
  misc_feature (220)..(222): n is a, c, g, or t

SEQ ID NO: 127244 - DNA, 227 bp, Homo sapiens
  misc_feature: GYAE6OF02FY8R2.44.7.A07.1.454.CMB.1.raw
  modified_base (220)..(227): a, c, t, g, unknown or other
  misc_feature (220)..(227): n is a, c, g, or t
tcagacagtatatacacgaccggtgctcgatttagcacgtgtcgcagggtgctgctgaggctgcggatgctggtgtttattactgcttgcaagctttagaccggtacacttttggccaggggacccggctggaggtcaatcgaactgtggctgcaccatctgtcttcatcttcccgccatctgatatatactgtctgagcgggctggcaaggcgcatagnnnnnnnn

SEQ ID NO: 127245 - DNA, 250 bp, Homo sapiens
  misc_feature: GYAE6OF02H04IG.44.7.A07.1.454.CMB.1.raw
  modified_base (212)..(212): a, c, t, g, unknown or other
  misc_feature (212)..(212): n is a, c, g, or t
  modified_base (219)..(250): a, c, t, g, unknown or other
  misc_feature (219)..(250): n is a, c, g, or t
tcagacagtatatacacgaccggtgctcgatttagcacgtgtcgcagggtgctgctgaggctgcggatgctggtgtttattactgcttgcaagctttagaccgtacactttggccagggaccggctggaggtcaatcgaactgtggctgcaccatctgtcttcatcttcccgccatctgatatatactgtctggagcgggctggcaagggcncgatagnnnnnnnnnnnnnnnnnnnnnnnnnnnnnnnn

SEQ ID NO: 127246 - DNA, 242 bp, Homo sapiens
  misc_feature: GYAE6OF02IOIMQ.44.7.A07.1.454.CMB.1.raw
  modified_base (223)..(242): a, c, t, g, unknown or other
  misc_feature (223)..(242): n is a, c, g, or t
tcagacagtatatacacgaccggtgctcgatttagcacgtgtcgcagggtgctgctgaggctgcggatgctggtgtttattactgcttgcaagctttagaccggtacacttttggccaggggacccggctggaggtcaatcgaactgtggctgcaccatctgtcttcatccttcccgaccatctgatatatactgtctgacgcggctggcaaggcgacatagnnnnnnnnnnnnnnnnnnnn

SEQ ID NO: 127247 - DNA, 234 bp, Homo sapiens
  misc_feature: GYAE6OF02F0JNN.44.7.A07.1.454.CMB.1.raw
  modified_base (219)..(234): a, c, t, g, unknown or other
  misc_feature (219)..(234): n is a, c, g, or t
tcagacagtatatacacgaccggtgctcgatttagcacgtgtcgcagggtgctgctgaggctgcggatgctggtgtttattactgcttgcaagctttagacaggtacacttttggccaggggacccgctggaggtcaatcgaactgtggctgcaccatctgtcttcatccttcccgcatctgatatatactgtctgagcgggctggcaaggcgcatagnnnnnnnnnnnnnnnn

SEQ ID NO: 127248 - DNA, 625 bp, Homo sapiens
  misc_feature: GYAE6OF01BV45P.21.35.D02.1.454.CMB.1.raw
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (365)..(365): a, c, t, g, unknown or other
  misc_feature (365)..(365): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactcgtgaaggccatcacatcncaganacaatcaagaacacgctgttcngacaaatgagcagcctagaaagaagaggacacggctagtatataactgtgcgacgaggtacctttatattagtggttacgaaggactagttgaacgtacgnggggacccaagggaacccgtggtaccaccgtctcctcacgccctacccgaaccgaacgggccctacgtccggttacccttccccccgtggtacccgtccccgtcgcccgtaccgacggaccgtacccgacccgttaccgacgaccgaccgaaccgaccggcccggaccccggtcgggtcccgtcggcccggttcgggtaccgtaaaccggtacccttaaccccgtttccccgttaccgttccttcccgttacgtaccggg

SEQ ID NO: 127249 - DNA, 722 bp, Homo sapiens
  misc_feature: GYAE6OF01CMQZX.21.35.D02.1.454.CMB.1.raw
  modified_base (258)..(258): a, c, t, g, unknown or other
  misc_feature (258)..(258): n is a, c, g, or t
  modified_base (344)..(344): a, c, t, g, unknown or other
  misc_feature (344)..(344): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcacgtgggtccgccagactccaggcgaaggggctaggagtggctggcagttatcgcattcgatgggaagcgatatgtactatggcggtactccggtaggaacgggccattcaccatcctacaganactaattaccaaagaacacgtacttcgtttacagacaaaagtgaacgtcacgaccgtaaggaaaagaaggaacggaaccacgggtntagtaatataacgtggtacgcgtaacggagttaactttattaacgttgttacggttacacgggtaactagttacggacgttacggacggggtaccgaacgggtaacccgtggtaccgtaccgttcctaccgtacccgacgtccctaacccgaaccgaaccgggtccctacggttcccggtacccttccccggcggtacccgtccccgtcgtccccgtaccgcggacccgtcccgtacccgtaccggtaacgccgaccgaccgaccgggtcccggtacccggtcgggccgtaccggtaccgttccgggttaacccgaaccggttaacccggttacccgttaccccggaaccgggtacccggtaacggtacggtaccggg

SEQ ID NO: 127250 - DNA, 575 bp, Homo sapiens
  misc_feature: GYAE6OF01A5O1I.21.35.D02.1.454.CMB.1.raw
  modified_base (272)..(272): a, c, t, g, unknown or other
  misc_feature (272)..(272): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccattcaccatctccagagacaattccaagaacacgctgtttcngcaaatgagcagcctagaaagaagaggacacggctgtatataactgtgcgacgagtaccttattattagtggttacgagggtacctagttacgaactacggtcgggggacccaacggggtaaccctgggtacctaccgtctcctcacgccctaccgacccgaacgggcccacgttccggtcccttcccccgtcggcccgtcccgtcgcctaccgaggaccgccaccgtccgagacgccgacgcggccggccgtcggccgtcgccgtcggcaacggtacctaccgtcccgagcgacgcgtacgg

SEQ ID NO: 127251 - DNA, 657 bp, Homo sapiens
  misc_feature: GYAE6OF01BLM35.21.35.D02.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagcacacgatagttgggtttggggggggagaggagcccagcactggaagtcgccggtgtttccattcggtgatcagcactgaacacagaggactcaccatggagtttgggctgaccttgggttttcctcgttgcttcttttaaggaggtgtccactgtcaggtccaccgtggtggaggtcgggggagcgtgttccagccgtggactcctgagagtctcctgtgcagcctcgtggattcagtcttcgagtgtactttcgcctatcgccacgtcgggtcccgcctagaccgtccgagggtaccgaaagggggtctaaggtaggtcggcgtgggactaggttacncgctacgttcgagtagggaacgcgtatagtacgtactagtcggccggtaacgtccggtaggaacgggtcccgtaattccgaacctactccgtaccagaacgtaacctaacttacccgaaagaaccgtacgtctttagttacgtagtactaaagtgagtacacgtaccgtaagaaacggaagacggtaacgacggtactacgtataacgtagtcggtaggacggtacggtaacggttaacctttagttacgtttacggtacggttacgacggtacgttaacgg

SEQ ID NO: 127252 - DNA, 792 bp, Homo sapiens
  misc_feature: GYAE6OF01DWLY6.21.35.D02.1.454.CMB.1.raw
  modified_base (326)..(326): a, c, t, g, unknown or other
  misc_feature (326)..(326): n is a, c, g, or t
tcagtcgtcgctcgcacgaccggtgctcgatttagcacacgatagttggggtttggggggggagaggagcccagcactggaagtcgccggtgtttccattcggtgatcagcactgaacacagaggactcaccatggagtttgggctgacctgggttttcctcgttgcttcttttaagaggtgtccactgtcaggtccactggtggaggtcgggggagtcgtgttccaggccgtgggacctcccgtgagcgtctcctgtgcagtcctcgtggacttcagtcttacgagttcgtactttggccagttcggcctacgtcggggtccccnccgaaggtaccctccggagggaccgtaaagggggcctaaggaggtcggctagggctaagttacgccgagtagttcggaagtagggaaacgtcgtaagttagtcgttaaccgtaggtccgggaccgggtaaccttccggtagggaaacgggtccgtacttacccgaactaccgtacctacccgaaagtaacgtaacctaaaccgttaccgaaacgtaaacccgtaccgttccgtttacggtttacccgtacggtaacctaaagtcgggaaccggtaacctaccggtaacccggtaaggaaaaaggtaacggaaccggggtaccgtaaccgggtacttaacggttaaacgtaaccggtttaaacgtgggttaacccggtagggtaacccggttaaacgggttaaccgttttaaagtttacggtttaacggttacgggtttaaccggtaagggtaacccgtttaaaggg

SEQ ID NO: 127253 - DNA, 540 bp, Homo sapiens
  misc_feature: GYAE6OF01ERJA6.21.35.D02.1.454.CMB.1.raw
  modified_base (341)..(341): a, c, t, g, unknown or other
  misc_feature (341)..(341): n is a, c, g, or t
  modified_base (482)..(482): a, c, t, g, unknown or other
  misc_feature (482)..(482): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggaggcgtgttccagcctgggacgtccctgagagtctcctgtgcagcctctggattcagcttcagtgactttgccatgcacgtggtcccgccagacctccgaggcaaggggctagagtggctggcagttancgctattcgatggaagcgatatgtactagtgcgactccggtaggaacgggccgattccacctatcctaccagacgaactaattaccaagaacacgcttgtttcagacaaagtgagcagccgtagaaagagaggacgacggntagtaatagtacgtgtgcgacggagtaccttagttattagtaggttacgaggcctaag

SEQ ID NO: 127254 - DNA, 663 bp, Homo sapiens
  misc_feature: GYAE6OF01BFDJO.21.35.D02.1.454.CMB.1.raw
  modified_base (274)..(274): a, c, t, g, unknown or other
  misc_feature (274)..(274): n is a, c, g, or t
  modified_base (370)..(370): a, c, t, g, unknown or other
  misc_feature (370)..(370): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccggtgaagggccattcaccatctccagagacaattccaagaacacgacttgttcngacaaatgagcagcctagaaagagaggacacggctgtatataactgtgcgacgaggtaccttattatagtggttacagggacctagttgactacgngggaccacgggaacctcggtaccaccgtctccgttacgacgtccctaccgtaccgaacgggccctaacgtcccggttcccgtttcccccgtcgggcccgtaccccgttacgcccgtacccgtacggaaccgccctaacccgtcccggtaacggaccgaccgaaccggaccggtacccgggtccccggttacggggccccgttacgggtccccggtacggggtaccccgtaaacgggtaacccttaccccgtttacccccttaccggttccccttaccggtaccgttacccggg

SEQ ID NO: 127255 - DNA, 625 bp, Homo sapiens
  misc_feature: GYAE6OF01AGKD2.21.35.D02.1.454.CMB.1.raw
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttggggggggagaggagcccagcactggaagtcgccggtgtttccattcggtgatcagcactgaacacagaggactcaccatggagtttgggctgacctgggttttcctcgttgctcttttaagaggtgtccactgtcaggtccactggtggagtcgggggagcgtgttccagcctgggacgtcctgagagtctcctgtgcagcctntggattcagtcttcagtgtactttgccatgcacgtcgggtccnccagacctccgaggccgaaggggctaggaggtggctgggctagttacgtcgctacgttcgatgggaagcgatatcgtactagtcgcggtacgtaccggtaggaacgggtccgtacttccacctatcctaccgaagtaacgaacctaaacttaccgaaacgtaaccaccgtctttacggtttacctacgtaacctaaagtcgacgtacgacgtaccgtaaggaaacgaaggtaacggacgtacggtctagtactaagtaacgtggtacgcggcggtaacggttacctttagtttaattagttacgggtacgtagggtaccctagg

SEQ ID NO: 127256 - DNA, 628 bp, Homo sapiens
  misc_feature: GYAE6OF01DHIKG.21.35.D02.1.454.CMB.1.raw
  modified_base (276)..(276): a, c, t, g, unknown or other
  misc_feature (276)..(276): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccattcaccatcctccaagagaacaattccaaagaaccacgctgttcngacaaatgagcagcctagaaagagaggacacggctagtaatataacgtgtagcgacgtagtaacctttattattagtggttacaagggtaccctagttacgacttacggtggggacccacggggtaaccctcggtcctaccgtctaccctcacgccctaccgaccgaacgggccctacgttcccgtccttcccccgtggcccgtccctcgaccctccgacggaccgtccgacccgtaccgacggtacgaccgaaccgacggcccgggtcccgtcggggtcctcggtacccgttcgggaaccgtaaccggtacccttacccgtttcccgtccgttcctcggttcccgtacggg

SEQ ID NO: 127257 - DNA, 610 bp, Homo sapiens
  misc_feature: GYAE6OF01BDOH5.21.35.D02.1.454.CMB.1.raw
  modified_base (277)..(277): a, c, t, g, unknown or other
  misc_feature (277)..(277): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccggtgaacgggcctattccaccatctaccagagacaattccaagaacacgctgtttcngcaaatgagcagcctaggaaagaagacggaacacggctagtaatactaacgtgtacgcgacgtaaggtaacctttaattaattacgtggtttacgaagggtacctagtttcgaacgtacggtcggggaccgaacgggtaacccgtggtaccaccgttctccctcgacgccctaccaaccgacgggtccctacgtccgttccttcccccgtcggtcccgcccgtcgcctaccgacggacgtaccgacccgtacgacgacgcacgacgccggcccgtcggcgtcgccgtcggtacgacggtaccttacctcccgtaccgtcctccgtcgtacggg

SEQ ID NO: 127258 - DNA, 685 bp, Homo sapiens
  misc_feature: GYAE6OF01CT872.21.35.D02.1.454.CMB.1.raw
  modified_base (584)..(584): a, c, t, g, unknown or other
  misc_feature (584)..(584): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtgctggcagtatcgcattcgatggagcgatatgtactatgcgactccgtagaacgggcattccacatccacagacgaactaacttccgaaagaaccacgtcttgtttacgagactaaagtcgacgaccacgtaccgtaggaaaagaacggtaacggacgacggtcttaaggtataagtaacgtgtacgcgacgtaacgttaactttattaacttagtcggttacgaacgggtacctgtttacgaacttaccgggtcggggaaccgacggggttaaaccccgttcggtacctaccccgtttacgtcccttacaaccggtcccctaaccgaacccggtaaccgggccctaaccggttccccggttccccgttccccgtagggcccctaccccgttgcccgtaccgacgggtaccccnccgtaccgcgagaccgaccgacggccggccggtccgtcggcctccgtacggtacgtaccgaaccgttccctacccgttaccgcttacctccgtcggtcggg

SEQ ID NO: 127259 - DNA, 659 bp, Homo sapiens
  misc_feature: GYAE6OF01AI9K4.21.35.D02.1.454.CMB.1.raw
  modified_base (291)..(291): a, c, t, g, unknown or other
  misc_feature (291)..(291): n is a, c, g, or t
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcacgtgggtccgcagacctccagggcaaggggctagaggtggctgggctagttatcgcattcgagtggaagcgatatgtactagtgcggtactccggtaggaacgggcctattcaccatctacagacgactaacttccaagaacacgtcttgtttccngacaaatcgagcagctagaaagagaggacacggntagtatatactgtgcgngtaacgtacttatagtgtgtacgtaggctagtcgtacgtacggcgggtacgacgggtaccgtcggtacctccgtctacctacgacgtccctaaccgaccgacggtccctacggttcccgttcccgttccccggtcggtcccgtcccgtcggtaccgtaccggtacgaccgtacccgtaccgtaccggaccgacgtacccgacggaccggtcccgggtccgggttccgggaccggttccgggcccgggttaacggaccgggtaaccgtttaccgttccccgtttacccgttacgttcccttacggacccggttacggg

SEQ ID NO: 127260 - DNA, 692 bp, Homo sapiens
  misc_feature: GYAE6OF01B2WYR.21.35.D02.1.454.CMB.1.raw
  modified_base (507)..(507): a, c, t, g, unknown or other
  misc_feature (507)..(507): n is a, c, g, or t
  modified_base (636)..(636): a, c, t, g, unknown or other
  misc_feature (636)..(636): n is a, c, g, or t
tcagtcgtcgctcgcacgaccggtgctcgatttagcacacgatagttgggtttgggggggagaggagcccagcactggaagtcgccggtgtttccattcggtgatcagccactgaacacagaggactcaccatggtagtttggctgaccttgggttttcctgttgcttcttttaaggagtgtcctactgtcgacggtcccacgtggtgggaggtcgggggagtcgtgtccgagccgtgggaccgtccgtgagcgtctccgtgtgacagtcctgtggtatcagtcttcgagtcgtacgttcgcctagtcgacgtacggtccggtccgaccgacgtacctaccggaggtaccgaagggtcctaggtaggtcggtacgtaggacgttacgttacgtacggacgttacgtacggtaagtacggtaacgagttaagtacgttacgttacgtaacgtcggtaccggtaccgttacgggaaacggtaccgggaccttacgttaccgaaccgttntacccgtacgtaaagacgtaacctaacgtaacgaacgtaacgtacgtctttacgtcaacgtagagtacgacgaccgtacgtaacgtaaaggaacgtaagtacgacgtacggtactagtactacgtacgnggttacgacgtacgtactttattagttacttaggtacgttacgacgtcgttaacgg

SEQ ID NO: 127261 - DNA, 862 bp, Homo sapiens
  misc_feature: GYAE6OF01DIOKH.21.35.D02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgcttcttttaagaggtgtccactgtcaggtccaccgtgggtggaggtcggggggagcgtgttccagcctgggactcccgtgagngtctccgtgtgcacgtcctcgtggtacttcgagtccttacgaggttcgtacctttcgcctattggacctacgtcgggtccccgcgtacggacctaccggacgggaccgaaagggggtctacgggacggttcgggccgttaggaccgtaggttaaccgtccggtactaacggtttacggaagttacgggaaacgtcgtaaattagttacggttaaccttaaggtccggtacccgggtaccggtttccgggtaacgggaacgggtccccgtaacgtttacccgaacccgttaacgttaccccgtaaccgaaacggtaaccggtaaacttaaaaccgtttacccgaaaacggtaacccgttaacccggtccgttttaggttttaacccgaacggtaaccttaaaggtcggtaaaccggtaccgtaaccgtaccggtaaagggaaaacggtaaggggtaaccggtacccgtacggttaaccgttaaggttaaacgttaaacgttaaccggttcgggtaacggtacccggggttaaacggtaacccggttttaactttttaaaggttttacggttaacggtttaccggggtttaaacgtcccgggtaacgtttaaacggg

SEQ ID NO: 127262 - DNA, 899 bp, Homo sapiens
  misc_feature: GYAE6OF01DJNV4.21.35.D02.1.454.CMB.1.raw
tcagtcgtcgctcgcacgaccggtgctcgatttagcacacgatagttgggtttgggggggagaggagcccagcactggaagtcgccggtgtttccattcggtgatcagcactgaacacagaggactcaccagtggagtttggctgtaccttggttttcctcgttgcttcgtttaagaggtcgtccactgtcacggtccacgtggtggaggtcgggggagtcgtcgttccgaggtccgtcgggtaccgtccgtagaacgtcgttccttccgtggtacgccgacggtcccgtttacggtggtaactttccgacggttcctttaacgtggttacgttacttttcggacccgtaagtccggaccgttaccgggttccggtaccccgacccgtaagacccgttaccggacgggtaccggaaacgggtcgtaaggtaggtcggtacgtacggtacgttaacgtttacgtccgtacgttaagtttacggaaggttacggtaaacgtacgttaaagtttacggttacgttaaccgttagttccgggacccgttacggttaccggttagggaaacccgggttccgtaaccgtttcccgaaacccgtaccgttaacccgtaacgtaaacggtaacgtaaacccgtaagtttaaacccgaaacggtttaaccctaaccgggtttctttacgggttttacctaaacggtaaaccgtaaaggtaccgaacggtacgaaccggtaaccgtaaaacgggaaaacgggtaacgggaaccggaaccggtaaacgggtcgtttaaacggtaaatttaaacgttacggtttcggactacgggtaaccgtaacggttttaaccgtttaagtttaacgtttaacggttacggtttaaacggtaccggtaacgtttaacgg

SEQ ID NO: 127263 - DNA, 541 bp, Homo sapiens
  misc_feature: GYAE6OF01AH2XV.21.35.D02.1.454.CMB.1.raw
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
  modified_base (470)..(470): a, c, t, g, unknown or other
  misc_feature (470)..(470): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcgactccgtgaaggccgattcaccatctccagagacaattccaagaacacgctgtttctgacaaatgagcagcctagaaaagagaggacacggctagtatataactgtgcgcgaggaccttatattatggttcaggaccattgactacgtgggccgagggacctggtcaccggtctcctcacgcctccacgacggccatccgtcttccccgtggccnccctgcctccgacggacnccgtacctccgacgacgcaccgngcccggcccgtcgggcctcgccgtcggtacgaacggtaccttaccgtcccgagtaccggacgccgtacggg

SEQ ID NO: 127264 - DNA, 720 bp, Homo sapiens
  misc_feature: GYAE6OF01BPL1U.21.35.D02.1.454.CMB.1.raw
  modified_base (593)..(593): a, c, t, g, unknown or other
  misc_feature (593)..(593): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggtagtttgggctgaccttgggtttttcctcgttgcttcgttttaagagtgtccactgtcaggtccacgtggtggaggtcgggggagcgttgtccagccgtgggaccgtcctgagagtcctcctgtgcagtcctcgtgtacttcagtcttcgagtcgtactttcgcctagtcgccgtaccggtccgggtccccaccgaacggtacccgtaccggaacgggaccggtaaggggtaccgtaagggcgggtcgggtaccgtacgggtacttaacgggtttacctaccgggtacctaacggtttaccggaaggtacgggaacgtacgtaattagttacgtaacgtacgtcgggtacggtaccgttcgggtaggaccggtacctacgttaccaccttagtcctacgaagtaacactaaacgtaaccaacgtacgtcgttctttacgttacaagtacaagtcgaacncgtaacgtacgaagaaacggagacgacgtacggtataagttactaacgtggtacggtagaccgggtagttaaccgtttaactttagttaagttacggtaacggttacggtaaacggtcttaaacggg

SEQ ID NO: 127265 - DNA, 630 bp, Homo sapiens
  misc_feature: GYAE6OF01CH76R.21.35.D02.1.454.CMB.1.raw
  modified_base (324)..(324): a, c, t, g, unknown or other
  misc_feature (324)..(324): n is a, c, g, or t
  modified_base (396)..(396): a, c, t, g, unknown or other
  misc_feature (396)..(396): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactagtgcggactccgtggaacgggccattcaccatcacagagacaataccaaagaacacgcttgttcagacaaagtgagcacgcctagaaagagaggacaggtctagtatatactgngacgcgagtacttatattagtgtcgaggactagtgactggtcgggaccgacgggacctgtaccgccgtctcncgacgccctaccgaccgacggtccctacgtcccgttcccgtccccgtcggacccgtcccgtcgtacccgtaccgaacgggacctacccgtaacccggtccggaccggacgtacccgaaccggccggtacccccggggtccgttacggggccccttcggcccggtacgggtaaccgtaacccggttcccttaacccgtttccccgacgtttcccgttaccgttacggtaccgggg

SEQ ID NO: 127266 - DNA, 848 bp, Homo sapiens
  misc_feature: GYAE6OF01BMTKW.21.35.D02.1.454.CMB.1.raw
  modified_base (680)..(680): a, c, t, g, unknown or other
  misc_feature (680)..(680): n is a, c, g, or t
  modified_base (754)..(754): a, c, t, g, unknown or other
  misc_feature (754)..(754): n is a, c, g, or t
tcagtcgtcgctcgcacgaccggtgctcgatttagcacacgatagttggggtttgggggggagaggagcccagcactggaagtcgccggtgtttccattcggtgatcagcactgaacacaggaggactcaccatggagtttcgggctgaccttgggttttcctcgttgcttctttaagaggtcgtcactgtcaggtccacgtggtggaggtcgggggagcgtgttccaggcccgtgggacgtcctggacgacgtctccgtgtcgcacggtcctcgtcggtaacttcgaggtcctttacgtaggttacgttaccgttttcggacccgttattccggtacccgtacggtttacccgggggtccccgtacccggaaccggttaacccgtacccccggtaaacggggacccggtaaaacggggggtacccttaacggggtaagggttcgggtaccgtacgggtaccgtaaacggtttcgacccggtacgtacggtttaccggagttacgggaaacgtccgtaagttacgttcggtaacgttacggtcgggtaccggtaacccgtccggtaagggaaccgggtaccctacttacccgaaaccgttcgttcccgtaacgaacggtaacgtaaaccgttaacgttaacccgaacgtaacccgtacgttcgtttacgtttaccgtaanaccgtaaatcggaactacgaaccggttccggaaagaaacggaacggtcggaacgaccggttgtaaccggttaanaccgtttaacggtggttacggacccgtaagggttaccgttaaagttttaccgttaaggttacggttcccgtaaaccgggtacgtaaccttaggg

SEQ ID NO: 127267 - DNA, 614 bp, Homo sapiens
  misc_feature: GYAE6OF01EZE65.21.35.D02.1.454.CMB.1.raw
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (540)..(540): a, c, t, g, unknown or other
  misc_feature (540)..(540): n is a, c, g, or t
tcagtcgtcgctcgcacgaccggtgctcgatttagcacacgatagttgggtttggggggggagaggagcccagcactggaagtcgccggtgtttccattcggtgatcagcactgaacacagaggactcaccatggagtttgggctgacctgggttttcctcgttgctcttttaagaggtgtccactgtcaggtccaccgtggtggaggtcggggggaggcgtgttccagccgtgggacgtccctgagagtctcctgtgcagcctgtggattcgagtcttcagtgactttgccatgcacgtcgggtcccnccgagacctccgaggcgaggggtcaggnggtggctggctagttancgntagttcgagtagggaagcgtatagtgtactagtcggccggtacttccggaggaacgggtccgtacttaccacctactcgtaccgaagacgtaactaacgtaccgaacgtaacgtaccgtcgttacgtttacgtagtaactaagtcgaacgacgacgaccgtaagaaggtaagacgacgtacgntagtactaagttacgtggtacgaccggtcggtaactacgtttattacgttagttggtacgtacggtacttacgg

SEQ ID NO: 127268 - DNA, 886 bp, Homo sapiens
  misc_feature: GYAE6OF01BCFAG.21.35.D02.1.454.CMB.1.raw
  modified_base (150)..(150): a, c, t, g, unknown or other
  misc_feature (150)..(150): n is a, c, g, or t
  modified_base (175)..(175): a, c, t, g, unknown or other
  misc_feature (175)..(175): n is a, c, g, or t
tcagtcgtcgctcgcacgaccggtgctcgatttagcacacgatagttgggtttggggaggcgtgttccagcctgggacgtccctgagagtctcctgtgcagcctctggattcagtcttcagtgtactttgccatgcacgtcggggtcccncagactccgaggcgaaggggctagngtggctggctagttatcgctattcgagtggaagcgtatagtgtactagtggacgtacttcggaggaacggggtcctattccgaactactccgtaccagaacgaactaacttaaccgaagaacctacgtcttagtttctacggataaacgtggaacgccacggtaccgtaaaggaaacggaacggtacggaaccgtaacggtcttaaggtaacttaacgttaacgtcggtacggaccgggtaacggtaacggtttaactttaagtttaagtttacgtcggtttaaccggacggtaacttacgttacgtacgttaaccggggacggtaccgggtaaccgggttacccgtacgggttacccgtacccgttccctccggttaaccctaccggttacccctaaacccggtaacccggacccgggttaacccgttaccggttcccccgggtttaaccccgttccccggtccggggtaccccccgttacccgttaccggtcccggttaacccggaccgggtaccccgtaaccccgttaacccgggtaaccggaaccgggtcccgtaaacccggtacccggtacccgggccccggggttaccggttaccccggggtcttaaccccggggtacccgtttacggggtaaacccgtaccgggtaaccccgtttccgggaacccccgggtaaggaccccgggttaccggcgggtaaccggggg

SEQ ID NO: 127269 - DNA, 760 bp, Homo sapiens
  misc_feature: GYAE6OF01EIBVX.21.35.D02.1.454.CMB.1.raw
tcagtcgtcgctcgcacgaccggtgctcgatttagcacacgatagttgggtttggggaggcgtgttccagcctgggacgtccctgagagtctcctgtgcagcctctggattcagcttcagtcgactttgccatcgcacgtgggtcccgccagacctccgaggcgaaggggctagagtggctggctagttatcgcattcgatggaagcgatagtgtactagtgcggtactcggtgaacgggccgtattcaccgtatcctccgagacgtaactaacttaccaaagtaacctacgtcttcgtttacagactaaaacgtgacgactaccggaccgtaaggaaaaagtaacggaacggtaaccgacggtacgtaggttaactaagttaacgttcggtcggaccggtaacggtaacggttaaccttttaatttacgtttaagtcggtttaacggaacgggttaaccctaagtacgtaacccgttaagggttccggggaacccgaacgggtaacccggttacggtaacccgtacccgttaccgtacccgtacgtaccgacccgtaaccgaaccccggaacgggtaccccgtaaccggttccccggttacccgttcccccggtacggccccgttaccgaccgtcctaccggacggtacgcctacccgtacgagacgtaccgacgccgccggcccgttcgggcctccggtcgtccggtaaccgaacgtacccttaccgttacccgttaccgtccttacggtcgtacggg

SEQ ID NO: 127270 - DNA, 495 bp, Homo sapiens
  misc_feature: GYAE6OF02IOFWC.21.35.D02.1.454.CMB.1.raw
  modified_base (421)..(421): a, c, t, g, unknown or other
  misc_feature (421)..(421): n is a, c, g, or t
tcagtcgtcgctcgcacgaccggtgctcgatttagcacacgatagttgggtttgggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttatattatggttcagggaccattgactactggggccagggaaccctggtcacgtctcctcagcctcaccaaggccatcggtcttccctgcncctgctccaggacgcacctccgagacgcacagcgccctgggctgcctggtcaaggctactccgagcgacgatgg

SEQ ID NO: 127271 - DNA, 537 bp, Homo sapiens
  misc_feature: GYAE6OF02HJFC0.21.35.D02.1.454.CMB.1.raw
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactggggccagggaccctggtcaccgtctcctcagcctccaccaacgggcccatccggtccttcccccgtggccgccctgcctccgacggacgccacctcccgagacgccacacgccggccctcggggctcgcccgtggtccaacggaccttaccgttccctccgtcctcctactcgg

SEQ ID NO: 127272 - DNA, 549 bp, Homo sapiens
  misc_feature: GYAE6OF02GYL7Z.21.35.D02.1.454.CMB.1.raw
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctatagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactggggccagggaaccctggtccaccgtctcctcagcctcacccaagggcccagtccggtccttccccgtggccgccctgccttccgacggacgcctacccgtccgacgacgccacgacgccgggccctggggcctggcccgtgggtaacggccttaccgttcccgtccgttcctccttacgtgtacgg

SEQ ID NO: 127273 - DNA, 528 bp, Homo sapiens
  misc_feature: GYAE6OF02G0CMX.21.35.D02.1.454.CMB.1.raw
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaaggccgattcacatctccagagacaattccaagaacacgctgttctgcaaatgagcagcctagaaagaagaggacacggctgtatataactgtgcgcgaggaccttattattatgttcagggaccattgactacgtgggaccagggaaccctggtcacgtctcctcacgcctccaccaacgggcccagtccggtcctcccctggccnccctcgctccgaggacncgaccctccgagacgcacgacgccggcccgtagggcctggccctggtccaaggaccttacgtcccgagccggacgctcgg

SEQ ID NO: 127274 - DNA, 554 bp, Homo sapiens
  misc_feature: GYAE6OF02GZXHA.21.35.D02.1.454.CMB.1.raw
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctagaaagaagaggacacggctgtatataactgtgcgcgaggacctttattattatggttcagggaccattgactacgtggggccagggaaccctggtcaccgtctcctcagcctccaccacgggcccagtccggtccttccccgtggccgccctcgcctcccgaggacgccaccctccgacgacgccacgacggccggcccgtgggcctcggcccgtggtaccgaacggtaccttaccgttcccggacggaccgaccggactacggg

SEQ ID NO: 127275 - DNA, 544 bp, Homo sapiens
  misc_feature: GYAE6OF02GR6WQ.21.35.D02.1.454.CMB.1.raw
  modified_base (433)..(433): a, c, t, g, unknown or other
  misc_feature (433)..(433): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactacgtggggaccagggaaccctggtcaccgtctcctcagcctccaccaacggcccagtccgtcttcccctggccncccgtgcctccaggacgccacctccgagacgcacagccgacccgtgggcctcggcccgtcggtaccgaaggtaccttaccgttcccgtcggttacccttccgtacgtacgg

SEQ ID NO: 127276 - DNA, 555 bp, Homo sapiens
  misc_feature: GYAE6OF02HBZFK.21.35.D02.1.454.CMB.1.raw
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctagaaagaagaggacacggctgtatataactgtgcgcgaggaccttattattatggttcagggaccattgactacgtggggccagggaacctggtcaccgtctcctcacgcctccaccacggcccagtccggtccttccccgtggccgtccctcgcctccgacggacgccaccgtccgagacgcacgacgccggcccgtcgggctcgccgtcggtaccgaacggtaccttacccgttcccggaacggtccggaaccggtacgtacggg

SEQ ID NO: 127277 - DNA, 548 bp, Homo sapiens
  misc_feature: GYAE6OF02FSWFN.21.35.D02.1.454.CMB.1.raw
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactagtggggccagggaccctggtcaccgtctcctcagcctccaccaacgggcccagtccggtccttcccccgtggccgtcccgtcgcctccgaggacgccaccctccgacgacgccacacgccggcccgtcgggcctcggcccgtggtccaacgggtaccttaccgttccccggaggccgaccgacgtcgg

SEQ ID NO: 127278 - DNA, 567 bp, Homo sapiens
  misc_feature: GYAE6OF02HL327.21.35.D02.1.454.CMB.1.raw
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccagacaaggggctagagtggctggcagttatcgcattcgatggaagcgatatgtactatgcggactccgtgaagggccgattcaccatctccagagacaattccaagaacacgctgtttctgacaaatgagcagcctagaaagagaggacacggctgtatataactgtgcgacgaggtacctttattattagtggttacaagggacctagttcgaactacgtggggccaagggaaccctggtccaccgtctcctcacgcctccaccgacggcccagtccgtccttccccgngccnccctgcctccgaggacgccacctccgacgacgccacgacgccggcccgtcgggcctcggccgttcggtaccgaacggtaccttacccgttccccgtccggttccttaccgtacgtacggg

SEQ ID NO: 127279 - DNA, 557 bp, Homo sapiens
  misc_feature: GYAE6OF02GM9WE.21.35.D02.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (322)..(322): a, c, t, g, unknown or other
  misc_feature (322)..(322): n is a, c, g, or t
  modified_base (463)..(463): a, c, t, g, unknown or other
  misc_feature (463)..(463): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcacgtgggtccgccagactccaggcaagggactagagtggctggcagttatcgctattcgatggaagcgatatgtactatgcggactcgagaagggccattcacatcnccagagacaattcaagaacacgctgttcngacaaatgagcagcctagaaagagaggacacggctagtatataactgtgcgngaggtactttattattagtggttacgaggacctagttagactaggtcgggacacgggtaccctggtccaccgtctccgtcacgtccctaccaccgacggccacgtccgtcctccccgtggcctcccgtgtcctccgaggcncctaccgtcgacgacgcacgacggccgccgtagggcctcggccgtacggtaccgaacggtaccttaccttcccgtcgtccttaccgtcgtacgg

SEQ ID NO: 127280 - DNA, 713 bp, Homo sapiens
  misc_feature: GYAE6OF02I3NLK.21.35.D02.1.454.CMB.1.raw
  modified_base (353)..(353): a, c, t, g, unknown or other
  misc_feature (353)..(353): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctgggtggagtcgggggagcgtgttccagcctgggacgtccctgagagtctcctgtgcagcctctggattcagcttcagtgactttgccatgcacgtgggtccgccagacctccgaggtcgaacggggctaacgaggtggctggactaggttatcgntagttcgagtaggagcgatagtagtactagcgacgtaccgtccggtaggaacgggtccgtaagtttccaaccgtagttacccgtacccgtaaagggtaacgtaaaccgttaaaaccgtttacccgaaaacggtaaaccgaccgttacccgtttaggtttacccgttaacggaacctaaaaggttcggaaccgtaccgaacggtaacccgtaaagggaaaaacgaacgggaacgggtaaaccgaacgggtaccttaaggttaactaaacgtaacgtcggtaggacccgtaacgggtaaccggttaactttaacgtttaacgttacggttacgggttaaccggtaacgggtaaccttaacgg

SEQ ID NO: 127281 - DNA, 556 bp, Homo sapiens
  misc_feature: GYAE6OF02FK1BA.21.35.D02.1.454.CMB.1.raw
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagagaggacacggctgtatataactgtgcgcgaggaccttattattatggttcagggaccattgactacgtggggccagggaaccctgggtccaccgtctcctcacgccctccaccgaacgggcccatccggtccttcccccgtggccgccctgcctccgaggacgccacctccgaagacgccacgacgccggcccgtgggcctcggcccgtggtaccgaacgggtaccttaccgttccccgttcgtaccttccttacgtacggg

SEQ ID NO: 127282 - DNA, 541 bp, Homo sapiens
  misc_feature: GYAE6OF02FEW8V.21.35.D02.1.454.CMB.1.raw
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
  modified_base (506)..(506): a, c, t, g, unknown or other
  misc_feature (506)..(506): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcggggggagcgtgttccagcctgggacgtccctgagagtctcctgtgcagcctctggattcagcttcagtgactttgccatgcacgtcgggtccnccagacctccaggcaaggggctagagtggctggcagttatcgctattcgatgggaancgatatgtactatgacggactccggtagaacgggtccgtattccacctatcctccaagacgaactaacttaccaaagtaaccacgtcgttagtttccagacaaatgacgcagacctagaaagaagagacacgctagtatataacgtgngcgcgagtaccttattattagtgtcgaggtactag

SEQ ID NO: 127283 - DNA, 666 bp, Homo sapiens
  misc_feature: GYAE6OF02GKC3M.21.35.D02.1.454.CMB.1.raw
  modified_base (280)..(280): a, c, t, g, unknown or other
  misc_feature (280)..(280): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgctattcgagtggaagcgatatgtactatgcgactccgtaggaacgggccattcaccatcctacagagacaattccaaagaaccacgcttgtttcngacaaatgaagcagcctagaaagagagacacgctagtaatataacgtgtacgcgacgaaggtacctttaagttacttaagtcggttacgaagggtaacctagttgtaaccgtacggttcggggaccgtaacggggaacccctagggtacccacccgttaccgtcccgttacgaccgtaccctacccgaacccggaaccgggacccctaacgttcccggttcccttacccccgtgggtccccgcccgttcggccctaccgaacggtaccgaccgtacccgtacgacgaccgacaccgaccggcccggtccggtcggtccgtccggtccgtaccggtacgaaccggtacctttaccgttccccgtaccggttcctaccgttacgtcgg

SEQ ID NO: 127284 - DNA, 697 bp, Homo sapiens
  misc_feature: GYAE6OF02H2P3O.21.35.D02.1.454.CMB.1.raw
  modified_base (238)..(238): a, c, t, g, unknown or other
  misc_feature (238)..(238): n is a, c, g, or t
tcagtcgtcgctcgcacgaccggtgctcgatttagcacacgatagttgggtttggggaggcgtgttccagcctgggacgtccctgagagtctccctgtgcagcctctggattcagcttcagtgactttgccatgcactgggtccgccagactccaggcaaggggctagagtggctggcagttatcgcattcgatggaagcgatatgtactatgcgactcgtgaaggccattcacatcncagagacaattccaagaacacgctagtttctcgactaaaagtgaacgtcaacgccgtaaggaaaaggaagacggaacgaacggcgttagtataataacgtgtacgcgacgacggtaccttaattagttagtcgttacgacggtacctagttacgaacgttacggtcggggacccgtaacggggtacccgtacgggtacccgtaccgttcctcccgtaccaccgtaccccttaccgaacccgtaaccgggtacccctaacgttcccggttaccccgtttaccccccgtcgggtcccgtccccgttacgccccgttacccgacgggtaccgacccgtacccgtaccggacgacgtccgaacgacgtcccgggacccggtcggcccgtacggcccggtaaggtacccgaaccggtacccgtttaccgtccccgttccggttacccgttcgttaccgtacggg

SEQ ID NO: 127285 - DNA, 693 bp, Homo sapiens
  misc_feature: GYAE6OF02G0M7C.21.35.D02.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaancgatatgtactatgcgactccgtgaagggccattcaccatctccagagacaattccaagaacacgctgtttctgcaaatgagcagcctagaaagaagaggacacggctgtatataactgtgcgacgaggacctttattacgttatggttacgagggacctagtttacgaccgttaaacgtcgggggacccgtaacggggtaaaccccttcggggtaccctaacccgggttccctttaccccgtaccgaacgtccccgttacccgaaaccccggtaaaccggggccccctaacgttcccgggttacccctttccccccgttgggccccgtaccccgttcgccccttacccgacgggacgaccgtaccccgtccggaacggcgacccgaccgtacggacccggtccccggtcgggtccctcggtacccgtcgggtacccgaacggtacccgttaaccgtttccccgtaccggttcccgttacccgttaacgtccggg

SEQ ID NO: 127286 - DNA, 737 bp, Homo sapiens
  misc_feature: GYAE6OF02GA1KC.21.35.D02.1.454.CMB.1.raw
  modified_base (288)..(288): a, c, t, g, unknown or other
  misc_feature (288)..(288): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccactggtggagtcgggggagcgtgttccagcctggacgtccctgagagtctcctgtgcagcctctggattcagtcttcagtgactttgccatgacncgtcgggtccgccagaccgtccaggtaccgaagggggtctaaggacggttcgggcctggggacctaagggtttactccggacttaagtttccggaagttacggggaagtccgtaatttacgtagttacctagtcggtaccggaccgttaccggtagggaaacgggtccgtacgttaccgacccgtaactccgtacgtaacggaacgtaaccgtaaacttaacccgaacggtaaaccacggttaccttaggttttaccaggtacctaaagtccggttaagaccgtaacggtaacccttaaggtaaaacgggaaaccgtacgggtaaccggtaaaccgggtccgttaacgtaagtttaacgtaacgtcggtaacggtccggtaaccggtaaccggttaacctttaacggtttacgttacgtttacggtttaccgaacgggtacccttacgg

SEQ ID NO: 127287 - DNA, 639 bp, Homo sapiens
  misc_feature: GYAE6OF02H4DV0.21.35.D02.1.454.CMB.1.raw
  modified_base (354)..(354): a, c, t, g, unknown or other
  misc_feature (354)..(354): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggtttttcctcgttgctcttttaagaggtgtccactgtcaggtccacctggtggaggtcggggggagcgtgttccagcctgggactccctgagagtctcctgtgcagcctctggattcagtcttcaggtgtacttttgcctatgctacgtcgggtccgccacgactccgaggcgaaggggtctaggaggtggctggctagttancgctagttcgagtagggaagcgattagtgtaactagtcggaccggtacttccggtaggaacgggtccgtacgttaccaacctacttcctaccgaagtacgtaactaacgttacccgaaagaaccacgtacttagtttacctagactaaagtgaacgacgacgtaccgtaaggaaacgaagaacggaacgacggtacgttagtataacgttaacgtggtacgacggtacggtaacggtaacctttagttaacgtttagttacgggtttacgacgggtaccttacgg

SEQ ID NO: 127288 - DNA, 528 bp, Homo sapiens
  misc_feature: GYAE6OF02I9G94.21.35.D02.1.454.CMB.1.raw
  modified_base (301)..(301): a, c, t, g, unknown or other
  misc_feature (301)..(301): n is a, c, g, or t
  modified_base (478)..(478): a, c, t, g, unknown or other
  misc_feature (478)..(478): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcggggggagcgtgttccagcctgggacgtccctgagagtctcctgtgcagcctctggacttcagtcttcagtgactttgccatgcactgggtccnccagacctccaggcaaggggctagagtggctggcagttatcgcattcgatggaagcgatatgtatagtgcgactccggtagacgggccgattcaccatcctcgaagacgaacaacttaccaaagaacacgtcttagtttcagactaaatgagacagacctagaagaagagacgacgntagtatatacgtgtacgcgcgacgtacttattatagtgtacgaggactag

SEQ ID NO: 127289 - DNA, 540 bp, Homo sapiens
  misc_feature: GYAE6OF02FU5BA.21.35.D02.1.454.CMB.1.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (485)..(485): a, c, t, g, unknown or other
  misc_feature (485)..(485): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcggggggaggcgtgttccagcctgggacgtccctgagagtctcctgtgcagcctctggattcagcttcagtgactttgccatgcactcggggtccnccagacctccaggcgaaggggctagaggtggctggcagttatcgntattcgatggaancgatagtgtactatgcggactccggtgaacgggccgattcaccctatcctaccagagacaacttccaaagaacacgtctgtttcagacaaatgagcagcctagaaagaagagacgacgctagtanataacgtgtcgacgcggtaacgactttattacttagtggttacgagggtacctag

SEQ ID NO: 127290 - DNA, 705 bp, Homo sapiens
  misc_feature: GYAE6OF02JYQFO.21.35.D02.1.454.CMB.1.raw
  modified_base (589)..(589): a, c, t, g, unknown or other
  misc_feature (589)..(589): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggagcgtgttccagccgtgggaccgtccctgagtagtctcctgtgcagcctcgtggattcagtcttcagtcgactttgcctagtcgctacgtcgggtcccgacccgtagacctccgagggaccgaaggggtcctaggagtcgggcgtgggacctaggttactcgctaacgtttccggagtaggaagcgtaattagtacgtactagtcggacggtaacctccggtagaacggggtcctagttccgacctagtaccaccgtaagaacgtactaaacttacccgaaagaaccacgtcttaggtttaccacgtaacgtaaacgttggaacgtccgtacgtaccgtaaaggaaacggtaagggaaccgtaccgaacccgggtnttaacggtaacttaacgttaacgtacgggtaccggtaaccgggtaccggtaacggttaacctttaagttttaaccggttaagtttcgggtaaccggttacgggtacccttaacggg

SEQ ID NO: 127291 - DNA, 815 bp, Homo sapiens
  misc_feature: GYAE6OF02HXPYQ.21.35.D02.1.454.CMB.1.raw
  modified_base (279)..(279): a, c, t, g, unknown or other
  misc_feature (279)..(279): n is a, c, g, or t
  modified_base (368)..(368): a, c, t, g, unknown or other
  misc_feature (368)..(368): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccactggtggagtcgggggagcgtgtccagccgtgggacgtccctgagacgtctccgtgtcgcgagcctcgtggtacttcagtcttnagtgactttgcctatcgctacgtcggtaccgcctacgacctccgaaggtcggaagggtctagaggtcggtcgtgtctagttacgtacgntacgttacgagttaggaacgtcggtaacttagttcgtaaactacgtcgggaccggttaaccgtaccggtacggaaaccggggtacccgttaacgtttcccgaacccgttaaccgttaccgttaccccgtaaacgggtaaaccgttaaacccgtaaaaccgttttaaccccgtaaaaacggtaaaacccgttaacccgggtttacctttaccggtttttaaccgttacgggtaaaccctaaaaagggttccggaaaccggtacgtaaccggaaccgtttaaaacgggaaaacggttaacggaaaccgggtaaacgtaccgggttaaccgttaggttaacgttaaccgtaacgtttacggtaccggtaaccggacggttaacgtttaaccgttttaacgtttacgttaaaccggtttcggttaacctaacggggtaacctttaaccggg

SEQ ID NO: 127292 - DNA, 700 bp, Homo sapiens
  misc_feature: GYAE6OF02JG9F9.21.35.D02.1.454.CMB.1.raw
  modified_base (174)..(174): a, c, t, g, unknown or other
  misc_feature (174)..(174): n is a, c, g, or t
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctctttaagnggtgtccactgtcaggtccacctggtggagtcgggggagcgtgttccagcctgggactccctgagagtctccgtgtgcagcctctggattcgagcttcagtgactttgccatgcacgtggtccgcagctccgaggcaagggctaggatggcaggctagttacncggactagttcgaacgtgggaaanccggtaattagtacggtacttacgtggacccggtacttacccggtaggaaacgggtcccgtaagtttcccgaacccgtactccgttacccgaaggtaaccgaacgtaaaaccgttaccgaaaacggtaaaccgtaacccgggtacctttacggtttaccgtaaccgggtaaacctaaaacgttacgggaacttaccggaacggacccgttaaaggaaaacggtaaacgaacggtaaccgaaccgggtactagttaacgtacgtaacgtcggtacgaccggtacggtaaccgttaaccgttatttaacgttaggttacggtacgtacgggtaccttaagg

SEQ ID NO: 127293 - DNA, 898 bp, Homo sapiens
  misc_feature: GYAE6OF02JI8V4.21.35.D02.1.454.CMB.1.raw
  modified_base (456)..(456): a, c, t, g, unknown or other
  misc_feature (456)..(456): n is a, c, g, or t
  modified_base (673)..(673): a, c, t, g, unknown or other
  misc_feature (673)..(673): n is a, c, g, or t
  modified_base (887)..(887): a, c, t, g, unknown or other
  misc_feature (887)..(887): n is a, c, g, or t
tcagtcgtcgctcgcacgaccggtgctcgatttagcacacgataggttgggtttgggggggagaggagcccagcactggaagtcgccggtgtttccattcggtgatcagcactgaacacagaggactcaccatgggagtttgggctgaccgttgggttttcctcgttgcttacgttttaaggaggtcgtcctacgtgtcgacggtcccaccgttgggtacggtagggtcggggggagtcggttacgttccacggccgttggggtacccgttccccgaggaacggtcggttcccttaccgttggttcgccgacgtcccgttcgttacgggtaacttcgaacggtccgtttagaggtaccgttaccgttttcggccctaagttccggaccgtaccggtccggggtccgtacccgaggtacccgtacgaccgggtaccggaacggggtccgttaaaggnggtcggtaccggtgggtaccgtagttacgtcggtactacgttacgaggtacgggaactacggtatttaaagtcgtaacgttacgcgggtaacccgttaccgggtaccggtaacgggtaaccggggtcccttaacgtttaacccgtacccgttaaccgttcccgtaacccgaagggtaaccgtaaaccttaaaaccgtttacccgaaaccggtaaccnccggtttacttttaccgggttactacggaaactaacggttcgaacggtccgttaacggtaacctaagggtaaaaccgggacgttaacgggacccgttaacgttcggaaagttaccgttaacggtacggtaccggtagaacccggggtacggtaacccgttttaacttttaacggttaccgttaaggttttccggtaaccggttaaccccgggtntttaacccggg

SEQ ID NO: 127294 - DNA, 553 bp, Homo sapiens
  misc_feature: GYAE6OF02G9LWH.21.35.D02.1.454.CMB.1.raw
  modified_base (198)..(198): a, c, t, g, unknown or other
  misc_feature (198)..(198): n is a, c, g, or t
  modified_base (279)..(279): a, c, t, g, unknown or other
  misc_feature (279)..(279): n is a, c, g, or t
  modified_base (314)..(314): a, c, t, g, unknown or other
  misc_feature (314)..(314): n is a, c, g, or t
  modified_base (443)..(443): a, c, t, g, unknown or other
  misc_feature (443)..(443): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
  modified_base (549)..(549): a, c, t, g, unknown or other
  misc_feature (549)..(549): n is a, c, g, or t
tcagtcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaancgatatgtactatgcggactccggtagagggccgattcaccatcctccgagacgacaattccaaggaacacgtctgtttcngacaaatgagcacgcctagaaagagaggacacggntgtatacgtaactgtgcgacgagtacttagttattagtcggtacgacgggtactagttacgacgtacggacgggccgaacgggtacctcggtcaccgtctccctcgccgacctaccgaccgacggtccncgtccgtccctcccgngcccnccgtcgccgtccgagacnccaccgtcgacgcncacgcgccgaccgtggccacgcgtcgacgacgtccttacgtcctcgtctcgtntcgg

SEQ ID NO: 127295 - DNA, 765 bp, Homo sapiens
  misc_feature: GYAE6OF02JQZRO.21.35.D02.1.454.CMB.1.raw
  modified_base (185)..(185): a, c, t, g, unknown or other
  misc_feature (185)..(185): n is a, c, g, or t
  modified_base (387)..(387): a, c, t, g, unknown or other
  misc_feature (387)..(387): n is a, c, g, or t
  modified_base (655)..(655): a, c, t, g, unknown or other
  misc_feature (655)..(655): n is a, c, g, or t
  modified_base (662)..(662): a, c, t, g, unknown or other
  misc_feature (662)..(662): n is a, c, g, or t
  modified_base (696)..(696): a, c, t, g, unknown or other
  misc_feature (696)..(696): n is a, c, g, or t
  modified_base (720)..(720): a, c, t, g, unknown or other
  misc_feature (720)..(720): n is a, c, g, or t
  modified_base (759)..(759): a, c, t, g, unknown or other
  misc_feature (759)..(759): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactccaccatggaggtttgggcgtgtaccgttgggttttcctcgttgtcttcgttttaaaggnggttcgtcctactcgtctacggtccaccgttgggtgggaacggtcgggggggtagtcggttcggttaccgacggccgtttacgggggaaccttccccgtaggaggtaccgttccgttacccttgggtcgacctaccggtcccgttcgttaggtactttccgagttccgtttacacgggtttcgtaccgttttcgaccccgtnttcgggcctacggttccggcccgtaaccgtacgtaccgtacccgtacgggtacgtaaggggtcctaaggtacggtcgggtcgtcggttaccgtaagttcggtctacgttaacgtggtacgtaggaacctgtattacgttaagttcgtaagtcgtacccggtacggtcggttacgggacgtacctacgtaccctatacgtcctaaccggagtaaacgtactaaccgtacgaaacctacgtacccgttagtttacgtcgtacaagtaacncggtacncgtacgtacgtaagaacgtaagcgtacacggttnccggtatacgtggacctgtaccgngttaaccgtagttaagttcgttaagtcggtacttaccgngttacg

SEQ ID NO: 127296 - DNA, 679 bp, Homo sapiens
  misc_feature: GYAE6OF02IET4D.21.35.D02.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatgggagtttgggctgacctgggttttccncgttgcttcttttaagaggtgtccactgtcaggtcccactggtggacggtcggggggagcgtgttccaggcctgggacctccgtgagacgtctcctggtgccagcctcgtggattcgagtccttcagtgtactttcgcctatcggcctacggttcggggtacccccaacgtaccttccggaacgggacggaaacggggggtccttaagggacgggttcgggtcggttgggaccttacggttttaacgccgtacgttaactttccggagttacggggaaacgtcggtaattaagttacggtaaccttaaggtcggacggtaccgttcggtaggggaacggtccgttaatccgaacctctaccgacaggaactacgtaacttacaaacgtaaccacgttcttcgtttacagtacataggacactagccgtaagaaagtacgaggaccaggtctagtactagtacgtgtacggcgcggtaacttatttacgttacgttagttcgggtacgtacggtctaagg

SEQ ID NO: 127297 - DNA, 693 bp, Homo sapiens
  misc_feature: GYAE6OF02F94TZ.21.35.D02.1.454.CMB.1.raw
  modified_base (190)..(190): a, c, t, g, unknown or other
  misc_feature (190)..(190): n is a, c, g, or t
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
tcagtcgtcgctcgcacgaccggtgctcgatttagcacacgatagttgggttggggaggcgtgttccagcctgggacgtccctgagagtctacctgtgcagcctctggattcagcttcagtgactttgccatgcacgtgggtccaccagactccgaggacgaagggggctagagtggcgtggctagttancgctagttcgataggaagcgatatacgtactagtcgcggtactccggtaggaacgggctattaccgaacctntaccacagagaactaactacgaacgacgacgtcttacgtttnagaactaatgaacgcacgtcctaaggaaacgtaaggaacggtaagccggattagtaactaagtaacgtggtacgcggacgtacgtactttagttactagttaggtaccgaaggtacagttacgacgtacgggtacgggaccgaacggtaccgtacggtacctacggtcctccggtaccacccgtccgtaacccgaccgaccggtaccctaggtaccccgttccgtacccgtcgtaccggccctcggaccctacgaccgggtactacccgtaccgtaccgaacgtaccacggtaccaccgggtccgaccggtcgggtccctaacgtccggtaaccggtaaccgacggttaaccccgtcggtacccgaccgaccggtaccgtcgtaacggg

SEQ ID NO: 127298 - DNA, 722 bp, Homo sapiens
  misc_feature: GYAE6OF01CKBWB.43.18.B07.1.454.CMB.1.raw
  modified_base (156)..(156): a, c, t, g, unknown or other
  misc_feature (156)..(156): n is a, c, g, or t
  modified_base (314)..(314): a, c, t, g, unknown or other
  misc_feature (314)..(314): n is a, c, g, or t
tcagtgtgagtagtcacgaccggtgctcgatttagtcgctgcgtaaaggaggtaaagggggggtgtagggtccaggaggcagaactactagggtcgtcgtcaccatggcctggatccctctacttctccccctcctccactctctgcacaggctcngaggccgcctatgaggtgaccacagccacacgtcggtagtcaggtcgtcccgaggacaggaccggccagggactcgaccgtgctctggacatgtaattggaccaaggctaatttggttattggtaccagcagagccacgcccgaggcccctgtgtggngtagtgtaataagcgaggtgacgacggtcctacgacgggactcccgagacgcgtacttccgtacgcggtccgaccgagccgtacgacggaacagtacgtacgtacgttacgaacacgtacgaggtacggacgtacgaggacaaggaacgacggagctagtacttagttacgtagtacgacggtacgtaagtaacgacgtacgacgtagggttcgttacccgtttaggtaccggggttacgggttacccgggggaccgggggttaaccgtaacggtttacccggttaccgggtaaccccggtttaccggttaaccgggttacccgtaacccgggtaacccccggtaacgggttaccccggttacccccgggttacccccccggtttcgggtaaccccgtttacccccgg

SEQ ID NO: 127299 - DNA, 851 bp, Homo sapiens
  misc_feature: GYAE6OF01DNU37.43.18.B07.1.454.CMB.1.raw
  modified_base (185)..(185): a, c, t, g, unknown or other
  misc_feature (185)..(185): n is a, c, g, or t
tcagtgtgagtagtcacgaccggtgctcgatttagtcgctgcgtaaaggaggaaagggggtgtgggtccaggaggcagaactctgggtgtctcaccatggcctggatccctctacttcctccccctctcactctctgcacaggctcgtgacggccgcttatgaggtgacacagccacactcggtntacgagttcgtaccccgaggaccagaccggccaagggactaccgacccgtgccttcggtaggagtatagtaagttcgaaccgaaggtactttaattttgttacgtttacggtacctacggacaacggaaccgtacccgacgacccggacggtccccgtggtttgggttcggttagtaaggttacgtaaaagtaaacggtaacgtagggtaacggtacgggtaacccggtcccggttacggtaaccggggtaaccttcccggtaacgggtacggtaccggtacttttccggtcggccgggtaccggtcccgaacggtcctaaccgggaaaggtaaccgttagtacggttaccggttaacgttaaccggactaacggttccggtaggtacggttacgaccggacggaacgaaacgggtaaaggacggtacggccgttaaacgtacgtttaagtttacgttaacggtaacgtaacgtaccggtaagtaaccggaacggtacgtaccgggttacgggtttacggttaaccgggttttggggttccgggttacggggggtccgggggtaaacggggtacctacggtacccggtacggtacccggttacggtaccgaaccgtacgcccggtacggtacccgtcccggtaccccgtcggttcccttacccggg

SEQ ID NO: 127300 - DNA, 642 bp, Homo sapiens
  misc_feature: GYAE6OF02I5F9J.43.18.B07.1.454.CMB.1.raw
  modified_base (113)..(113): a, c, t, g, unknown or other
  misc_feature (113)..(113): n is a, c, g, or t
  modified_base (237)..(237): a, c, t, g, unknown or other
  misc_feature (237)..(237): n is a, c, g, or t
tcagtgtgagtagtcacgaccggtgctcgatttagtcgctgcgtaaaggaggaaagggggtgtgggtccaggaggcagaactctgggtgtctcaccatggcctaggatccctntacttctcccccctctcactctctgcacaggctcgtgaggccgcctatggaggtgacacagccacgacgtcggtgtcagtcgtccccaggacagacggccaggactccaccgtgcttcgtgganagtgaattcgaccgtaaggctaagttttgttagttggtaccagcgagacgccacgccccgaggcccctgtcgtggtgagtgtaataagactaggtgagacggcctgacgggactccgtgacgcgtattccgtcgtcggcgaccgtagcctagacgaactagtacgtacgtacgttacgaaccgtagttccgagtacggtacgtccgaggcgtaagaacgacggaggcgttacgacgttagttacgtcgtaacgtagacgtagtacgaagtcgacgttaggttcgttacgtttcggtcgggttcggttacggggtaccggggactaggtccggtacggtacccggtacgtacggtaccgtacgtacccgacggtcccgtaccgtcccccgtcggtaccttacccgg

SEQ ID NO: 127301 - DNA, 754 bp, Homo sapiens
  misc_feature: GYAE6OF02HDKR9.43.18.B07.1.454.CMB.1.raw
  modified_base (152)..(152): a, c, t, g, unknown or other
  misc_feature (152)..(152): n is a, c, g, or t
tcagtgtgagtagtcacgaccggtgctcgatttagtcgctgcgtaaaggaggaaagggggtgtgggtccaggaggcagaactctgggtgtctcaccatggcctggatccctctacttctccccctctcactctctgcacaggctctgagccnctatgaggtgacacagccacacgtcggtgtctagtcgtccccaggaccaggaccggctaggactccaccgtgacctcgtaggatacgtgaacttcgaccgaaaggtcttaagttttgtttacgttacggtacctaggacgtaaggaacgcccgaacggacccgaccggtccccgttggtggtttcggtagtagtacggtaataaacgacgtaggtgacggtaccggtcctaggacggtaccttcccgaggtacgcgttacgtttcgtacgtcggggtaccaccgagtacggtaccggaaacggtaacgtaccggttacgtaccgttaacggttaccgaactcgtacggtaacggttcgggacgtaccgacggtacggaagaacggtacggacgtacggtacgttaactttacggttacttaggtaacgaacggtaccgtaagggtaccgtaacgtaccggttaggttaccggttaccggtttaaccgtttgggtacccgggttagggttaccgggggacggggtactaccgggtcggtaacgttaccggtacgtacggcctacgaaccgtcggtaccgtcccgtacccggtcgtacgtcccg

SEQ ID NO: 127302 - DNA, 596 bp, Homo sapiens
  misc_feature: GYAE6OF01BMJT8.4.16.B05.1.454.CMB.1.raw
  modified_base (248)..(248): a, c, t, g, unknown or other
  misc_feature (248)..(248): n is a, c, g, or t
  modified_base (350)..(350): a, c, t, g, unknown or other
  misc_feature (350)..(350): n is a, c, g, or t
tcagagcactgtagcacgaccggtgctcgatttagagctcacgtagttgggtttgggggggcctcaggaagcagcatccggaggtgccgtctagccattggctatggatccctctcttcctcggcgtccttgcttactgcacgaggtagtccggggcctcctatcgaacttgactcaaccaccttacactgtccgtctctccaggacgacagccgtcatcgacctgctctgcaaacggcttggggganagatatgtttcctggtatctccagagccaggtccactccctattctagtccatgtatcaaacgtacgaagccgccctcgacggggtccctgagcgtctttcncggctccaagtcgtggggacacgacgcctactctcgacttcctcgtcccggggcccagggccagtccgatggagggacactattactgtcaggtcgtaggacagcacaacgtgactagtccgttcgggacgggtacgggaccgagggtacgacccggtcgtcgggtccacggtcccgaaggtcctaccggcccccgttaggtcctacgtccgttcgttaccccaccccgttccgttcccgtaaccg

SEQ ID NO: 127303 - DNA, 729 bp, Homo sapiens
  misc_feature: GYAE6OF01B1DZC.4.16.B05.1.454.CMB.1.raw
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (326)..(326): a, c, t, g, unknown or other
  misc_feature (326)..(326): n is a, c, g, or t
tcagagcactgtagcacgaccggtgctcgatttagagctcacgtagttgggtttgggggggcctcaggaagcagcatcggaggtgcctcagccatggcatggatccctctcttcctcggcgtccttgcttactgcacaggagtccggggcctcctatcaactgactcaaccaccctcactgtccgtctctccaggacggacagccgtcatcacctgctcngcaaacgngttggggagagatatgttcctgtatctaccagacggccacggccacctccctattctagtcatgtatacaactacgaacgccgccctcgacgggtccngacgtcgtctttcgtcgtcctacgtaaggtcgtaggggaccacgacgacctacgtcgtacgtaccgttcgtcccggtaccccggggtacccgtacgggaccctacgttccggtagtacggggaacgggtacgtaaccttacggttacctcggttaccggacgggttaccggtagggaacccacggtaccaaccgtaaccgttacggccgttaacggttccggttaccgggggacccgggtaacggggtacccggtagggggttcccgtaacccgggttccggttacggggtacccaaccggtaccccggtaacgggtcccgtccccggttccccccgtcggttaccctacccggttcccgttaccccggttcccccgtacccgttccccgttccgttaaccgg

SEQ ID NO: 127304 - DNA, 945 bp, Homo sapiens
  misc_feature: GYAE6OF01DXRZS.4.16.B05.1.454.CMB.1.raw
  modified_base (247)..(247): a, c, t, g, unknown or other
  misc_feature (247)..(247): n is a, c, g, or t
tcagagcactgtagcacgaccggtgctcgatttagagctcacgtagttggggtttgggggggcctcaggaagcagcatcggaggtgcctcagccatggcatggatccctctcttcctcggcgtccttgcttactgcacaggacgtccggggcctcctatcaactgactcaaccaccctcactgtccgtctctccgaggacggacacgccgtcactccacctcgctctgacaaacgtcgttagggganagatagttcgtttcgtagtactctcgaggacgccacggccacctccctattctacgtctatcgtactacaaactacgacgccgtcccgtacggtacgggtcctgacggtcgttaccgtttcgtcggtacctacggtaacgtcggtacggggaccaccgacgtacccgtaccgttcgtacggtacccgttccggttaccccgggtaccccgggggtaacccccgtaacgggtaccctaaccgggtacccgggtaaacgggtacggggtaaaccggggtaaccgtttaaaccgtttaaaccgttttacgggtaccgggtttacccggggaaacggggttccggggttaaaccggggaacctaaccggggtaaacccgaaacccggtttaaacccgggttcgggtaaccggtttaaccgggtttacccgggtttacccggggggaacccggggggtaaaccggggtacccgggggttaaccggggttacccgggtaacccccggggttttaccgggtaacggggttaccccgggtaacccgggtaacccccgggttaaacccgggtccccggtttaccccccggggttccccccggttacccggggttaccctttaaacccccggttcccccggttttaacccccggttacccccccccgttaacccccgtttaacccccgttcccggtttaaaccccggg

SEQ ID NO: 127305 - DNA, 916 bp, Homo sapiens
  misc_feature: GYAE6OF01CAS7P.4.16.B05.1.454.CMB.1.raw
tcagagcactgtagcacgaccggtgctcgatttagagctcacgtagttggggtttggggggcctcaggaagcagcatcggaggtgcctcagccatggcatggactcctctcttcctcggcgtccttgcttactgcacgacggacgtcccggggccttacctataccaaacgttcgaacctaccaaacccctaccctacctacgttccgtcccgttacctccgtaccgaagggaccggacacgtccgtacactaccgacctgcttcgacgaaccgtaaacggtcgggtagggggaataaggtaattcgttcgtttccggtaggtactcgtaccgaggtacggcgacggcctacctcccttagtcctagtctagtacgtactaaccgaaactacgacgtcccgtaccgacggtccggtaccgcggtacgtccgttctttccgacggtactaccgtacggtacgggtacgggaacctacgacgtaacccgtacgtacctacgttacccgtcccggttacccgggacccgggtacccgtaacggtaccgaacgtgggaaccggttacggggaacgttaacccgttaaacgtttccgttaaaaccggttgggtaacccgggtaacgggggtcgtaacccggggaaactccgggaaacccgttaacgtaacccgtcgggtaaccgttaccgggtacccggggttaaccggggaccgggtaaacccggggtagggttaccgggtaacccgtccccggggttaagggttcccggaaccccgggtaaaccggttaccccggtaaccggggttcccccggtaacccccggttaccccggttaacccggttccctaaaccccggtttccccggttaaccccccggtacccttaacccccggttcccggttaaccgttaaacccgggg

SEQ ID NO: 127306 - DNA, 693 bp, Homo sapiens
  misc_feature: GYAE6OF01D0KAK.4.16.B05.1.454.CMB.1.raw
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
tcagagcactgtagcacgaccggtgctcgatttagagctcacgtagttggggtttggggggcctcaggaagcagcatcggaggtgcctcagccatggcatggatccctctcttcctcggcgtccttgcttactgcacaggatccgggctctatcaactgactcaaccacctcactcgtccgtctctccaggacgacagccgtcactcgacctcgctctacgacgaaacgtcgttgggganagatactgtttccgnggtactctacgagacgccagccactccctagttctacgtcatgtacacgaacgtacgacgccgtccgtacgacgggtccagacgtcgttcgtttacgtcggacctaccgacgttcgtacggggacacgacgtacctactcgtacgtaccgtcgtaccggacccggggacccaggtccctaggtacgtacgtacgggacggaacttacgtacgttacgtcgtacggaagggtcggtacgggacgtacgtacgaactacgtgtccttaaggttacccgtcggggacggtaacggggtacctacggggttacccgaccggttaccggtacgggtaccggaacccggtacccggaccgggttcccggtacccggtccccgttaccggtcctacccgttaccgttccccggttaccccggttcccctcccgttacccgtacgg

SEQ ID NO: 127307 - DNA, 709 bp, Homo sapiens
  misc_feature: GYAE6OF01CZ28Q.4.16.B05.1.454.CMB.1.raw
  modified_base (275)..(275): a, c, t, g, unknown or other
  misc_feature (275)..(275): n is a, c, g, or t
  modified_base (334)..(334): a, c, t, g, unknown or other
  misc_feature (334)..(334): n is a, c, g, or t
  modified_base (444)..(444): a, c, t, g, unknown or other
  misc_feature (444)..(444): n is a, c, g, or t
  modified_base (495)..(495): a, c, t, g, unknown or other
  misc_feature (495)..(495): n is a, c, g, or t
tcagagcactgtagcacgaccggtgctcgatttagagctcacgtagttgggggtttgggggggcctcaggaagcagcagtcgggaggtcgcctcgagccatggcagtcggactcccttctcttccgtcgggccgtccttgtcttactgacacgagggacgtccggggcctcctactcaactcgactccaacccaccctcacgtcgtccgtctccgtacgacgggacgacacggtccgtcactccgacctgctcgagacgaacggtaggtgggganagattagttcggttcgtgtactctacgacggacgtcgacgtcctaccttcctatcgtanacgtatacgtaactacgaactacgaccgtcccgtaccgtacggtaccgggtacctcggacgtccgttcgtttcgtcgtaccgtacgtacggtcgggacggtacacgtacnccctgtactacgccttaccggccgggcccgggcctacggaccgtgtacggnggtacgggacgtagacttacgttacggcgtaggtcgggcgtacggacacgtacacgtcgcgacgtcggtacggacggggtacggacggtcgtacgggtaccgtcgtaacggcgggccgaacgggttcccggacggttcccggtcccgtcccggttccccggtaatcccgttcccgttaacccggtcccctaacccttccggtacccttaccggg

SEQ ID NO: 127308 - DNA, 848 bp, Homo sapiens
  misc_feature: GYAE6OF01BRZ38.4.16.B05.1.454.CMB.1.raw
tcagagcactgtagcacgaccggtgctcgatttagagctcacgtagttggggtttgggggggcctcaggaagcagcatcgggaggtgcctcagccatggcatggatccctctcttcctcggcgtcttgcttactgcacgaggacgtcccggggccttcctatcaactgacctacaaccaccctcactcgtccgtctctccgaggacggacacgtccgtctacgtccacctcgtcctcgtacgaaccgaaaccggtacgggttacggggggaagaaggtagttagtttccggttttaccgtggtttacctccgtaccgaaggaccggaccgaccggtccctaaccctttccccgttacttacgtacggttactaagttacttaactaacctaaaccgtaccgaaccggtccccgtacccgtaccgggtacccgggtccgtacgaccggttccgtttacgttttcgcgtaccgtaccgtaaggtccgggtaacggacctacgaccgtacctaacgtcccgttacgtaccgttcccggtaccccggggtccccgggacccgtacggtacccgtacggttacggaagggttccgggtaaagggtaactaaccgttacggttaaccgtacgggtaccgggtacggggtaccgggtacgggaacccgtacggtaaccctacgtaacgtacggtaccggtaccggttccggggtccggggtaacggggaccgggacgggttccggtaccggtcccgggtcgtcgggaccgtaccggtacgtcccggcccggttcccgccccggttccgtacccttcgtacccgttaccccctacccgtcccttcccgaccgtacg

SEQ ID NO: 127309 - DNA, 828 bp, Homo sapiens
  misc_feature: GYAE6OF01EIT1U.4.16.B05.1.454.CMB.1.raw
  modified_base (272)..(272): a, c, t, g, unknown or other
  misc_feature (272)..(272): n is a, c, g, or t
tcagagcactgtagcacgaccggtgctcgatttagagctcacgtagttgggggtttggggggggcctcaggaagcagcatcggaggtgcctcagccatggcatggactccctctcttcctcggcgtccttgcttactgcacgagggacgtccggggccttcctatcaactcgactaccaacccaccctcactcgtccgtctctccgagggaccggacgacgccgtacactccgacctcgctcgtagaccgaaacggtacggttagggggaanagtagttagttcgtttaccgtggttactccgtaccgaaggaccggaccgaccggtaccctaacccttccccttactttcgtaacgtactaacgttacgtaacgtaaccgtaaaaccgtaccggtaaccgccccggtaccccgtacgggtaccggggttccctaggtaccgtccgtttccgttttcgcggtacctaccgtaggttcggtacggggaaccaccgacgtacccactccgtacgacccgttccggtaccccgggtacccgggacccgtacggacccgtaagtaccgggaaggtacgggggaacgggtaacttaaccgttacggttttaacgtacggtaccgggacggggtaccgggtaacgggaaccacggtaaccgaaccgtacggtacgtaccgggtacggttccgggtacgggggaccggggaacgggacgggtacgggtaccggtaccggtcggtcgggaccgaccgggtacccgacgggtcccgtcccggtccctcggtaccctccgttcccggttcccgtacccctcccgttaccgtcgtaccg

SEQ ID NO: 127310 - DNA, 717 bp, Homo sapiens
  misc_feature: GYAE6OF02FU5UA.4.16.B05.1.454.CMB.1.raw
  modified_base (239)..(239): a, c, t, g, unknown or other
  misc_feature (239)..(239): n is a, c, g, or t
tcagagcactgtagcacgaccggtgctcgatttagagctcacgtagttggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgcgttggggganagatatgtttcctaggttactctccagacggccaggccacctcccctattctagtcatgtactaacaactacgacgccgcccgtacggaccgggtcctggacgtccgtttactttcgcggtcctaccgtacggttcgggtacgggacctaacgaccgacctacgtcgtacgtaccttcccgtacccgggtccccgggacccgtacgggcctaacggtcgaggtaggggaacgggtactacgtttaacttacggtcgaccggtagggtcggtaacgggactaccgggactaaccgtagtcgacgtacggttccgtacgggggcggaacggggtacggtacgggtaccggtaccgttccgggacgggtaccgaccggaccggtaaccggtcccggtaccccggtacccccggtttcggacctaccggttttcccgttacccccggttaccccctacccccgtttaccgtaccctaccggg

SEQ ID NO: 127311 - DNA, 758 bp, Homo sapiens
  misc_feature: GYAE6OF02HAJHP.4.16.B05.1.454.CMB.1.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (338)..(338): a, c, t, g, unknown or other
  misc_feature (338)..(338): n is a, c, g, or t
tcagagcactgtagcacgaccggtgctcgatttagagctcacgtagttgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggcagccgtcatcacctgctctgcaaacgcgttggggganagatatgtttccgnggttactctcctagcggccaggccactccccgtattcctagtcagttgtactacaacgtaccgaagccgccccgtcgtacggggtcccnggacgtcgttcctttacgtcggctaccgaagtccgtggggacctacacgccacgtctgaccttccgtccgtacccgggcccacgggacctacgtcgaacgtaggaacggggtactaacgttacgttacgttacggtacgaaggggttcccggtaagggacctacggtaacccgaacgtaaccgttcggaccctaacgggtttcccggtttacggggcccgggtaacgggtaacccgttacgggggtaccgtaccccgggtttaaccgtcggggttacccgaaccgggtaccccggtaaacgggtccccgttaacccgggtcccccccggtttacgggttaaccccgttcccggtttacccggtttccccggttacccccccggtacccggtttacccccgttaaccgggttaaccccggg

SEQ ID NO: 127312 - DNA, 847 bp, Homo sapiens
  misc_feature: GYAE6OF02F72LU.4.16.B05.1.454.CMB.1.raw
  modified_base (647)..(647): a, c, t, g, unknown or other
  misc_feature (647)..(647): n is a, c, g, or t
  modified_base (703)..(703): a, c, t, g, unknown or other
  misc_feature (703)..(703): n is a, c, g, or t
  modified_base (796)..(796): a, c, t, g, unknown or other
  misc_feature (796)..(796): n is a, c, g, or t
tcagagcactgtagcacgaccggtgctcgatttagagctcacgtagttgggtttgggggggcctcaggaagcagcatcggaggtgcctcagccatggcatggactccctctcttcctcggcgtccttgcttactgcacaggagtccggggcctcctatcaactgactacaacccaccctcgacctcgtccgtctctccgagggaccgacacggtccgtacactccgacctgaccttcgtacgaaccgtaaaccggtacgggttacggggggaagacgtattaacgttcggtttaccgttcggtaactccgtaccgtaaggaccgggaccgacggtaccctaacccttccccgttatttaccgtacgtactaacgttacgtaacgtaaccaaaaccggttaccggaaaccgtcccggtacccccgtagggtaacccggggtcccgtaggtaccggtcccgtttcgttttaccggtccggtacccgttacgtaacggttccggggtacgggaacctaaccgtcgacccggttacttacgtcgacccttaccggttcccgggacccgggaccgacggtaccttacgtcggacgtcgggaacggtactacgttaacgtttacgcggtacgggtacggtcggacggtaaccncgaacgtactaacggcgtacgtaaccggttcggtaccggggacggtaacccggggngttaaccggggtacccgtccgttaccggggtacgggtaccctaaccggacccgggttaacggtccccggtaccgtcccccggttacgtacccnccgttttacccggttcccgtaaccccctccccgttacgtccccgtaaccgg

SEQ ID NO: 127313 - DNA, 749 bp, Homo sapiens
  misc_feature: GYAE6OF02FPPS5.4.16.B05.1.454.CMB.1.raw
  modified_base (136)..(136): a, c, t, g, unknown or other
  misc_feature (136)..(136): n is a, c, g, or t
  modified_base (207)..(207): a, c, t, g, unknown or other
  misc_feature (207)..(207): n is a, c, g, or t
  modified_base (739)..(739): a, c, t, g, unknown or other
  misc_feature (739)..(739): n is a, c, g, or t
tcagagcactgtagcacgaccggtgctcgatttagagctcacgtagttggggtttgggggggcctcaggaagcagcatcggaggtgcctcagccatggcatggactccctctcttcctcggcgtccttagcttacngcacgaggactccgggctcgtatcaactgactcaaccacctcactcgtccgtactctaccgaggaccgganacgtccgtacactccaccgtgtcctctacgacctaaacggtcggtagggggatagacttagttcgttttaccgaggttactccgtaccagggaccggtccgaacgggtccctaaccgtcccccttagtttccgtacggttacctagtacggttaactaacgtaaaccgtacggaaccgtacccgtacccggtacggtaaccggggtccctaggtacccgtcgtttccgtttcgccggtacctacgttaaggccggtacgggacacgacgacctaacgtcgtactacggttcccgacccgggtccgggacccgtacggaccgtcgtacgtaggtgggaacggtacggttaactacgtacggtcggtacgtcggggtacgtacggacgtaccgacacgttaggctacggtagtccgtacgggtcggacgggtacgccgggtcgttaccgcggtcggaccgtacgaccgggtaccgtcccgtacccgtcggttacccgccgttacgtaccgttcccgtaacccctcggttacccncgttaaccgg

SEQ ID NO: 127314 - DNA, 814 bp, Homo sapiens
  misc_feature: GYAE6OF02HEHXG.4.16.B05.1.454.CMB.1.raw
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
tcagagcactgtagcacgaccggtgctcgatttagagctcacgtagttgggtttggggggcctcaggaagcagcatcggaggtgcctcagccatggcatggactccctctcttcctcggcgtccttgcttactgcacgaggacgtccgggcctctatcaactgactcaaccacctcactcgtccgtctctccgaggacgacacgccgtcacnccaccgtncctctcgacaaacgtacggttcgggaccagtactttatcgttaccgttggttactcgtaccgtaggacggccgacggcctaccctacccctagtttacgtcagttcgtactacctaacgttcggaccggccgtaccccgtacgtacggtccgtaccgtcgaaccgttcgtttaccgggtacctaccgtaacggtccgtacgggggtaaccctacgtaacggacctaccgttacgtacgtaacgtttaaccggtaccccgggggaaccctaccggacccgtaacgtacggtaccgtaggggtaaacgggttactttaaccggttttagtacgttacgggaacggtccggggtacgaacggtaccgtaccgaaccttaacccgtttcgaccgtttacgggtccgggaccgggtaccgggaaccgtaccgggtaggttaacccggtacgttacccggttcgggtaacccgtcccgggaaccgaccggttacccgaccccggtaccccgttcccgggtaccggttccgttaccccgttcccggtttcccccgtccccgttacccgttccctaaccggtccgttacctcggttaccggg

SEQ ID NO: 127315 - DNA, 502 bp, Homo sapiens
  misc_feature: GYAE6OF01BRXVU.49.64.F09.1.454.CMB.1.raw
  modified_base (499)..(499): a, c, t, g, unknown or other
  misc_feature (499)..(499): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagttactgatctatgctgcagccaatttgcaaagtgggtcccatcaaggttcagtggcagtggatcgtggacagaattcactctcaccatcagcagtctgcaacctgaagtattttaggaaattactattgtacaactagtaagttacggaaacttgactctattttcggacggtagggacctaagggtggagtagtacgaaagactggtgctgctacatctgtctntac

SEQ ID NO: 127316 - DNA, 497 bp, Homo sapiens
  misc_feature: GYAE6OF01BZDG0.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtcccatcaaggttcagtggcagtggatctgggacagaattcactctcaccatcagcagtctgcaacctgaagatttggaaagtactattgtcaacagagttacggaaacttgacttcattttcggcggagggaccaagggtggagatacgaaaagaactaggtggctgcaccatctgtcttctac

SEQ ID NO: 127317 - DNA, 605 bp, Homo sapiens
  misc_feature: GYAE6OF01BDMJX.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaagcccctaagttactgatctatgctgcagccaatttgcaaagtgggtcccagtcaaggttcagtgcagtggatgtgggacagaattcaactctcaccatcagcagtctagcaacctgaacgtattttaggaaaagttacttagttacgtactaaacgtagtaacgtttaaacggaaactttcggacttacgttaagttttttaccgggacgggtaacggggtaacccgtaaaggggttacggaaaggtaaacgttaacgaaaaacggtaaacgttaggtacgggtaaccgttacggaaccgtaccctaacgtttaccgtttacgttccgtttaccgtaaccg

SEQ ID NO: 127318 - DNA, 549 bp, Homo sapiens
  misc_feature: GYAE6OF01BBN0R.49.64.F09.1.454.CMB.1.raw
tcagagtcgagagacacgaccggtgctcgatttagcgcgtatacaaagggggaaggtacagtcttcagtcaggacgacagacaatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaatggtatcagcatacccgggaagcccctaagtactgatctatgctgcagccaatttgcaaagtgggtcccatcaaggttcagtggcagtgatctggacagaattcgactctacaccatcagcagtctgacaacctgaagtatttaggaaattactaattgtacaactagtacgttaacggaaacttgacttactaacgttttcggacggtaacgggtaccaagggtcgaagtaactacgaaaaacgtactaggttacggacttaggacctaaccgtattacctacggttccttcgtaaccg

SEQ ID NO: 127319 - DNA, 501 bp, Homo sapiens
  misc_feature: GYAE6OF01A5WQR.49.64.F09.1.454.CMB.1.raw
  modified_base (427)..(427): a, c, t, g, unknown or other
  misc_feature (427)..(427): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcatacccggggaagcccctaagttactgatctatgctgcagccaatttgcaaagtgggtcccatcaaggttcagtggcagtgatctggacagattcactctcatcatcagcagtctgcaacctgaagtatttaggaaatactattgtacaatagagttaacggaaacttgacttanattttcggacgtagggacctaagggtggagtagtacgaaaagtaacgtgtaggactggacaccatctgtcttac

SEQ ID NO: 127320 - DNA, 538 bp, Homo sapiens
  misc_feature: GYAE6OF01CR3S6.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaagcccctaagtactgatctatgctgcagccaatttgacaaagtgggtcccatcgaaggttcagtgcagtggatcgtggacagaattcactctcacatcagcagtctgcaactgaagtatttaggaaattactattgtactaagagtagttaacggaacttgacttacgtagttttcgggacggtagggtaccgaagggttaggaagtagtaacgaaaaaggtaacttaggtacggactagacccgtaacctattaccgtacgttccttcgtaccg

SEQ ID NO: 127321 - DNA, 636 bp, Homo sapiens
  misc_feature: GYAE6OF01BD7L7.49.64.F09.1.454.CMB.1.raw
  modified_base (499)..(499): a, c, t, g, unknown or other
  misc_feature (499)..(499): n is a, c, g, or t
tcagagtcgagagacacgaccggtgctcgatttagcgcgtatacaaggggtaggttcggaggtactcagtcaggtacgaccagcgaactggacgaatccgagggtccccgctcagtctccttcggggcctcctgcctactcgtcggcctccgaggtgccagtagtgtagacgatccagatgacccagtccgtccactccgccctgtttcctgggcatctcgtacggagaccagagtcgacccagttccaagttttggcccggggtacgaaacggtacctaaggtacgttagtttaagccaaacgtatttaaaagttgggtacttcgacgacgacttacccccggggaaagggcccccttaacggttacctgtactttcgtactcgttacctgggccaggtccgaaattttcgacgaaacgtggggttccccagtccgaacggttcgaggtggcgagttggtatctggacacgaattcactctcaccatcagcagttctnctaacttgaagtatttaggaatactattgtacaactaggacgttacggaactttggacgtcgactttacgggcggacggtaccaaagggtgaggtagtacgaaagactacgtggctggctacatctcgtcttctacg

SEQ ID NO: 127322 - DNA, 498 bp, Homo sapiens
  misc_feature: GYAE6OF01CKP4D.49.64.F09.1.454.CMB.1.raw
  modified_base (342)..(342): a, c, t, g, unknown or other
  misc_feature (342)..(342): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaaagtcagagtattagcaactatttaaattggtatcagcataccccggggaaggcccctaagttactgatctatgctgcagccaatttgcaaaagtggggtcccatcaaggttcagtggcagtgganctgggacagaattcactctcaccatcagcagtctgcaacctgaaagatttttggaaaagtactattgtcaacagaagttacggaaacttgactcattttcggcggagggaccaagggtgagaatcaaaaagactgtggctgcacatntgtctntac

SEQ ID NO: 127323 - DNA, 502 bp, Homo sapiens
  misc_feature: GYAE6OF01EGQKC.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagtactgatctatgctgcagccaatttgcaaagtgggtccatcaaggttcagtgcagtgatctggacagaattcactctcaccatcagcagtctgcaactgaagtatttaggaaatactattgtacaacagtagttacgaacttgctctattttcggcggtagggaccgaaggtaggagaagtacgaaaagtaacgtaggtggactgactaccactactcgtcttctacg

SEQ ID NO: 127324 - DNA, 519 bp, Homo sapiens
  misc_feature: GYAE6OF01AOZVV.49.64.F09.1.454.CMB.1.raw
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagttactgatctatgctgcagccaatttgcaaagtgggtcccatcaaggttcagtggcagtgatctggacagaattcactctcacatcagcagtctgcaacctgaagtattttaggaaattactattgtacaacagtaagtttaaccggaaacttgacttacgtagttttcggacggtagggaccgtaagggtggaagagtacgaaaagacttaggtcggctagcaaccgtatccgtgtccttctacg

SEQ ID NO: 127325 - DNA, 576 bp, Homo sapiens
  misc_feature: GYAE6OF01EPNIZ.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaatttgcaaagtgggtcccatcaaggttcagtggcagtggatcgtgggacagaattcactctcacatcagcagtctgcaactgaagtattttaggaaagttactattgtacaactagtaagttaacggaaactttcggacttacgttaagttttcgggaccgggtaagggtacccgaaaggggttacggaagtaaagttaaccgaaaaaaggtaaccgttagggtacgggaccgttaggacccgtaaaccctattaccgttcgtttacgttccgtaaccg

SEQ ID NO: 127326 - DNA, 531 bp, Homo sapiens
  misc_feature: GYAE6OF01CLW72.49.64.F09.1.454.CMB.1.raw
  modified_base (379)..(379): a, c, t, g, unknown or other
  misc_feature (379)..(379): n is a, c, g, or t
  modified_base (439)..(439): a, c, t, g, unknown or other
  misc_feature (439)..(439): n is a, c, g, or t
  modified_base (516)..(516): a, c, t, g, unknown or other
  misc_feature (516)..(516): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgttgacatccagtatgacccagtctccatccgccctgtctgcatctggtaggagacagagtcaccgatcatttgccgggcaagtcagagtattagcaactatttaaattggtatcagcagtaccccggggaagcccctaagttactgactctaatgctgacagccaatttgacaaagtgggtccatcaaggttcagtgcagtgatcgtggacagaattcactctacaccatcagcagtcngcaacctagaagtatttaggaaatactattgtacaacaagagttaacggaacttgacttntagttttcggacgggtaggtaaccgaaggtagaagtagtaacgaaaaggactaggtcggactagacctacctacttnttcgtcgttctaccg

SEQ ID NO: 127327 - DNA, 489 bp, Homo sapiens
  misc_feature: GYAE6OF01BV42R.49.64.F09.1.454.CMB.1.raw
  modified_base (486)..(486): a, c, t, g, unknown or other
  misc_feature (486)..(486): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtccatcaaggttcagtgcagtgatctgggacagaattcactctcaccatcagcagtctgcaacctgaagattttggaaatactattgtacaacagaagttacggaaacttgactctattttcggcggtagggaccaaggtggagatacgaaagactggtggctgcacatctgtctntac

SEQ ID NO: 127328 - DNA, 589 bp, Homo sapiens
  misc_feature: GYAE6OF01B5ZNZ.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcataccccggggaagcccctaagttactgatctatgctgcagccaatttgacaaaggtcgggtcccatcaaggttcagtggcagtggatcgtggacagtatcactctacacatcagcagtctgaccaactgtaaagtacgttttaggaaagttacttaattacgtacaacgtaagtaacggttaaccggtaaactttggtaccttacgtaagtttttcggggacgggtacgggtaaccgtaaaggggtcggaaaggtaagtaacgaaaaacggtaagtacggttacgggacgttacgacctaaccgtagttaccttacggttccttacttaacccg

SEQ ID NO: 127329 - DNA, 501 bp, Homo sapiens
  misc_feature: GYAE6OF01AZMGY.49.64.F09.1.454.CMB.1.raw
  modified_base (325)..(325): a, c, t, g, unknown or other
  misc_feature (325)..(325): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaagccctaagttactgatctatgctgcagccaatttgcaaagtgggtccatcaagttcagtgnagtgatctggacagaattcatctacacatcagcagtctgacaacctgaagtattttaggaaagttactaattgtacaacagtaagttaacggaacttgacttactattttcggacggtagggaccaaggtggagaattacgaaaagtatggtggactgactacatctgtcttctac

SEQ ID NO: 127330 - DNA, 512 bp, Homo sapiens
  misc_feature: GYAE6OF01BSUTG.49.64.F09.1.454.CMB.1.raw
  modified_base (141)..(141): a, c, t, g, unknown or other
  misc_feature (141)..(141): n is a, c, g, or t
  modified_base (500)..(500): a, c, t, g, unknown or other
  misc_feature (500)..(500): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgaaaaaccngatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtcccatcaaggttcagtggcagtggatctggacagaattcactctcaccatcagcagtctgacaacctagaagtatttaggaaagttactattgtacaacagtagttaacggaacttgacttactagttttcggacggtaggaccgaaggtggagatacgaaaagtactaggtgctgactacatntcgtcttcgtac

SEQ ID NO: 127331 - DNA, 491 bp, Homo sapiens
  misc_feature: GYAE6OF01E3MSM.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtccatcaagttcagtgcagtgatctgggacagaattcactctcaccatcagcagtctgcaacctgaagattttaggaaagtactattgtacaacagagttacggaaacttgactcattttcggacggtaggaccaaggtgagatacgaaaagactaggtgctgacaccatatgtcttgtac

SEQ ID NO: 127332 - DNA, 494 bp, Homo sapiens
  misc_feature: GYAE6OF01BBHJI.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagttactgatctatgctgcagccaatttgcaaagtgggtcccatcaaggttcagtggcagtggatctgggacagaattcactctcaccatcagcagtctgcaacctgaagtattttaggaaagttactattgtacaacagaagttaacggaaacttgctactagtttcggcggagggaccgaaggtgagatacgaaagatgtgctgcacatctgtcttctac

SEQ ID NO: 127333 - DNA, 559 bp, Homo sapiens
  misc_feature: GYAE6OF01B2WY9.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcatacccggggaagcccctaagttactgatctatgctgcagccaatttgacaaagtcgggtaccagtcaaggttcagtggcagtggatcgtagggacagtaatcactctcacatcagcagtctagacaaccgtgaagtattttaggaaattatattagtactaagtagtacgttaacgtaacttagacgttactagttttacgggacggtacgggtaaccgaagggtacggtagtaaacgtaacgaaaagtaagttaggtacggactacgaccgtaccgtagtaccttcggttcttccgtaacccg

SEQ ID NO: 127334 - DNA, 510 bp, Homo sapiens
  misc_feature: GYAE6OF01CWVWO.49.64.F09.1.454.CMB.1.raw
  modified_base (432)..(432): a, c, t, g, unknown or other
  misc_feature (432)..(432): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagttactgatctatgctgcagccaatttgcaaagtggggtcccatcaaggttcagtggcagtggatctggacagaattcactctcacatcagcagtctgcaactgaagtattttaggaaagttactaattagtcaacagtaagttaacgaaacttgactntacgttttcggacgggaggacctaaaggtggaagatacgaaaaagaactgtggactgactaccattctgtcttgtaac

SEQ ID NO: 127335 - DNA, 493 bp, Homo sapiens
  misc_feature: GYAE6OF01BGAPG.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaaggcccctaagttactgatctatgctgcagccaatttgcaaagtgggtcccatcaaggttcagtgcagtgatcgtggacagaattcactctcaccatcagcagtctgcaactgaatatttaggaaagttactattgtacaacagagttacgaacttgacttctattttcggcggtaggaccgaaggtgagatacgaaaagactgtggctgacaccatctgtcttgtacc

SEQ ID NO: 127336 - DNA, 565 bp, Homo sapiens
  misc_feature: GYAE6OF01ARNL3.49.64.F09.1.454.CMB.1.raw
  modified_base (406)..(406): a, c, t, g, unknown or other
  misc_feature (406)..(406): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccggggaagcccctaagttactgatctatgctgcagccaatttgcaaagtgggtcccatcaaggttcagtgcagtgatctgggacagaattcactctcaccatcagcagtctgcaacctgaagattttaggaaattactattgtacaanagtagttaacggaaacttgacttactagttttccgggacgggtagggaacccgtaaaggggtcgggaaagtaacgtacgaaaaaacggtaacgttaggtcgggaccgttaggacccgtaaacccgtacttacccgttaggttccctttaccgtaacccg

SEQ ID NO: 127337 - DNA, 498 bp, Homo sapiens
  misc_feature: GYAE6OF01EQZF4.49.64.F09.1.454.CMB.1.raw
  modified_base (492)..(492): a, c, t, g, unknown or other
  misc_feature (492)..(492): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaaggcccctaagttactgatttatgctgcagccaatttgcaaagtgggtcccatcaaggttcagtggcagtgatctggacagattcactctcacatcagcagtctgacaacctgaagtatttaggaaagttactattgtacaactagtagttacggaattgctctatttcggacggagggaccaagggtgagatacgaaagtactgtaggctgacactatctatcttcnttcccg

SEQ ID NO: 127338 - DNA, 504 bp, Homo sapiens
  misc_feature: GYAE6OF01AUJ3D.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaatttgcaaagtgggtcccatcaaggttcagtggcagtgatctggacagaattcactctcaccatcagcagtctgcaacctgaagattttaggaaatactattgtcaacagtaagttacggaaacttggactcattttcggcggtacggaccgtaaggtggaagattacgaaaagtaactggtcggctgcacctatctgtcttcgtac

SEQ ID NO: 127339 - DNA, 548 bp, Homo sapiens
  misc_feature: GYAE6OF01A09YM.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagttactgatctatgctgcagccaatttgcaaagtgggtccatcaaggttcagtgcagtgatcgtggacagaattcactctcaccatcagcagtctacgacaacctagaagtagttttaggaaagttacttattgtactaactagtaagttaacggtaaacttcgacttacgtagttttacgggacgggtacgggaccgtaagggtggaacgaagtaacgaaaaggtaacgtggtaggactaggacctaaccgacttaccgtgttccttcgtaccg

SEQ ID NO: 127340 - DNA, 741 bp, Homo sapiens
  misc_feature: GYAE6OF01BL8EQ.49.64.F09.1.454.CMB.1.raw
tcagagtcgagagacacgaccggtgctcgatttagcgcgtatacaagggggtaggttcgagtctcagtcaggacacagcatggacatgagggtccccgctcagctcctggggctcctgctactctggcgtccgaggtgccacgatgtgacatccagatgacccacgtctccactccgccctcgtctgcatctgtaggagacagagtcaccatcattgccggcaagtcagaggtattaagactaaacttaattttaaattaggttatacgagacaacgtacccggggaaggacccctaacgttacgtgtatctatgcgtgcagcctaatttgacgaaaggttcggggtaccccaattacgtaacggttacgaggtcggacgtaggtacggtacgtccggtaggggaacctaagtaattaccgtactccgtacacctaatacagtccagtacctacgacgtaaccttaggtaacgtagttttaacggtaaacgtactttaagttacgtaacgtaaacgtaacgtaacggtttaacccgggtaaaccgtttagtacccgtttacgttaaccggtttttccggggaaccggggtaacgggtaacccggtaaacgggggtaggttaaacgggtaaacgttaaccggtaaaaaacggttaccggtacgggttacgggtaccggttaccggtaacccgtaaaccccgttacgttaaccggtttcgtttacccgttacgttaaccccgg

SEQ ID NO: 127341 - DNA, 492 bp, Homo sapiens
  misc_feature: GYAE6OF01DHS3G.49.64.F09.1.454.CMB.1.raw
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagtactgatctatgctgcagccaatttgcaaagtgggtacccatcaagttcagtggcagtggatctggacagaattcactctcaccatcagcagtctgcaacctgaagtattttggaaagttactattgtacaacagtagttaacgaacttgactctattttcggcggagggtacaaggtgagatacgaaaagactgtgctgacaccatctntcttntac

SEQ ID NO: 127342 - DNA, 535 bp, Homo sapiens
  misc_feature: GYAE6OF01CIJ2A.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtatgcatctgtaggagacagagtcaccatcatttgccggcaagtcagagtattagcaactatttaaattggtatcagcataccccggggaagcccctaagttactgatctatgctgcagccaatttgacaaagtgggtcccatcaaggttcagtggcagtgatctggacagaattcactctcacatcagcagtctgacaacctgaagtattttaggaaagttactattgtacaacagtagttaacggaaacttgacttcgtattttacgggacggagggaaccgtaagggtaggagaagtaacgaaaaaggaacgttggtacggcttacgacctaaccgtattcttacgttcttctaaccg

SEQ ID NO: 127343 - DNA, 560 bp, Homo sapiens
  misc_feature: GYAE6OF01BQ8QD.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaagcccctaagtactgatctatgctgcagccaatttgacaaaggtcgggtacccatcaaggttcagtgcagtggatcgtggacagaattcactctcaccatcagcagtctagcaactgaagtatttaggaaagtctattcgacaagaacgtagttaaacggtaaacttcggacttacgtaagttttcggacgggtaacggaccgtaagggtggtaaggtaattaaaccgaaaaaggtacttagggtacggaccttaggacctaaccgtaatttccgtggttaccctttcttaaacccg

SEQ ID NO: 127344 - DNA, 540 bp, Homo sapiens
  misc_feature: GYAE6OF01DNKAB.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaaggcccctaagttactgatctatgctgcagccaatttgacaaaggtcgggtcccagtcaaggttcagtggcagtggatcgtggacagtaatcactctcaccatcagctagtctgacaactgaagtagtttagaaagtactattgtacaatagtaagttaacgaacttgacttacgtattttcgggacggtacgggaaccgtaagggtagggaagaagtaacgaaaaacgtaagttggtaggtacgtgacctaacctatccttgttcttcttacccg

SEQ ID NO: 127345 - DNA, 494 bp, Homo sapiens
  misc_feature: GYAE6OF01A5RJA.49.64.F09.1.454.CMB.1.raw
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaaggcccctaagttactgatctatgctgcagccaatttgcaaagtggggtccatcaaggttcagtgcagtggatctggacagaattcactctcaccatcagcagtctgcaacctgaagattttaggaaagtactattagtacaacagtaagttacgaaacttgacttctattttcggcggaggaccgaaggtgganagtacaaaagatgtggntgctaccatctntctntac

SEQ ID NO: 127346 - DNA, 615 bp, Homo sapiens
  misc_feature: GYAE6OF01DDYJ8.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagctaactatttaaattggtatcagcacgtaccccggggaagcccctaagttactgatctatgctgcagcctaatttgacgaaaggtcggggtacccagttcgaaggtttcaaggtggcaggttggatcgtgggacagtaattcactctacaccatcagcagtctgacaactgaagtagttttaggaaatacttattacgtacaagtagtaaggtttaaccggaaacttggtacctttacgtaacggtttttccggggacgggtaacggggaaaccgtaaaggggtagggaaaggtaaactaaacggtaaaaacggtaacgttacgggtcgggaccttacgggaaccctacccgtaagtttaccgttacggttcccttacgtacccg

SEQ ID NO: 127347 - DNA, 571 bp, Homo sapiens
  misc_feature: GYAE6OF01EAGHX.49.64.F09.1.454.CMB.1.raw
  modified_base (341)..(341): a, c, t, g, unknown or other
  misc_feature (341)..(341): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcatacccgggaagcccctaagttactgatctatgctgcagcctaatttgacaaagtgggtaccatcaaggttcagtggcaggtggatcgnggacagaattcactctcacatcagcagtctgcaactgaagtattttagggaaattacttattagtactaacgtagtaacggttaacggaacttcgacttacgttaagttttccgggacgggtaacgggaccgtaagggtacgggaagtaacgtaacgaaaaaggtaccgttggtacgggtaccttaggaccctaaaccgtattacccgttcggtttccttaccgtaaccg

SEQ ID NO: 127348 - DNA, 500 bp, Homo sapiens
  misc_feature: GYAE6OF01DKKFI.49.64.F09.1.454.CMB.1.raw
  modified_base (401)..(401): a, c, t, g, unknown or other
  misc_feature (401)..(401): n is a, c, g, or t
  modified_base (488)..(488): a, c, t, g, unknown or other
  misc_feature (488)..(488): n is a, c, g, or t
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaatggtatcagcatacccgggaagccctaagttactgatctatgctgcagccaatttgcaaagtgggtccatcaaggttcagtggcagtgatctgggacagaattcactctcaccatcagcagtctgcaacctgaagattttggaaagtactattagtcaanagagttaacggaaacttggactcattttcggacggtagggaccaagggtcggagagtacgaaaagaacttgtcggactgccaccatntcgttctcgtac

SEQ ID NO: 127349 - DNA, 486 bp, Homo sapiens
  misc_feature: GYAE6OF01A4D4D.49.64.F09.1.454.CMB.1.raw
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtccatcaaggttcagtgcagtgatctggacagattcactctacaccatcagcagtctgacaacctgaacgtatttaggaaatctattgtacaacagagttacgaattgctctagtttcggcggtaggaccaggtgagatacgaaaagtactgngctgacacntctntcttctac

SEQ ID NO: 127350 - DNA, 553 bp, Homo sapiens
  misc_feature: GYAE6OF01B24HT.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagtactgatctatgctgcagccaattgacaaagtgggtcccatcaaggttcagtgcagtggatcgtggacagaattcactctcaccatcagcagtctgacaacctgaaacgtattttaggaaacgttacttattgtactaacagtacgttaacggaaactttgacttcgtagttttccgggacgggtaagggtaacccgaagggtcggaagtaagtaaccgaaaaaggtaacgtggttacggccttagacctaacccattacttcggttccttcgtaaccg

SEQ ID NO: 127351 - DNA, 505 bp, Homo sapiens
  misc_feature: GYAE6OF01CJ875.49.64.F09.1.454.CMB.1.raw
  modified_base (494)..(494): a, c, t, g, unknown or other
  misc_feature (494)..(494): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtccatcaaggttcagtggcagtggatctggacagaattcactctcaccatcagcagtctgcaacctgaagtatttaggaaagtactattagtacaacagtagttacgaacttcgcttctagttttcggacgggtaggaacctaggtggagagtacgaaaagactaggtcggactggctaccatntcgtcttctac

SEQ ID NO: 127352 - DNA, 604 bp, Homo sapiens
  misc_feature: GYAE6OF01DMII4.49.64.F09.1.454.CMB.1.raw
  modified_base (394)..(394): a, c, t, g, unknown or other
  misc_feature (394)..(394): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagacaactatttaaattggtatcagcagtaccccggggaagcccctaagttactgatctatgctgcagtccaatttgacgaaaggtcggggtacccatacaaggtttcaagtcggacaggtggatcgtaggacagtaattcactcctacaccatcagctagtctanactaacctagaaacgttagttttaaggaaacgttacttaattacggtactaaacaggttaaggttaacggtaactttagactttcgtaggttttccgggaacgggtaacgggtaccgtaaaggggttggaaacgtaacgtaacgtaaaaaaggtaccttagggtacggtacgtcgaacgtacctacgttactttcgtctttacctacccg

SEQ ID NO: 127353 - DNA, 543 bp, Homo sapiens
  misc_feature: GYAE6OF01BM5W3.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagcctaatttgacaaaggtgggtaccccatcgaaggttcagtggcagtggatcgtgggacagaattcactctcaccatcagcagtctgacaacgtgaagtagttttaggaaacgttatattgactaacgagtaagttaacggaaactttgacttacgtacgttttcgggacggtacgggaccgtaagggtcggaagtataacgaaaaggtaactggtcggcgtagacctacctacttactgttcttcgtac

SEQ ID NO: 127354 - DNA, 677 bp, Homo sapiens
  misc_feature: GYAE6OF01CRA86.49.64.F09.1.454.CMB.1.raw
tcagagtcgagagacacgaccggtgctcgatttagcgcgtatacaagggggagtcagtctcagtcaggacacagcatggacatgagggtccccgctcagctcctgggctcctgctactctggctccgaggtgccagatgtgacatccagatgacccagtctccatccgccctgtctgcatctgtaggagacagagtcaccatcatttggccggcaagtcagagtatagctaactatttaaattggtatcagcacgtaacccggggaagcccctaagtactgatctatgctgcagactaatttgacgaaaggtcgggtaccctagtacgtaaggttcaaggtggtacgtagtaggtagtcggtagggaactaggtaacttacactcctactaaccattaccgagacgtacgtcgtagtacctaaaccgtaaggtaaagttaacgttttaagggaaaactttacttaagtttacgtaactaaacgtaaaggtaacggtttaaacggtaaacgtttacgtaccgttaacgttaacgttttacggggaacgggttaaccggggaaaccggtaagggtagggtaaacgtaaacgtaaacggtaaaaacggtaacgttagggttaacggtaccgtacggtacctaaccgtacttacgttacgtttcccgttaccgttaacccg

SEQ ID NO: 127355 - DNA, 503 bp, Homo sapiens
  misc_feature: GYAE6OF01ETC3O.49.64.F09.1.454.CMB.1.raw
  modified_base (436)..(436): a, c, t, g, unknown or other
  misc_feature (436)..(436): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagcctaatttgactaaagtggggtaccccatcaaggttcagtggcagtggatcgtggacagattcactctcaccatcagcagtctgacaacctgaagtattttaggaaagttactattgtacaacagagttaacgaattgactntagtttcggcggaggaccgaaggtggagatacgaaaagtatggtggctgactaccatntgtctntac

SEQ ID NO: 127356 - DNA, 580 bp, Homo sapiens
  misc_feature: GYAE6OF01EAK56.49.64.F09.1.454.CMB.1.raw
tcagagtcgagagacacgaccggtgctcgatttagcgcgtatacaagggggagtcagtctcagtcaggacacagcatggacatgaaggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtggggtcccatcaaggttcagtggcagtggatctggacagaattcactctcacatcagcagtctgcaacctgaatagttttaggaaagttactattgtacaacaagtagttaacggtaacttgcttactaacgttttcgggacggtaacggggaccgtaaaggggtacggtaaggtaacgttaaccgtaaaaaaggtaaacctttagggtacgggtaccgtaaggacccgtaaacccgtaacgtttccgttacggtttctttcccgttaacccg

SEQ ID NO: 127357 - DNA, 563 bp, Homo sapiens
  misc_feature: GYAE6OF01CE2UH.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagcctaatttgacaaagtgggtcccatcaaggttcagtggcagtggatcgtggacagaattcactctcaccatcagcagtctgacaacctgaagtattttaggaaattactattgtacaactaagtagttaacggaaacttgaccttacgtacgttttcgggacggtagggtaaccgtaagggtggaagaagtaacgaaaaaggtaacttagggtacgggtacgttacggacctaaccgtacttaccgttacggttcctttacgtaacccg

SEQ ID NO: 127358 - DNA, 637 bp, Homo sapiens
  misc_feature: GYAE6OF01D4Y02.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcacgtacccggggaagcccctaagttactgatctatgctgcagcctaatttgacaaagtcgggtaccatcaaggttcaggtgcagtggatcgtgggacagaattcactctacaccatcagctagtctgactaaccgtagtaagtagttttaaggaaattacttattacgtacaaacgtaagtaaggttaaccggtaaactttcgaccttacgttaacggtttttacgggaccggggtaacggggtaacccgtaaaggggttacgggtaaaggtaaacgtaaccggtaaaaaacggttaacggttacgggttacgggtaccgttacggtaacccgtaacccgttaacgtttacccgtttacggtttcccgtttacgttaacccccg

SEQ ID NO: 127359 - DNA, 543 bp, Homo sapiens
  misc_feature: GYAE6OF01AUYE0.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaatggtatcagcatacccggggaagcccctaagtactgatctatgctgcagccaatttgacaaagtgggtcccatcaaggttcagtgcagtgatcgtgggacagaattcactctacacatcagcagtctgacaacctagaagtagttttaggaaagttacttattgtactaacaggtaagttaacggtaaacttgacttactagttttcgggacggtaacgggaccgtaaggtaggtaagaagtaacgaaaaggtacgtaggtcgggactagaccgtaacctagttacctcgttcttctaccg

SEQ ID NO: 127360 - DNA, 585 bp, Homo sapiens
  misc_feature: GYAE6OF01DWMSI.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagacaactatttaaattggtatcagcatacccgggaaggccctaagtactgatctatgctgcagcctaatttgactaaaggtcgggtaccagtacaaggttcaagtgcaaggtgatcgtgggacagaattcacttctacaccatacagctagtctacgcgaacctagaacgttagttttaggaaacgtttactatttagtacgtaactaggtaacggtttaaccggtaaactttaggtaccttacttaacggttttcgggaccgggacgggtaaccgtaagggtacggaaagtagttaacgaaaaaggttacgtaggtggacgtagaccaccctaattccttaggttccttcgtaccg

SEQ ID NO: 127361 - DNA, 681 bp, Homo sapiens
  misc_feature: GYAE6OF01CYJK4.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatccgccctgtctgcatctgtaggagacagagtcacctatctatttcggccgggacaagtcagagtattagactaaacttatttaaattggtaatcagacaacgtaccccggggaagtacccctaagttactgatctatgctgcagacctaatttgactaaaggtcgggtaccatacgaaggttcaggtggacagtggatcgagggacagtaacttcactccacaccatacagcagtctagacctaacgtagtaagttatttaagggaaactttactagtttacgtaacgtaaactaagggttaacgttaaaccgtaaactttcgggtaccttacgttaaggttttacccgggggaacgggtaacggggtaacccgtaaagggggttaacggtaacggttaaacgttaaaccggaaaaacgggttaaccgtttggggtaccgggttaccgtaacgggtacccttaaaccccggttatttacccggtttcgttacccgttttacccgttaaccccgg

SEQ ID NO: 127362 - DNA, 597 bp, Homo sapiens
  misc_feature: GYAE6OF01ALAQV.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcacgtaccccggggaagcccctaagttactgatctatgctgcagcctaatttgactaaaggtcggggtaccctagtacgaagggttccaaggtcggacgtaggtggagtcgtagggaactagtaacttcgactctacaccatcagcagtctgacaacctagaagttatttaggaaattacttattacgtacaacgtagtaacggttaacgtaacttgacttacgttacgttttccgggacggtacgggtaaccgtaagggtacggaacgtaagtaacggaaaaagtacgttagggtcggaccgttacgacctaaccgtattacgttcgttccgttcttaacccg

SEQ ID NO: 127363 - DNA, 585 bp, Homo sapiens
  misc_feature: GYAE6OF01EK1K0.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcatacccggggaagcccctaagtactgatctatgctgcagccaatttgcaaagtgggtccatcaaggttcagtggcagtggatcgtggacagattcactctcaccatcagcagtctgacaactgaacgtatttaggaaagttacttagttacgtactaaactagtaagtttaacggtaaactttgaccttacgttacgtttttaccggggacgggtaacggggtaacccgtaaaggggtagggtaaacgtaagtaaccgaaaaaacggtaacgttaggtacggaccttaggaaccctacccgtaattaccgtttacgttcctttacgtaacccg

SEQ ID NO: 127364 - DNA, 760 bp, Homo sapiens
  misc_feature: GYAE6OF01DAMPD.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatcatttggccggcaagtcagagtattagactaacttatttaaattggtatcagcacgtacccgggggaagcccctaagttactgatctatgctgcagcctaatttgacaaaggtcgggtacccctagtacgtaacgggtttccagggttaggacgtaggtacgggtaagttcgggtaggggaacctaacggtaaactttacccgaactttaccccgttaccaacccgtaacttaccgaacggtcccgtaaagggtttccccttaacgggaaccccttaaaacccggttagggtaaaaacggtttaaggttttttaacgggtaaaaaacgtttaaccgttttaagtttaacggtaacccgtaaaaccggtaagggttaaacgggttttaaacccgggtaaaacgttttccggtaaccgtttaacgtttaacggtttttacccggggaccggggtaaagggggtaacccgtaaagggggttacggaaacggtaaattaacggaaaaaagtaccggttaggtcgtacgtacgactaccgtatcgtacgttcctacgtacc

SEQ ID NO: 127365 - DNA, 496 bp, Homo sapiens
  misc_feature: GYAE6OF01AK2S8.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccggggaaggccccctaagttactgatctatgctgcagccaatttgcaaagtgggtcccatcaaggttcagtggcagtggatctgggacagaattcactctcaccatcagcagtctgcaacctgaagattttggaaagtactattgtcaacagagttacggaaacttgacttcagttttcggcggtagggacgaaggtggagatacgaaagacgtgtggctgcaccatctgtcttctac

SEQ ID NO: 127366 - DNA, 537 bp, Homo sapiens
  misc_feature: GYAE6OF01BSI57.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtcccatcaaggttcagtggcagtggatcgtggacagaattcactctcaccatcagcagtctagcaacctgaacgtattttaggaaagtacttaattgtacaactagtagttaacggtaaacttgacttactacgttttcgggacggtagggacctaagggtaggagtaagtaacgaaaaggtaactaggtcggactgaccgtactagtcctcgttccttctaccg

SEQ ID NO: 127367 - DNA, 638 bp, Homo sapiens
  misc_feature: GYAE6OF01CG02G.49.64.F09.1.454.CMB.1.raw
  modified_base (215)..(215): a, c, t, g, unknown or other
  misc_feature (215)..(215): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggnaagtcagagtattagcaacttatttaaattggtatcagcagtaccccggggaaggcccctaagttactgatctatgctgcagacctaatttgacgaaaggtcggggtacccagtacgaaggttcaggtggcaggtgagtcgtaggactagtaacttcacgtctacacctatcagctagtctacgacctaaccgtaggtaaacgtagttttaacgggaaagttaccttaagttacgttaacgaacgtaaggtaacggtttaaccggtaaactttcggacttacgttagttttaccggggacgggtaacgggtaaccgtaaggggtaggaacggtaaacgttaaccggtaaaaacggtacgttacgggtcggtaccgttacggaccctaacccgttacgtacgtttcgttccttacgttaacccg

SEQ ID NO: 127368 - DNA, 554 bp, Homo sapiens
  misc_feature: GYAE6OF01DWVOH.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagcctaatttgactaaaggtcggggtcccatcgaaggttcaggtggcaggtggatcgtgggacagtaatcactctcacatcagcagtctgacaacctgaagtagttttaggaaagttacttattagtacaactaagtaacgttaacggtaaacttgacttacgtaacgttttcgggacgggtacgggaaccgtaagggtaggaagtaatacgaaaaagtacgttaggtggactgacctacctattacgtcgtcgttctaccg

SEQ ID NO: 127369 - DNA, 787 bp, Homo sapiens
  misc_feature: GYAE6OF01CP4V0.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagttactgatctatgctgcagcctaatttgacgtaaaaggtcggggtaccccaagttcgaaaggtttccgaaggttgggccaaggttgggaattccgtaggggaaccagtaaactttccgaaccttaccgtaccaaccctaagttcccgaacggtacctaacggttacccttacggtaccctaaaaccccgttaaggtaaaacggttaacgtttttaacgggtaaaaacgtttaaccgtttaacgtttaacggtttacctaaaaccgttaagggtaacggttttaaaccgggaaaaccgttttacggtacctttaccggttaacgttttttacccgggggaaccggggttaacgggggtaaaccccggtaaaagggggttacggggtaaacggtaaacgttaaaccggtaaaaaaacggtaaccggttaacggggttacgggtacccgttacgggtaacccgtaaccccgtaaacgtttaccgtttacggttacccgttttccgttaaaccccgg

SEQ ID NO: 127370 - DNA, 525 bp, Homo sapiens
  misc_feature: GYAE6OF01C12OL.49.64.F09.1.454.CMB.1.raw
  modified_base (289)..(289): a, c, t, g, unknown or other
  misc_feature (289)..(289): n is a, c, g, or t
  modified_base (347)..(347): a, c, t, g, unknown or other
  misc_feature (347)..(347): n is a, c, g, or t
  modified_base (520)..(520): a, c, t, g, unknown or other
  misc_feature (520)..(520): n is a, c, g, or t
tcagagtcgagagacacgaccggtgctcgatttagcgcgtatacaagggggagtcagtcgtcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctangctgcagccaatttgcaaaggtggggtacccatcaaggttcaagtggcagtggatcgngggacagtaatcatctcaccatcagcagtctgccaactagaagtatttaggaaagttactatttagtacaatagtagttaacggaaacttgtacttctagttttcggacgggtagggacctaagggtgagtatacgaaaagtactaggtcggctggctacgattctgttcttntaccg

SEQ ID NO: 127371 - DNA, 534 bp, Homo sapiens
  misc_feature: GYAE6OF01A74VQ.49.64.F09.1.454.CMB.1.raw
  modified_base (337)..(337): a, c, t, g, unknown or other
  misc_feature (337)..(337): n is a, c, g, or t
  modified_base (362)..(362): a, c, t, g, unknown or other
  misc_feature (362)..(362): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagttactgatctatgctgcagccaatttgcaaagtgggtccatcaaggttcagtgcagtgatcgngggacagaattcactctcacatcancagtctgactaaccgtgaacgtattttaggaaagttactagttgtacaactaggtaagttaacggaaactttgacttacgtagttttcggacggtagggacctaagggtgaagaagtacgaaaacggtaatggtaggactagacctacctattacgttcgttcttactaccg

SEQ ID NO: 127372 - DNA, 736 bp, Homo sapiens
  misc_feature: GYAE6OF01ALP4I.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatcatttgccgggcaagtcagagtattagcaacttatttaattggtatcagcacgtacccggggaagcccctaagttactgatctatgctgcagcctaatttcgacgtaaaggttcggggtacccctaagttaccgtaaacgggtttacgaagggttacgggaccgtaagggttgggtaacgttccggttaggggggtaaaccctaaagggttaaacttttcccgaaaccgtttacccgttacccgtaaacccgtacgttacccgaacggtaccctaagtttccccttacggtaaccctaaacccgttagggtaaaacggttaacgttttttaacgggaaaagttttaaccgttaagtttaccggtaactaaaccggtaaggttaacgtttaaaccggttaaacgttcgtaccttaacgtttacggttttaccggggacggggaacggtaaccgtaagggtacggaagtaacgtaacgaaaaggtacctaggtcgacgtagacctaaccgtatccgttcgtaccttcgtaaccg

SEQ ID NO: 127373 - DNA, 602 bp, Homo sapiens
  misc_feature: GYAE6OF01A19F6.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaattggtatcagcagtaccccgggaagcccctaagttactgatctatgctgcagcctaatttgactaaaggtcgggtcccatcgaaggttcagtggcagtggatcgtaggacagtaattcactctacaccatcagcagtctcgactaacgtagtaagtagttttaaggaaagttacttaagttcgaactaacgtaagtaacgttaacgggtaaactttggacctttacgtacgttttacgggacgggtacgggtaaccgtaagggtacggtaagtaacgttaacgaaaaaggtaccggttagggttcgggtaccgtacggtacccgtaaccgtactacgttacgtttccgtttacgttaacccg

SEQ ID NO: 127374 - DNA, 626 bp, Homo sapiens
  misc_feature: GYAE6OF01D7BBO.49.64.F09.1.454.CMB.1.raw
  modified_base (218)..(218): a, c, t, g, unknown or other
  misc_feature (218)..(218): n is a, c, g, or t
tcagagtcgagagacacgaccggtgctcgatttagcgcgtatacaagggggagtcgagtctcagtcaggacacagcatggacatgagggtccccgctcagctcctggggcctcctgctactctggctccgaggtgccagatgtgacatccagatgacccagtctccatcccgccctgtctgcatctgtaggagacagagtcaccatcatttgccgggnaagtcagagtatagacaacttattaaatggtatcagcacgtacccggggagaccctaagttactgatctatgctgcagcctaatttgacgtaaaggtcgggtcctatcgtaaaggttcagtggcaggtgatgtgggacagtattcactctaccactatcagtccgtagtctagactaacgttggtaaagttaacgttttaggaaaagttactttaacgttacgtaaccgtaacgtaacggttaacggttaaacgttaacgttcggtacttacgttaacgttttcggggaacgggtacgggaaccgtaaggggtaggaaccgtaagttaaaccgaaaaggtagttacgggttaacggcttaaggaccctaaccggttattaccggtttctttacgttccgttacccccg

SEQ ID NO: 127375 - DNA, 534 bp, Homo sapiens
  misc_feature: GYAE6OF01BT5D2.49.64.F09.1.454.CMB.1.raw
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtagagacagagtcaccatcatttgccgggcaagtcagagtattagacaactatttaaattggtatcagcagtaccccgggaagcccctaagttactgatctatgctgcagcctaatttgactaaaggtcgggtaccatcgaaggttcagtggcagtgatcgtggacagaattcactctacacatcagctagtctagacaactagtaagtatttaggaatatatntacaanaagtagtaacgtaacttcgtacttcgtagtttcggacggtacgggaaccgtagggtaggagtaagtaacgtaaaacgtagtaggtcggctacggccaactacgttactcttctctacccg

SEQ ID NO: 127376 - DNA, 531 bp, Homo sapiens
  misc_feature: GYAE6OF01A3C00.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtatagcaactatttaaattggtatcagcataccccggggaagcccctaagttactgatctatgctgcagccaatttgcaaagtcgggtccatcaaggttcagtggcagtggatcgtgggacagaattcactctacaccatcagcagtctgacaaccctgtaagtattttaggaaagttacttaattgttacaactaaggtagttaacggtaaacttgactctaagttttcggcggagggtaccgtaaggtaggagaagtacgaaaagattaggtggtactagacacctactcttacgtcttctaccg

SEQ ID NO: 127377 - DNA, 579 bp, Homo sapiens
  misc_feature: GYAE6OF01AV3BU.49.64.F09.1.454.CMB.1.raw
  modified_base (324)..(324): a, c, t, g, unknown or other
  misc_feature (324)..(324): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaagcccctaagtactgatctatgctgcagccaatttgcaaagtgggtccatcagttcagtgnagtgatcgtggacagaattcactctcacatcagcagtctgacaactgaagtattttaggaaattacttaattgtacaactaaggtaacgttaacggtaaacttcgacttacgtagtttttaccgggacggtaacgggtaaccgtaaaggggtaggaaaggtaacgtaaccgtaaaaaggtaaccgttagggtacgggaccgttacggacccgtaacccgtagttacccgtttcggttccttttaccgttaacccg

SEQ ID NO: 127378 - DNA, 565 bp, Homo sapiens
  misc_feature: GYAE6OF01AN6MR.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcatacccgggaagcccctaagtactgatctatgctgcagccaatttgacaagtgggtcccatcaaggttcagtggcagtggatcgtaggactagaacttcactctacacctatcagctacgtctagactaacctagaagtagtttaggaaagttacttagttagtacaactagtaacgttaacggtaaacttacgtacgttacgtagttttcgggacgggtaacgggtacgtaagggtaggtaacgtaagtacgtaaaaacggtacgttaggtcggtacgtacgaccgtaccacgttactcgttcttcgtaccg

SEQ ID NO: 127379 - DNA, 675 bp, Homo sapiens
  misc_feature: GYAE6OF01AR47S.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgcctgtctgcatctgtaggagacagagtcaccatcatttgccgggcaagtcagagtattagcaacttatttaattggtatcagcacgtacccgggaagcccctaagttactgatctatgcctgacacgacctaagtttcgacgtaaaacgggtcgggttacccaagttaccgtaagggtttccgtaaggttcgggacgtaggtagggtacgttacggtagggaactaagtaaacgtttccaacgttcctaccacctatacatccgagtctacggactaaccgttaggtaaattagttttaacggaaacgttacttatttacggtacaaacgtaggtaaggttaacgtaacgttcgtacgttaccgttaggttttacccggggaacggtaacgggtaaccggaagggttacggtaaaggtaacgtaacgtaaaaacggtacggttacggtacgggtaccttacgaacccttacgaccgtttagttaccgttccgtttacgtacccgg

SEQ ID NO: 127380 - DNA, 534 bp, Homo sapiens
  misc_feature: GYAE6OF01BPOYB.49.64.F09.1.454.CMB.1.raw
  modified_base (367)..(367): a, c, t, g, unknown or other
  misc_feature (367)..(367): n is a, c, g, or t
tcagagtcgagagacacgaccggtgctcgatttagcgcgtatacaagggggagtcagtctcagtcaggacacagtatggacatgagggtccccgctcagctcctggggctcctgctactctggctccgaggtgccagatgtgacatccagatgacccagtctccatccgccctgtctgcatctgtaggagacagagtcaccatcatttgccgggcaaggtcagagtattagctaactatttaaattggtatcagcactacccggggaagcccctaagtactgatctatgctgcagcctaatttgactaaaggtcggggtacccatcgaaggttcagtggcaggtggatcgtgggacagattcactcncacatcagcagtctgactaacgtgaagtatttaggaagttacgtattgtacaactagtagttaacgtaaacgttgacttcgtacgttttcggacggtacgggacgaagggtgaagtatacgaaagtacgtagtacggctcgacacgtatactgttcttcgtattccc

SEQ ID NO: 127381 - DNA, 573 bp, Homo sapiens
  misc_feature: GYAE6OF01B0DHS.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaatttgacaaaggtcgggtacccatcaaaggttcaagtggcagtggatcgtgggacagaattcactctacaccatcagcagtctgacaactagaagtagttttaggtaaagttactattagtactaacgagtaagttaacggtaaacttgacttacgtagttttacgggacgggagggtaaccgaagggtacggaaggtaagtaacgtaaaaaggtaacgttagggtcggtacgtacgacctaaccgtacgttacgttacggttcctttcgtaaccg

SEQ ID NO: 127382 - DNA, 650 bp, Homo sapiens
  misc_feature: GYAE6OF01D94GI.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccactccgccctgtctgcatctgtaggagacagagtcaccatctatttcggccggacaagtcagtagttatagactaacttatttaaattggtatcagaccaacggtaaccccggggaacgtaccccttaagttactgtatctagtgctgacactacctaatttcgaacgtaaacgggttcggtacctagtacgtaaggttcgaggtggactaggtggtactacggtaggaactaggtacttaccgaccttctaccaacctactacgtacgtacgtagtccgtacgtaccgtaacgttagtaaagtttagtttaacggtaaacttacttagttacgtactaacgtagtaacggttaacgtaacgttcgtacgttacgttacggtttcgggacgggtaacggacgtaagggtacgagtaaacgtaacgtaaacgtagtaggtcggacgtacgaccgtacctacttaccgttcttaccgttcgtacccg

SEQ ID NO: 127383 - DNA, 654 bp, Homo sapiens
  misc_feature: GYAE6OF01CISEN.49.64.F09.1.454.CMB.1.raw
  modified_base (283)..(283): a, c, t, g, unknown or other
  misc_feature (283)..(283): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtatagcaactatttaaattggtatcagcagtacccggggagcccctaagttactgactntatgctgcagacctaatttgacgtaaaggtcggggtccctatacgtaaggttcaggtcggcgagtggatcgtaggacagtaacttcactcctcaacctataccgagcgtacgtctacgaccgtaaccgtaggtaagttagttttaggaaaacgttactttaacgttagtaacctaaacgtaacggttaacggtttaaccgggtaaactttcggtacctttacgttacgggttttacgggaccgggtaacggggtaaccgtaaggggttagggaaacggttaaacgtaacgaaaaacgggttacgttacgggttacgggtaccgtacggacctaacccgttagttaccgtttagttcccgtttacttacccg

SEQ ID NO: 127384 - DNA, 622 bp, Homo sapiens
  misc_feature: GYAE6OF01DUGBH.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaaactatttaaattggtatcagtcagtaaccccggggaagccccgtaaagttacctgatctatgctgcagcctaatttgacaaagtcgggtacccatcaaggttcagtggcagtgatctggacagatcactcacacatcagacagtctgacaaccgttagaagtattttagggaaaacgttattaagtttcgtaacaacgtagtaaggtttaaaccggaaacgtttacggtacttacgttaacggttttacgggacggggtaacgggtaacccgtaaaaggggttacgggaaagtaacgttaaacgtaaaaaacggtaacccgttagggtacgggtaccgtagggaccctaaaccgtaacgttcctttacggttacctttccgttaaaccg

SEQ ID NO: 127385 - DNA, 593 bp, Homo sapiens
  misc_feature: GYAE6OF01BZ5Q4.49.64.F09.1.454.CMB.1.raw
tcagagtcgagagacacgaccggtgctcgatttagcgcgtatacaagggggagtcagtctcgagtcaggtacacagcatggacatgagggtccccgctcagctcctggggctcctgctactctggctccgaggtgccagatgtgacattccagattgacccagtctccatccgaccctgtctgcatctgtaggagacagagtcaccaatctatttggccgggacaagtcagtacgtattacgctaactatttaaattggtatcagcacgtacccgggagcccctaagtctgatctatgctgcagcctaatttgacaaggtcgggtacccagtacaaggttcaggtggcaggtgagtctagggactagtaacttcacttctacacatacagctagtctgaccaaccgtagtaagttagtttacggtaaagttacttaagttgtacaacgtaagtaacgttaacggtaaacttgtaccttacttagttttacgggcgggtacgggaaccgtaagggtaggtagtaacgtaacgtaaaacggtaagtacggtaggcctaggtaccctactacttacgttcgttccgttactacccg

SEQ ID NO: 127386 - DNA, 599 bp, Homo sapiens
  misc_feature: GYAE6OF01A0AW5.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagctaactaatttaaattggtatcagcagtacccggggaagccctaagtactgatctatgctgcagcctaatttgacgtaaaggtcggggtacccagtacgtaaggttcaggtggcaggtaggatcgtaggaacagtaacttcactctacaccatcagtcagtctacgacctaaccgtagaaagttagttttaaggaaacgttacttagttacgtactaagtaaggtaacgttaacggtaaacttgacttacgttacggtttacgggacgggaacgggtaaccgtaagggtacgtaaaggtaacgtaacgaaaaggtaccgtaggtacggacgtagacctaaccgttataccgttgttccttcgtaacccg

SEQ ID NO: 127387 - DNA, 577 bp, Homo sapiens
  misc_feature: GYAE6OF01B0OKF.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgacaaagtcggggtcccatcaaggttcagtgcagtggatcgtgggacagaattcactctcacatcagcagtctgccaactgaagtattttaggaaattacttattagtacaacgtagtaagttaacggtaactttggaccttacgtagttttccgggacggtacggggtaccgtaaagggtgggtaaagtaacgtaacggaaaaacggtaacgttacggtgggaccgttggaccctaacccgtaacgttacccgttgttacccgtttccgtaacccg

SEQ ID NO: 127388 - DNA, 681 bp, Homo sapiens
  misc_feature: GYAE6OF01EF6RY.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagactaacttaatttaaattggtatcagcacgtaccccggggaagcccctaagttactgatctatgctgcagcctaatttcgactaaaggtcgggtaccagtacgaaggttcaggtggacaggtggatcgtaggacagtaacttcactcctacacctatcagtacctagttctagacctaaaccgtaggtaaacgtttaagtttttaagggaaaactttaacgttagtttacgtaacgtaaacgtaacgggttaaacggtttaaccggtaaactttcggtacttaaccgtttaacggttttaccggggaacggggtaacgggtaaccggtaaaggggttacgggaaacgtaaacgttaaacggaaaaaacggttacgttacgggttacgggaccgttacgggaacccttaacccgtaacgtttcccgttaggtttacccttacgttaaccccg

SEQ ID NO: 127389 - DNA, 628 bp, Homo sapiens
  misc_feature: GYAE6OF01AQZIX.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacgatcccaggatgacccagtcgtccagtccgaccctgtctgcatctgtagagacagagtcaccatctatttgccgggacaagtcagagtattagctaactatttaattgtatcagcacgtacccgggaagcccctaagttacagatctatcgctgactacgacctaatttcgactaaaggtcgggtacccagtacgaaggttcaggtcggacgaggtggtaattcggaggaacagtaaacttctaactctacacgtactcacgctaggtctacgactaacctagtaacgtaagttttacggaaagtttacctattcggtaactaacgtagtaacgtttaacggtaacttgaccgtttacgttaacgtttaccgggacgggtaacgggtaaccgtaaggggttacggaaacgttaataaaccggtaaaacgtacgtgggtaacgtccgtagaacctacccgtaattccgtagttctaccgttaccg

SEQ ID NO: 127390 - DNA, 785 bp, Homo sapiens
  misc_feature: GYAE6OF01DKLAD.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagactaaacttatttaaaagttggtaattacaagacctaacgtaacccccgggggaacggtaccccctaaagttaactggattccgttaatggtcctaggccaacggtaccctaaagttttcggacgtaaaacgggttcgggggtaccccaagttaccgaaagggtttccgaaggttacgggacgaaggttagggtaacttcggtacggggtaaccgaggtaaacgttccaaccgttccttacccaaccctagttaccgtaaggtaccgtaacgttccgttacgaccgtaaacccgttaaggtaaaggtttaagtttttaagggtaaaacgtttaaccgtttaagtttacgttaacctaaacgtaaaggttaacggtttaaaccgggttaaacgttttaccgtaccgtttaccgttacggtttttacggggaacccgggtacggggtaaacccgggtaaagggtagggaaacggtaacgtaaacgaaaaacggtaacgttaggtacgggtactacgggaaccctaccgtaacttccgttacgttccttccgttacccg

SEQ ID NO: 127391 - DNA, 584 bp, Homo sapiens
  misc_feature: GYAE6OF01A7Y0B.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagcaactatttaaattggtatcagcagtaccccggggaagcccctaagttactgatctatgctgcagcctaatttgacgtaaaggtcgggtaccctagtacgtaaggttcgagtggacaggtggactcgtgggacagtaacttcgactctacaccatcgacgctagtctcgactaaccgtagtaagtagtttaggaaagttacttattacgtactaacgtagtaacgttaacggaaacttcgacgttacgtagtttcgggacggtacgggaaccgtaaggtaggaagtaacgtaacgaaaagtacgttaggtcggtacgtagacctaacctattaccgtcgttaccgttcgtacccg

SEQ ID NO: 127392 - DNA, 569 bp, Homo sapiens
  misc_feature: GYAE6OF01BJGKT.49.64.F09.1.454.CMB.1.raw
  modified_base (299)..(299): a, c, t, g, unknown or other
  misc_feature (299)..(299): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagccctaagtactgatctatgctgcagcctaattnacaaagtgggtacccatcaaggttcagtgcagtgatcgtggacagaattcactcctcacctatcagctagtctacgactaaccgtagaagtagttttaggaaagttacttaagttcgtacaacgagtaagttaacggtaacttcgcttactagttttacgggacgggtacgggaaccgtaagggtaggtacgtaagtacgtaaaaacggtaacgttaggtacggtacctaggaccctaacgtacttaccgttggttccttcgttaccccg

SEQ ID NO: 127393 - DNA, 536 bp, Homo sapiens
  misc_feature: GYAE6OF01D2NIW.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaagcccctaagttactgatctatgctgcagccaatttgacaaaggtcgggtacccaatcgaaaggttcaagtggacaggtggatcgtgggacagaattcactctacacatcagcagtctgacaacctgtaagtatttaggaaagttactattagtacaactaagagttaacggaaacttagacttacgtagttttcggacggagggtaccgaagggtaggagtaatacgaaaacgtaacgtaggtaggctagctaccatactcgttctctaccg

SEQ ID NO: 127394 - DNA, 576 bp, Homo sapiens
  misc_feature: GYAE6OF01C5JM7.49.64.F09.1.454.CMB.1.raw
  modified_base (284)..(284): a, c, t, g, unknown or other
  misc_feature (284)..(284): n is a, c, g, or t
  modified_base (387)..(387): a, c, t, g, unknown or other
  misc_feature (387)..(387): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgcctgtctgcatctgtaaggagacagagtcaccatcattgccggcaagtcagtagtattagacaacttaatttaatggtatcagctaacgtacccggggaagcccctaagttacngaatctatcgctgctagcctaatttgactaaaggtcgggtaccatacgtaaggttcaggtgacaggtaggatcggtaggaactagtactcgactcacacctanacagctagtacacgtactaacgtagtagtaagtttagtaaatactattagactaagacgtaagttaacgaacttcgacttcgtagtttcgggacgggaggtaccgtaagggtacggaagtaacgtaaacgaaaaggtacgtacggtacggacctagacccgtactacgttacgttcgttctcgtaaccc

SEQ ID NO: 127395 - DNA, 573 bp, Homo sapiens
  misc_feature: GYAE6OF01BFIER.49.64.F09.1.454.CMB.1.raw
tcagagtcgagagacacgaccggtgctcgatttagcgcgtatacaagggggaggtcagtcctcagtcaggacaccagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagacaactatttaaattggtatcagcatacccggggaagcccctaagttactgatctatgctgcagcctaatttgacgtaaaggtcgggtacccatccgaaggttcagtggcagtgatcgtggacagattcactctcacatcagcagtctgacaactagaagttatttaggaaagttactagttagtacaacgtagtaacgttaacgaacttgacttacgttacgttttcggacgggtacgggtaaccgtaaaggggtggtaaacggtaattaacgaaaaaggtaacgttagggtcgtacgtacgacctaaccgtacgttaccttcgttccttcgtaacccg

SEQ ID NO: 127396 - DNA, 583 bp, Homo sapiens
  misc_feature: GYAE6OF01B8026.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtccatcaaggttcagtggcagtggatcgtgggacagaattcactctcaccatcagcagtctcgcaacctgaagtattttaggaaagttactattgtacaaacgtagtaagttaacggaaactttggaccttacgtaacgtttttccggggacgggtaaggggtaacccgaaaggggttcggaaagtaagttaaccgtaaaaaagggtacttagggtcgggaccgttaggaccctaaccgtaacttccgtttggttccctttacgtaacccg

SEQ ID NO: 127397 - DNA, 503 bp, Homo sapiens
  misc_feature: GYAE6OF01CBTGH.49.64.F09.1.454.CMB.1.raw
  modified_base (275)..(275): a, c, t, g, unknown or other
  misc_feature (275)..(275): n is a, c, g, or t
  modified_base (400)..(400): a, c, t, g, unknown or other
  misc_feature (400)..(400): n is a, c, g, or t
  modified_base (498)..(498): a, c, t, g, unknown or other
  misc_feature (498)..(498): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcatacccgggaagccctaagtacngatctatgctgcagcaatttgacaaagtgggtccatcaaggttcagtgcagtgatcgtggacagaattcactctcaccatcagcagtctgacaactgaagtatttaggaaatactattgtacaanagagttaacggaaacttgacttctagttttcggacggtagggaccgtaaggtaggagaagtacgaaaagtagtagtggctagctaccatatcgtcttntaccg

SEQ ID NO: 127398 - DNA, 588 bp, Homo sapiens
  misc_feature: GYAE6OF01D4WVC.49.64.F09.1.454.CMB.1.raw
  modified_base (383)..(383): a, c, t, g, unknown or other
  misc_feature (383)..(383): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatcatttcgccgggcaagtcagagtattagctaatatttaaatggtatcagcacgtacccggggaagtacccctaagttactagatctatgctgcagtccaatttcgacgtaaaggtcgggtaccagtacaaggttcaggtgactagtgatcgaggacagtattcacttcacgactatcancgacgtctgacaacgtagaaagtagtttaaggtaaagttattaacgttagtactaactaagtaagttaacgtaaacgttgtacttacgttacgtttacgggacgggtaacgggaaccgaagggtaggtaagtaaagtaacgtaaaaggtaacgttacggtggtcgtacggacctaacctataccgttcgttacttcgttaacccg

SEQ ID NO: 127399 - DNA, 719 bp, Homo sapiens
  misc_feature: GYAE6OF01A4O2Q.49.64.F09.1.454.CMB.1.raw
tcagagtcgagagacacgaccggtgctcgatttagcgcgtatacaagggggagtcgagtactcagtcaggacacagcactgggacatgagggtccccgctcagctcctggggctcctgctactctggtctccggaggtgccagatgtgacatccagactgacccagtctccatccgccctggtctgcatctggtaggagacaggagtcacctatctatttcggccggacaaggtcaagtacgttattacgactaaacttaatttaaagttggtaattcgagtacaacggtaccccggggaagtaccccgtaagttactgtactcgttagtgcgtgcacgtacctaattcgacgaaacggtccgggtaccctaagtaccgaacggttacaggtacggactaggtacgatacgtaggaactaagtaacttcaacctactaccaactactacgtaacgtcgtagtctacgactaaccgtagtaacgttacgtttaaggaaacgttacttaagttacgtaacgtaacgtaacgggttaacgttaaaccggtaaacttcggtacgttacggtttaaggtttaaccggggtaacggtaacgggttaacccggtaagggttacggaaacgttaaacgttaaaccgtaaaaaggttccgttacgggtcgtacccggtaggaacccgtaaccgttacgttaccgttccgtttaccttaccgttacccg

SEQ ID NO: 127400 - DNA, 532 bp, Homo sapiens
  misc_feature: GYAE6OF01ARNP2.49.64.F09.1.454.CMB.1.raw
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttattaaattggtatcagcataccccggggaagcccctaagttactgatctatgctgcagccaatttgacaaggtcgggtcccagtcaaggttcaggtgcaggtgatcgtggactagaattcgactctcaccntcagcagtctgcaactgaagtntttaggaattactattgtacaanagtaagtttacgaaactttgaccttacgtacgtttcgggaccggtacgggacctaagggtcgtagaataacggaaaagtacgttgtggcttgacctacctattctacgttcttcgtaccg

SEQ ID NO: 127401 - DNA, 540 bp, Homo sapiens
  misc_feature: GYAE6OF01BH51I.49.64.F09.1.454.CMB.1.raw
  modified_base (382)..(382): a, c, t, g, unknown or other
  misc_feature (382)..(382): n is a, c, g, or t
  modified_base (526)..(526): a, c, t, g, unknown or other
  misc_feature (526)..(526): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcacgtaccccggggaagcccctaagttactgatctatgctgcagcctaatttgacaaaggtgggtcccagtcgaaggttcagtggctagtgatcgtagggacagaattcactctacaccatcagcagtcngacaactagaagtatttaggaaagttactattacgtactaacgtaagtacgttaacgaacttgacttacgtagttttacggacggtagggaccgtaagggtagagtaataacgaaaagtacgtaggtggtactgactacacttntcgttcttctaccg

SEQ ID NO: 127402 - DNA, 601 bp, Homo sapiens
  misc_feature: GYAE6OF01EV7S2.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatctatttcggccgggacaagtcagagtattagctaacttatttaaatggtatcagcacgtacccgggaacgtcccctaagtactgtatctatgctgcagtacctaattgactaaggtcggtaccagtacgtaaggttacgaggtgactaggtgatcgtaggaactagtattcactctacaccatcgagtctacgtctacgtacaacgtagtaaacgttagtttaaggaaagttacttaagttacgtaacaaacgtaggtaacgtaacggtaaacttcgtacttacgttacgtttacgggacgggtacggtaacgtaagggtagaacgtaagtaaacgtaaaagtagttaggtcggtaccgtagaccctaactacgttacttacttccgtcgttaaccg

SEQ ID NO: 127403 - DNA, 665 bp, Homo sapiens
  misc_feature: GYAE6OF01BB7KX.49.64.F09.1.454.CMB.1.raw
  modified_base (283)..(283): a, c, t, g, unknown or other
  misc_feature (283)..(283): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcagtaccccggggaagcccctaagttactnatctatgctgcagcctaatttgacgtaaagtcgggtccagtcgaaggttcagtggcagtggatcgtggacagattcactctacacatcagtcacgtctacgactaaccgtgtaaacgttagttttacgggaaagttacgttatttacgtaccgtaaagtacgggtaaacgtttaaccggtaaaacgtttcggaacccttttaggttaaccggtttttacggggaaccgggtaacgggggttaaacccgtaaacgggggttacgggtaaacgtaacgttaaacccgggtaaaaaacgtaccggttacggttcggggtaccttaccgggtaacctaaccccggttagttaacccgtttcggttaccgtttaccgttaaccccgg

SEQ ID NO: 127404 - DNA, 606 bp, Homo sapiens
  misc_feature: GYAE6OF01DXU45.49.64.F09.1.454.CMB.1.raw
  modified_base (386)..(386): a, c, t, g, unknown or other
  misc_feature (386)..(386): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagttatagactaacttaatttaaattggtaatcagacacgtacccggggaacgacccttaagtactgatctatgctgacagtacctaatttgactaaggtcgggtacccagtcgaaggttcaggtggcaggtggatcgtggacagtactcactctacacatcngactgtctacgactaacgtagaagttagtttaaggaacttacttattacgtaacaacgtagtaacggttaacgtaacgttcgtacgttacgttacggtttacgggacgggtacgggaaccggtaagggtaggaacgtaagtaaacgaaaacggttaacgttagggtcggtaccgtacgaccgttaccctacgttaccgtttcgttcctttcttaaccccg

SEQ ID NO: 127405 - DNA, 656 bp, Homo sapiens
  misc_feature: GYAE6OF01ANLGV.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagcaacttatttaaattggtatcagcagtaccccggggaagcccctaagttactagatctatgctgcagcctaatttgacaaaggtcgggtcccagtcgtaaggttcaggtgcgagtggatcgtgggacagtaattcaactctcacatcagtcagtctcgactaaccgtggaaacgtagtttttaagggaaactttacgttaagtttacgtacgaaacgtaggtaacggttttaaaccggtaaaactttggtaccgtttacttaacgggtttttaccgggaccggggttaaaggggtaaccccggttaaaggggttagggaaacggttaacgtaaaccggtaaaaaaggtaccgttaaggggttggaacccgttcggaacccggtaaacccttacgttacgtttaccgtttccgtttaacttaccccgg

SEQ ID NO: 127406 - DNA, 593 bp, Homo sapiens
  misc_feature: GYAE6OF01CLT8I.49.64.F09.1.454.CMB.1.raw
  modified_base (287)..(287): a, c, t, g, unknown or other
  misc_feature (287)..(287): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggacaagtcagagtattagactaacttaatttaaattggtatcagcacgtaccccgggaagaccctaagttacngtatctatgctgcagtacctaatttgacgtaaaggtcgggtaccatacgaaggttcaggtggacgaggtggagtcgagggaactagtaattcactctacacatcagctagtctcacaactagtaagttagtttaaggaaattactaattcgtaacaacgtaaggtaacggttaacgtaacgttcgtaccgttacgttaacggttttaccgggacggggtaacgggtaaccggtaagggttaggaagtaaacgtaacgtaaaaggtacgtagggtcgactcgactacctatcgtacttctcgtaccg

SEQ ID NO: 127407 - DNA, 521 bp, Homo sapiens
  misc_feature: GYAE6OF01A1ARO.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccagtcaaggttcagtggcagtggatcgtggacagattcactctcaccatcagcagtctgacaacctgaagtagttttaggaaagttactagttagtactaacgagtaagttaacggtaaacttgacttctagttttcggacgggtagggaccgtaagggtggagatacgaaaagacttaggtggctgactacatctgtcttctac

SEQ ID NO: 127408 - DNA, 690 bp, Homo sapiens
  misc_feature: GYAE6OF01C4XRE.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagacgtcaacctatctatttcggccgggacaaggtcagagtattagactaaacttaatttaaattggtatcagtacaacgtacccggggaacgtaccccgtaagttactgtactctagtgctgcacgcctaatttcgacgtaaaggtcgggtaccagtacgtaaggttctaaggtggactaggtggtagtcgtagggaactagtaaacttcactctacaccataccagctagtcctagtactaaccgtagtaaagtttacgtttaaggtaaaacgttacttaagttacgtaaccgaaagtaacgggttaacggtttaaccgggtaaactttcgggtaactttacgttaacggttttccggggaacgggtaacggggaaccgtaaggggtacggtaaacgttaacgtaaacggtaaaacggtacggttagggtccgtaacgtacggttaccctaaccccggttattacccgtttcgggttaaccctttcgttaccccgg

SEQ ID NO: 127409 - DNA, 527 bp, Homo sapiens
  misc_feature: GYAE6OF01A14QE.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagtactgatctatgctgcagccaatttgacaaagtgggtcccatcaaggttcagtggcagtgatctaggacagaatcactctcaccatcagcagtctgccaactgaagtagttttaggaaagttactattgtacaactaagtaagttaacggtaacttgactacgtagttttcggacggtagggtaaccaagggtaggacgtaagtaacgtaaagtacgtaggtagctagctaaccgattatcgtcttcgtaccg

SEQ ID NO: 127410 - DNA, 638 bp, Homo sapiens
  misc_feature: GYAE6OF01DIL6A.49.64.F09.1.454.CMB.1.raw
  modified_base (215)..(215): a, c, t, g, unknown or other
  misc_feature (215)..(215): n is a, c, g, or t
  modified_base (385)..(385): a, c, t, g, unknown or other
  misc_feature (385)..(385): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcacatcattgccggganaagtcagagtattagactaacttatttaaagttggtatcagacacgtaaccccggggaagtacccctaagttactagatctagtgactgacagacctaagtttagacgtaaaggtcgggtacctagtacgtaacggttacaggtcggacgtaggtagtagtcgagggaanacgtaacttacgactcctacaccatacagtcacgttctacgactaaccgtagtaaacgtagtttaaggaaattacgttaagttacgtaacaaagtaagtaacggttaacgtaacgttcgtaccttacgttaaggtttaccgggaacgggtaacggtaaccggtaagggtacggtaaaggaaactaaacggaaaaggttactagggtacggcttacggaacctacctattaccgttcgttccttccgttaaccg

SEQ ID NO: 127411 - DNA, 611 bp, Homo sapiens
  misc_feature: GYAE6OF01E3AD7.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagactaactatttaaattgtatcagcacgtacccggggaagcccctaagtactgatctatgctgcagcctaatttcgacaaaggtcgggtcccagtcgaaggttcagtggcagtggtatcgtggacagtacttcactctacaccatcagcagtctgacaaccgtgtaagtattttagggaaattactattagacctaacgtagtaacggtttaacggaaactttcggaccttacgttacgttttaccgggacgggtaacgggtaacccgaaagggttgggtaaacgtaagtttaaaccggaaaaacggttaacgttacggggtaacgggtacccttagggaccctaacccgtaacttccgttacggttccctttacgtaacccg

SEQ ID NO: 127412 - DNA, 776 bp, Homo sapiens
  misc_feature: GYAE6OF01BDAJZ.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcacatctatttcggccgggacaagtcagtagtatagactaacttaatttaaagttggtatacgagtactaacggtaaccccggggaacgtaccccttaagttaccgtgtactactatcgctacgactacgacctaagttcgaacgtaacggtcggtacccagtacgtaacggttacgaggtacgacgtaggttacggtacgttcggtacgggaactaagtaactttaccgaaccgttacctaccaaccctagtaccgtacggtacctaacggttaccttacggaaaccttaacggtaaacggtaaacgtttaagttttaaacgggtaaacgtttaacgtttaacgtttaaccggttaaacgaaccgttaaagggttaacggttttaaaccggtaacctttacggtaccgttaaccggtttacggttttaccgggggaaccgggtaaccgggtaaaccggtaaggggtaacggtaacgtaaaacgtaaacgggaaaacggttaacggttagggttaaccggtaccttacggaccctaaccgttagttacccgttacgttacccgttacgttaaccccgg

SEQ ID NO: 127413 - DNA, 558 bp, Homo sapiens
  misc_feature: GYAE6OF01CPU72.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagttactgatctatgctgcagcctaatttgactaaaggtcggggtaccccagtactaaggttcaggttcggcaggtggatcgtgggaacagtaacttcacttctaccacgatcagcagtctgactaactagaagtagttttaaggtaaagttactattagtacaacgtaagtaagttaacggtaacttcgacttcttagttttcggacggtacgggtaaccgtaggtaggaagagtaacgaaaacgtagtaggtggacgtgactaccattcttctcgttctaaccg

SEQ ID NO: 127414 - DNA, 553 bp, Homo sapiens
  misc_feature: GYAE6OF01E4FRP.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcacgtaccccggggagcccctaagttactgatctatgctgcagcctaatttgactaaaggtcggggtacccatcaaggttcagtggcagtggatcgtggacagaattcactctacacatcagcagtctgactaacctagtaaagtagttttaggaaagttactattagtacaactagtaagtttaacggaacttgacttacgtagttttcggacggtacgggaaccgaagggtaggagaagtaacgaaaacggtataggtcggactaggacctaacctacttccttcggttccttcgtacc

SEQ ID NO: 127415 - DNA, 594 bp, Homo sapiens
  misc_feature: GYAE6OF01CJH3Y.49.64.F09.1.454.CMB.1.raw
  modified_base (393)..(393): a, c, t, g, unknown or other
  misc_feature (393)..(393): n is a, c, g, or t
tcagagtcgagagacacgaccggtgctcgatttagcgcgtatacaagggggagtcagtctcagtcatgacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagctaacttatttaattggtatcagacacgtaacccggggaacgcccctaagttactgtatctatgctgcagtcctaatttgactaaggtgggtacccagtctaaggttcaggtggacaggtggtactcggtagggactagtaattcactctacaccatacacgnacgtactagacctaacgtgaacgttaagttttaggaaacgttacttagttacgtaacaaacgtagttaacggttaacggtaacgtttacggtacttacgttacggtttaccgggacgggtacggtaaccggtaaggtaggaagtaacgtaacgtaaaaggtaccgtgtacggactacgacctacacttctgttccttaccg

SEQ ID NO: 127416 - DNA, 599 bp, Homo sapiens
  misc_feature: GYAE6OF01EAD14.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcacgtacccgggaagcccctaagttactgatctatgctgcagcctaagtttgacgtaaaggtcgggtacccagtactaaggttcaggtggcagtggatcgtaggacagtaacttcacttctcaccatacagcagtctagaccaacgttagaaacgttagttttaagggaaactttacttagttacgtactaaactaggtaacgttaacggtaaaccttgtacgttcttaaggttttcggacgggtaacggggaaccgtaaagggttaggacgtaaacgtaagaaaacgggtaactaggtacggaccgtagacccgtactattaccgttacggttccttcgtaacccg

SEQ ID NO: 127417 - DNA, 636 bp, Homo sapiens
  misc_feature: GYAE6OF01DY0C4.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgccatctgtaggagacagagtcaccatcatttgccgggacaagtcagagtattagactaacttatttaaattggtatcagcacgtaacccgggagcccctaagtactgtatctatgctgacagcctaatttgacgtaaaggtcgggtacccatacgtaaggttcgaggtggacaggtgagtcgtggaacagtacttcacgtcctacaccatcagctagtctagactaaaccgtaggtaaacgttagttttaagggtaaagtttaccttaagtttacgtaacaacgtaagttaacggttaaccggtaaactttagaccttacgttacgttttacgggaacgggtacgggtaaccggtaaaggggtaagtaacggtaagtaaacgtaaaaaggtaaccgttaggttacgggaccttacgaacccgtacgttaacgttccgttacgttccttacgtaacccg

SEQ ID NO: 127418 - DNA, 578 bp, Homo sapiens
  misc_feature: GYAE6OF01BMA02.49.64.F09.1.454.CMB.1.raw
  modified_base (381)..(381): a, c, t, g, unknown or other
  misc_feature (381)..(381): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcgagcgaagtacccccgggggaagcccctaaagttacctgatctatgctgcagcctaatttgacaaaggtcgggtacccagtacgtaaggttcaggtcggctaggtggatcgtgggacagtacttcactcncacatcagcacgtctacgacaaccgtagtaagttagtttacggaaattacttagtcgtaacaagtagtaacgttaacggtaacttcgtactacgttacgtttcgggacggtacgggtaccgtaaggggtcgtagtaactaacgaaaacggtacgtaggtacgcgttagaccaacctatccgttgtccttacgtaccc

SEQ ID NO: 127419 - DNA, 520 bp, Homo sapiens
  misc_feature: GYAE6OF01EIUDO.49.64.F09.1.454.CMB.1.raw
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaagccctaagttactgatctatgctgcagccaatttgacaagtgggtccatcaaggtcagtggcagtgatcgtggacagatcactctcacatcancagtctnacaactagaagtagtttaggtaaagtattattgtacaacgtagtaacgttaacgtaacttcgtactcgtagttttcggacgggtagggaccgaaggtaggagaagtaacgaaaagtagtaggtggacgtgaccgactactctcgttcttcgtaccg

SEQ ID NO: 127420 - DNA, 584 bp, Homo sapiens
  misc_feature: GYAE6OF01DI6CK.49.64.F09.1.454.CMB.1.raw
  modified_base (216)..(216): a, c, t, g, unknown or other
  misc_feature (216)..(216): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttggccgganaagtcagagtattagactaacttatttaaatggtatcagcacgtacccgggaagaccctaagttactgatctatgctgcacgctaagtttagacgtaaaggtcggtaccagtacgtaggttcgaggtggacgaggtggtaagtcgtaggggaactaggtaacttcacttcctacacctatccagactagtctagactaaccgtagagttaagtttagtaaattactagttcgtaacaactagtaacggttaacgtaacttcggtacttacgttacggtttcgggacggtacgggaacgtaaggtagagtaactaacgtaaaagtacgtaggtcgacgtacgaccgtactacttcgttctcttctaccg

SEQ ID NO: 127421 - DNA, 559 bp, Homo sapiens
  misc_feature: GYAE6OF01EG2OB.49.64.F09.1.454.CMB.1.raw
  modified_base (190)..(190): a, c, t, g, unknown or other
  misc_feature (190)..(190): n is a, c, g, or t
  modified_base (374)..(374): a, c, t, g, unknown or other
  misc_feature (374)..(374): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtagganacagagtcaccatcatttgccgggcaagtcagagtattagctaactatttaaattggtatcagcacgtacccgggaagcccctaagtactgatctatgctgcagcctaatttgactaaaggtcgggtacccagtcgaaggttcaggtggcagtggatcgtggacagaattcactctcacatcancagtctgacaactgtaagtattttaggaaattactattacgtactaacgtagtaagttaacggtaacttcgtacttacgttacgttttacgggacgggaacgggtaccgtaagggttcggaagtaaagtacccgaaaagtacgtaggtacgacgtcgacctactacgtacttcgtcttcgtaccg

SEQ ID NO: 127422 - DNA, 545 bp, Homo sapiens
  misc_feature: GYAE6OF01EA1F2.49.64.F09.1.454.CMB.1.raw
  modified_base (533)..(533): a, c, t, g, unknown or other
  misc_feature (533)..(533): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaaacttatttaaattggtatcagcataccccggggaagcccctaagttactgatctatgctgcagcctaatttgactaaaggtcggggtacccagtcaaggttcaggtggacaggtggatcgtgggacagtattcactctcaccatcagcagtctgacaacctagaagttatttaggaaagttactattagtacaactagtagttaacggtaacttgacttcgtagtttcgggacggacgggtacgaagggtaggagaagtaacgaaaagtaattggtagcgtagacctaccgtatcgttnttcgttctaccg

SEQ ID NO: 127423 - DNA, 629 bp, Homo sapiens
  misc_feature: GYAE6OF01BD7AR.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcacatctatttgccgggcaagtcagagtattagactaacttatttaaattggtatcagcacgtacccgggagaccctaagtactgatctatgctgcagacctaattgacgtaacgggtcgggtacctagtacgtaaggttcgaggtggacgaggtgagtcgtaggacagtacttacactctacacctagtcacgctagtctacgacctaacgtagtaaagttagttttaacggtaaagtttacttaagttacgtaactaacgtaaaggttaacgttaaccggttaaacttcgtaaccttacgtttaacggtttccggggacgggtaacgggtaaccgtaaggggtaggtaagtaacgtaaacggaaaacggtacgttagggtcggtacgtcgaaccctaacgtacgtttacgttcgttccttcgttaacccg

SEQ ID NO: 127424 - DNA, 629 bp, Homo sapiens
  misc_feature: GYAE6OF01BMYOZ.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagacaactatttaattgtatcagcacgtacccgggaagcccctaagtactgatctatgctgcagcctaatttgactaaaggtcgggtaccagtacgtaaggttcaggtggacgtaggtcggagtcggtagggtaactaagtaacttaccaactcctaccaaccctagtctaagcgtacgtactgaccgtaaccgtagtaaacggttaagttttaagggaaacgtttacttaagttacgttaacgaaacgtaaggtaacgttaacggtaaacttcggtaccttacgttacggttttacgggacgggtaacggaaccggtaagggtacgggaagtaacgtaaacgaaaaggtacgttaggtcggtacgtacgaccgtactacttaccttcgttacttcgtaccg

SEQ ID NO: 127425 - DNA, 616 bp, Homo sapiens
  misc_feature: GYAE6OF01B9Z38.49.64.F09.1.454.CMB.1.raw
  modified_base (286)..(286): a, c, t, g, unknown or other
  misc_feature (286)..(286): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttcgccgggcaagtcagagtattagactaacttaatttaaattggtatcagcacgtacccgggaagacccctaagttacngatctatgctgcagcctaatttgacgtaaaggtcgggtacccagtacgaaggttcgagtggcgtaggtggtagtcggtaggactaagtaacttcgacttcctacaccactcacgtctagtcctacgaactaaccgtagtaagttagtttaaggtaaacgttacttagtttagtacgaaacgtaggtaacgttaacggtaaacttcgtacgttacgttacgtttacgggacgggtacggtaaccggtaaggttaggaacgtaacgtaacgaaaacgtacggtaggtacggacgtagacctaccgtacttaccgttcgttccgtcgttaccg

SEQ ID NO: 127426 - DNA, 604 bp, Homo sapiens
  misc_feature: GYAE6OF01EDT3R.49.64.F09.1.454.CMB.1.raw
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtccaccatctatttggccgggacaagtcagtagtattagactaacttaatttaaattggtatcagcacgaaccccgggagcccctaagtactgatctatgctgcagtcctaatttgactaaaggtcgggtacccatacgaaggttcaggtgctaggtggatgtaggganagttttacncactctacacatcagctagtctacgacctaacgtagaacgttagttttaaggaacgttacttaagttctaacaacgtagtaacgttaacggtaacttcgtacttacgttaggtttcgggacgggaacggtacgtaagggtagaacgtaacgtaaacgtaaaacggtagttagggtcgtaaccgtcgaacccgtaacttacgttaccgttacgtttctccgttaaaccccg

SEQ ID NO: 127427 - DNA, 814 bp, Homo sapiens
  misc_feature: GYAE6OF01B1CVL.49.64.F09.1.454.CMB.1.raw
  modified_base (771)..(771): a, c, t, g, unknown or other
  misc_feature (771)..(771): n is a, c, g, or t
tcagagtcgagagacacgaccggtgctcgatttagcgcgtatacaagggggagtcgagtctcagtcaggacacagcatggacatcgagggtccccgctcagctcctggggctcctgctactcgtgctccgaggtcgccagatgtgacatccagactacgaccctacgttcctcctacgtcccgtcccctggtacctcgcctacttcctggtaaggacgacgagtacgtccaacctatctagtttccggaccggtactaagtcaaggtacgttataacgactaaacgttaatttaaagttcggtactacgacgtacccgtaacggtaaccccggggtaacgttaccccgttaaggttacctagtaactccgtagtaccggtccgtacggaccacgttacctaagtttacggaaccggttaaacggtccggggtaacctaggttacccggtaagttcggacggttcgggacgtacgggttacggtaacgttacgggtaacggtaacgtaacgtaccgtttacctaaccgtttaccaaccctaccgtaacgttaccgacgtacctaacggttaccgtaccgtaaccgttaacgtacggttaaacggtttacgtttaaagggtaaacctgtttaaccgtacgttaaccctaacgtaacggttaaccggttaacgtaaccgttacggttaccgtacggtttacggttaccggggaacggtaccgggtaacgtagggtaacgaacgtaaacggtaacgtaaacggtatcgggtaacnccgtaccaccgttacttagtaccgtctttaccgtcgttacccg

SEQ ID NO: 127428 - DNA, 570 bp, Homo sapiens
  misc_feature: GYAE6OF01BNSAG.49.64.F09.1.454.CMB.1.raw
  modified_base (282)..(282): a, c, t, g, unknown or other
  misc_feature (282)..(282): n is a, c, g, or t
  modified_base (381)..(381): a, c, t, g, unknown or other
  misc_feature (381)..(381): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtatagacaacttaatttaaattggtatcagcagtaccccgggaagcccctaagttacngactctatgctgcagcctaagtttgacaaaggtgggtcccatcgtaaggttcagtggcagtgatcgtggacagtattcactctcaccatcagcagttcncgacaacgtagtaacgttagtttaggaaagttacttagttagtacaactaggtaagttaacggtaacgtttcgtacttactaaggttttccgggacggtacgggaaccgtaagggtacggtaaggtaactaacgaaacggtacgtacggtaggtactacgacctaccgtattacgtgttacttcgtacc

SEQ ID NO: 127429 - DNA, 596 bp, Homo sapiens
  misc_feature: GYAE6OF01CCYA7.49.64.F09.1.454.CMB.1.raw
  modified_base (283)..(283): a, c, t, g, unknown or other
  misc_feature (283)..(283): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggacaagtcagagtattagacaactatttaaattgtatcagcacgtaccccggggaagcccctaagttacngtatctatgctgcagcaatttgactaaaggtcgggtccatcgaagttcagtggcaggtggatcgtggacagtattcactactacacatcagcagtcgtacgactaacgtagtaacgtagttttaggaaaagttacttaatttacgtactaaactaaggtaagttaacgtaaacttgtacgttacttacgttttaccgggacgggtacgggtaaccggtaagggtcgaaggtaaactaacgtaaaaggtaacgttaggtacggaacgtcgtacccgtaaacctacgttccgttacgttcccgttcgttaacccg

SEQ ID NO: 127430 - DNA, 573 bp, Homo sapiens
  misc_feature: GYAE6OF01BTYQ4.49.64.F09.1.454.CMB.1.raw
  modified_base (284)..(284): a, c, t, g, unknown or other
  misc_feature (284)..(284): n is a, c, g, or t
  modified_base (392)..(392): a, c, t, g, unknown or other
  misc_feature (392)..(392): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatctatttgccgggcaagtcagagtattagctaaactatttaaattggtatcagcagtaccccggggaagcccctaagttacngatctatgctgacagtcctaatttgacaaaggtcgggtcccagtacaaggttcaggtcggacgaggtggatcgtagggacagtaattcactctcacatcagcagtctnacaactagaagtatttaggaaattactattcgtacaatagtaaggttaacgaaactttgacttactacggtttacggaccggaggaaccgtaagggtaggacgtaacgtaacgaaaacggtacgttaggtcggtaccgtacgtaccgtaaccgtacttacgttcgtttcgtccgttaaccg

SEQ ID NO: 127431 - DNA, 670 bp, Homo sapiens
  misc_feature: GYAE6OF01AX7YI.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatcatttgccgggcaagtcagagtattagctaacttaatttaaattggtatcagacacgtaaccccggggaacggtccccttaagttactgactctatgctgcagctaattgacaaagtcgggtacccagtacgtaaggttcaggtcggacgaggtggactcggtaggactaagtaattcactctaccacatacgagcagtctacgtaccaacctagtaagttaagttttaaggaaacgttactttaagttacgtaacgaacgtaacggttaacggtttaaaccggtaaactttcggtaccgtttaaccgtttaacggttttaccgggaccggggtaacgggtaacccggtaaagggggtaggtaaacggtaacgttaaacgtaaaaacggtaaccggttagggtaccgggtaccgttacgggaccctaacccgtattaccgttaccggtttccttaccgttaccccg

SEQ ID NO: 127432 - DNA, 622 bp, Homo sapiens
  misc_feature: GYAE6OF01EMSMD.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagctaactattaaattggtatcagcacgtacccgggaagtcccctaagtactgatcgtatgctgcagcctaatttgacgtaaaggtcggggtacccaatacgtaaggttcaggtggacaggtggagtcgtagggactaagtaacttcaccttctacaccatcagcagtctacgactaacctaggtaaagtagtttaggaaagttacttattacgtacaacgtagtaacggttaaacgtaacgttagtcttacttacgtttacgggacgggtaacgggtaccgaaagggtaggaaacgtaagtaaacgtaaaaacggttacgttacgggtacgggtaccgttacggaacccgtaacccgtaagttaccctttcggttacctttacgttaaccccg

SEQ ID NO: 127433 - DNA, 900 bp, Homo sapiens
  misc_feature: GYAE6OF01CA58U.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccactcccgccctgtcctgctatctggtaggagacgagacgtcaacctatctagtttcggccggacaagtcgagagttattagactaaacttaatttaaattggtatacgagtacctaaccggtaaccccggggaacgtcccccgttaaaggttacctaggtacttccttaagtcgtcttacgacctacggtaccttaagtttacggaacgtaaacgggtccggggtaacccctaagttacggtaaacggttcgtaacgggttcgggacgtagggttacggtaacgttccgggtaaggggtaacttaaggttaaacctttcccgtaacccgttacccgttaccctaacccgtaacgttacccgaacggtaccgtaaccgggtttaccgtaacccggtaacccgttaaaaccccgggtttaaggtttaaaacgggttttaaacgggtttttaaaaccgggttaaaacgtttaaaccgttttacgttttaaccggtaaaccggtaaaacggttaacgggttaaaccggttttaaaccggggttaaaccttttaccgggtacccgttttaaccgggtttaacggggttttcccgggggaaacccgggggttaaccgggtaaacccgggtaaggggtttacgggaaacgttaaacggtaaacgtaaacggttaacggttcggtaccggtaccgtacggaccctaacgtacgttaccgtttacttccgttaccgttacccg

SEQ ID NO: 127434 - DNA, 638 bp, Homo sapiens
  misc_feature: GYAE6OF01D15CO.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatctatttcggccgggacaagtcaagaagttattagactaaacttaatttaaattggtaatcagacgtaacgtaccccggggaacgtaccccttaagttacctgacttctatcgctgcacgcctaattgacgtaaggtcggtaccagtacgaaggttcaggtcgataggtaggactcgtagggaactagtacttcactctacgacacgtcacgctacgtctacgacctaacgtaggtaacgttagtttaaggtaaaacgttacttaagttacgtaactaaacgtaacggttaacgttaaaccggtaactttcgtaccgttacgttacggtttaccgggacgggtaacgggtaacggtaaggtaggaaacgtaagtaaacgaaaaggtacgtggtacggtcgtacgacctactacgttacgttcgttccttcgtaccg

SEQ ID NO: 127435 - DNA, 542 bp, Homo sapiens
  misc_feature: GYAE6OF01C89X7.49.64.F09.1.454.CMB.1.raw
  modified_base (349)..(349): a, c, t, g, unknown or other
  misc_feature (349)..(349): n is a, c, g, or t
  modified_base (424)..(424): a, c, t, g, unknown or other
  misc_feature (424)..(424): n is a, c, g, or t
  modified_base (530)..(530): a, c, t, g, unknown or other
  misc_feature (530)..(530): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagacaaacttatttaaattggtatcagcagtaccccggggaagcccctaagttactgatctatgctgcagccaatttgacaaagtcgggtaccatccaaggttcagtggacagtggatcgnggacagtaatcatctcacatcagcagtctgacctaacgtagaagttagtttaggaaacttactattacgtacaanagtaagttaacgaacttgtacttgtagtttcgggacggagggacctaagggtaggaagtaagtaacgaaaagtagttaggtcggactagacctaacctataccgtnttcttcgtaccg

SEQ ID NO: 127436 - DNA, 593 bp, Homo sapiens
  misc_feature: GYAE6OF01D9U0O.49.64.F09.1.454.CMB.1.raw
  modified_base (587)..(587): a, c, t, g, unknown or other
  misc_feature (587)..(587): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatctatttgccgggacaagtcagtagtattagctaacttaatttaaattggtatcagacacgtaacccggggagacccctaagttactgtatctatgctgcagtacctaagtttgactaaaggtcgggtaccatacgaagttcagtgcgtagtgatcgtaggactagtaatcactctacacatcagcagtctacgactaacgtagtaaagttagttttaaggaaattacttaattacgtactaaagtaacgtaacgttaacggtaaacttgtaccttagttacggtttacgggacgggaacgggaacgtaagggtaggaataaaggtaacgtaaaaaggtacgtaggtaggactacgacctaccgtattaccgttagttccgttntaaccg

SEQ ID NO: 127437 - DNA, 685 bp, Homo sapiens
  misc_feature: GYAE6OF01BN7EE.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatcatttcggccgggacaagtcagtagttattagactaacttaatttaaaagttggtaactcagtaccaacgtaaccccgggggaagccccttaaagttactggatctatgctgcagcctaagtttgacgtaaaggtcgggtaccagtacgtaaggttcaggtcggacgtaggtggatcggtagggaactagtaacttcacgtctacgacctatacagtcagttctacgaacctaacgttagtaacgttagtttaacggtaaaacgttactttaagttacgtaacgtaacgtaaggttaacggttaaaccggtaactttcggtaacgttaccgtttacgggttttacccggggaacggggtaacgggttaaccggtaaggggtaacggtaaacgtaaacgttaaacgtaaaacgggtacgttagggtacggtaccgtcggaacccttacctacgtttacctcgtttacccttccgttaacccg

SEQ ID NO: 127438 - DNA, 675 bp, Homo sapiens
  misc_feature: GYAE6OF01BKPLI.49.64.F09.1.454.CMB.1.raw
tcagagtcgagagacacgaccggtgctcgatttagcgcgtatacaagggggagtcagtctcagtcaggacacagcatggacatgacgggtccccgctcagctccgtggggctcctgctactctggctccgaggtgccagatgtgacatccgagatcgacccagtcctccactcccgtccctgtctgcatctggtaggagacgagacgtcaccatctagttcggccgggacaagtcagtagttattagactaaacttaatttaaagttggtatcagacctaaccggtaccccggggaacgtaccccttaagttacctaggtactactatcgctgcacgtactaattacgacgtaacggtcggtacctagtacgtaaggtcgaggtagacgtaggtaggtacgtcggtaggaactaagtacttaccgaccttcctacctactactacgacgctacgtctacgtactaacgtagtaagttagttaggtaaattacgttatcgtaacgaactaggtaacgttaacgtaacttcggtacttacgttacggtttacggggacgggtaacgggtaaccgtaagggtacgtaaagtaacgtaaacgtaaacggttacggttaggtacggtaccgtaacggtaccctaacgtacgtttccttacgttcccttacggtaaccccg

SEQ ID NO: 127439 - DNA, 539 bp, Homo sapiens
  misc_feature: GYAE6OF01A0IIG.49.64.F09.1.454.CMB.1.raw
  modified_base (435)..(435): a, c, t, g, unknown or other
  misc_feature (435)..(435): n is a, c, g, or t
  modified_base (534)..(534): a, c, t, g, unknown or other
  misc_feature (534)..(534): n is a, c, g, or t
tcagagtcgagagacacgaccggtgctcgatttagcgcgtatacaagggggagtcattctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagcaactattaaattggtatcagcacgtaccccggggaagcccctaagttactgatctatgctgcagcctaatttgactaaaggtcggggtacccagtacgtaaggttcgaggtggacgtaggtggtagtcgtagggactagtaacttcgtactctacacctatcagtctagtctgacaacctagaagtagtttaggaaattctattntacaatagtacgttacgaacttgacttactagtttcggaggacggtacgaggtggagtagtaacgaaagtactaggtcgactgacactatctcgtcttntaccg

SEQ ID NO: 127440 - DNA, 622 bp, Homo sapiens
  misc_feature: GYAE6OF01EMW2E.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccatcccgccctgtctgcatctgtaggagacagagtcaccatctattcgccgggacaagtcagtagtattagactaacttaatttaattggtatcgagcaacgtacccgggaagtacccctaagttactgactctatcgctgcacgctaagttcgacgtaaggtcgggtaccagtacgtaggttcaggtcggactaggtggacgtcgtaggactaagtacttacactccacactatcagtcgtacgtctacgacctaacgttagtaaagttagtttaaggaaacttacttacgttagtaactaacgtagtaacgttaacgtaacttcgacttacgttacggtttacgggacggtacggtaacgtagggtacggtaacgtaaacgtaacgtaaacggtacgtacgggttcggtaccgtacgtaccctacgttacttaccgttcgttccgtccttacccg

SEQ ID NO: 127441 - DNA, 555 bp, Homo sapiens
  misc_feature: GYAE6OF01A219O.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccgggaagcccctaagttactgatctatgctgcagcctaatttgactaaaggtcggggtacccatcgaaggttcagtggcaggtggatcgtggacagtaattcactctacaccatcagcagtctgactaacctagtaagtatttaggaaagtactagttagtacaacaagtaagttaacggtaaacgttacgtcgtacttagtttcgggacggtacgggaaccgaaggtaggaacgtaacgtaacgaaaacgtaactaggtggactagtacccccgatacgtacttcgtcttctaccg

SEQ ID NO: 127442 - DNA, 545 bp, Homo sapiens
  misc_feature: GYAE6OF01EAHQB.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacccggggaagcccctaagtactgatctatgctgcagcctaatttgacaaagtcgggtcccagtcaaggttcagtcggcagtggatctggacagaattcatctcaccatcagcagtctgactaactgaatattttaggaaattactattgtactaacgaagtaagttaacggaaacttgaccttacgtaagttttcgggacgggtacgggaaccgtaagggtaggaacgtaataacgaaaagtaacgtagttcgggactgacctacgtaatcgttacgtcgttcctaccg

SEQ ID NO: 127443 - DNA, 612 bp, Homo sapiens
  misc_feature: GYAE6OF01BMFRG.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtatagcaactaatttaaattggtaatcagcacgtaccccggggaagcccctaagttactagatctatgctgcagcctaattgacgtaaaggtcgggtacccagttcgaaggttcagtcggactaggtggacgtcggtaggaactaggtaacttcctactcctacacctatccagacgtaacgtcgtacgacctaacgtagtaagttagtttacggtaaagttacttaagttacgtaactaacgtaggtaacggtttaacggtaacttcgtacgttacgttaagttttccgggacgggtacgggtaaccgagggtagacgtaaagtacgtaaaagtacgtaggtcggtactacggtacaaccgttatacctcggtttacttccgtaaccg

SEQ ID NO: 127444 - DNA, 700 bp, Homo sapiens
  misc_feature: GYAE6OF01B5NL4.49.64.F09.1.454.CMB.1.raw
  modified_base (300)..(300): a, c, t, g, unknown or other
  misc_feature (300)..(300): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccatccgccctgtctgcatctgtagagacagagtcaccatctatttcggccggacaagtcagtagtattagactaaacttaatttaaattggtatacagactaacggtaccccggggaacgtacccctaagttacngtatctagtcgctgacacgtactaattcgacgtaaaggtcgggtaccagtacgaaggttcgaggtggcaggtgagtcgtaggactagtaacttacactactacacatcgagtacgtagtctacgaacctaacggtagtaaagtttacgtttaaggtaaacgtttacgttagtttacgtaaactaaacgtaaggttaacggtttaaaccggttaacttaccggactttaacggtttaaggtttttacgggggaaccgggtaacggggtaaccgttaaaggggggtaacgtaacgtaaacggtaaaccggttaaaaacggtaccgttaagggtccgggtaacctaacgggtccctaaaccggtttacgttaccgtttacgttccctttaacccggttacccg

SEQ ID NO: 127445 - DNA, 545 bp, Homo sapiens
  misc_feature: GYAE6OF01EZOW2.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagcaactatttaaattggtatcagcatacccggggaagcccctaagttactgatctatgctgcagccaatttgcaagtgggtcccatcaagttcagtgcagtgatcgtggacagattcactctcacatccagcagtctgacaactgaagtattttaggaaagtacttattagtacaacagtaagttaacggtaaacttgacttactagttttcgggacgggtacgggtaccgtaagggtggtaagtaacgtaacgaaaaacggtaacgttaggtcggacgtacgaccgtacctattccgttcgttccttcgttacccg

SEQ ID NO: 127446 - DNA, 584 bp, Homo sapiens
  misc_feature: GYAE6OF01EMYQM.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtatagctaacttatttaaattggtatcagcacgtacccggggaagcccctaagttactgatctatgctgcagcctaatttgactaaaggtcgggtaccagtacgaaggttcgagtggacagtgatcgtaggacagacttcactctcacatacacgctagtctagacaaccgtagaagttagtttaaggaaattactattcgtacaacgtagtaacgttaacgaacttgaccttacgttaggttttaccgggacgggtaacgggtaaccgtaagggtacggtaaacgtaagtaacggaaaaggttacgttaggtcgggtactacggacctaaccgtattccgttacgttcttcgtaacccg

SEQ ID NO: 127447 - DNA, 798 bp, Homo sapiens
  misc_feature: GYAE6OF01DRPA8.49.64.F09.1.454.CMB.1.raw
  modified_base (217)..(217): a, c, t, g, unknown or other
  misc_feature (217)..(217): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatctatttggccgganaagtcagagtattagactaacttaatttaaattggtatcagacacgtacccggggaacgacccctaagttactgtatctagtgctgcacgactaatttacgacgtaaacgggtcgggtacccctagttaccgtaaacggtttcgaacggttcgggtacgtaaggttacgggtaacgttcggtaacggggtaaacctaacgggttaaactttacccgtaaacccttaccgttaacccgtaacccgtaactttaacccgaacggtaccgttaaccggttacccttacggtaaccccgtaaaacccgttaagggtaaaaccggttttaagggttttttaaaccgggaaaaacgttttaccgtttaacgtttaacggtaaacccttaaaacggtaacgggtttaaacgggtttaaaaccggttaaccgtttacggttaaccgtttaccggtttaacggttttacccggggaacggggtacgggtaaccggttaaagggtaggaaacgtacgtaaaacgtaaaaccggtaggttacggtacggactaccggactaaccgtagtttcctaggttccttccgtacccg

SEQ ID NO: 127448 - DNA, 862 bp, Homo sapiens
  misc_feature: GYAE6OF01BLQZW.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagacacgtacccggggaagtcccctaagttactgatctatcgctgacagacctaagtttcgacgtaaacggttggggtacccctagttaccgtaaacgggttcgtaggtgggacgtagggttacggagttccgtaggggaaccgtaaaggtaaacgtttacctaacctttaccgttacctaaccccgtaacttacccgtaacggtacctaacgggtttccgttaacggtaccccgtaaaaccgtttacggggtaaaacggttaacgtttttttaaacgggggaaaaaaccgttttaacgtttaaacggttttacccggttaaacgtaaaacccggttaaagggttaaaaccggttttaaacccggggtaaaaaccgtttttaccgggtaaccgttttaacccggtttaacgggtttttttaccccgggggaaccggggttaaacgggggtaaaccccgggttaaagggggttaacgggggtaaacggtaaaccggttaaaaccgtaaaaaacggggttaaccggttaacgggttacggggtaccgttaacgggtaaccctaacccgttaacgtttacccgtttaccggtttcccttttaaccgttacccccg

SEQ ID NO: 127449 - DNA, 862 bp, Homo sapiens
  misc_feature: GYAE6OF01D31G9.49.64.F09.1.454.CMB.1.raw
  modified_base (226)..(226): a, c, t, g, unknown or other
  misc_feature (226)..(226): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccactcccgccctgtctgctatctggtaggagacagacgtcaccatctagttcggccggganagtcagtagtatagactaacttaatttaagtggtatacgacgacgtaaccggtaaccccggggaacgtaccccttaaagttaccgtagtacgttacctagtcggtctacgaccgacgtaccgtaattacggaacgtaaacgggtcggtaacctaagtacgtaacggttactagggttcgacgtaggtcggtagtcgtacggaactaacgtacttacaccttcctaacctacgtacgtacaacggtctaacgtacccgtaggtaacccaaaggtttacggtaaaagttttaagggtttaaacggtaaacgtttaacgttaacgtttaaccggtaaacctaaaacgggttaaccggtttaaaacgggttttaaaaccccgggtttaaacgtttaccggtaaccggtttttaaccccgggtttaaacggggtttttcccgggggggaaaccgggggttaaaccgggttaaacccggggtaaaggggtttaaccgggtaaaaacgtaaaaccggtttaaaaaccggggttaaaaccggtaccggggtttaaggttacccgggttaacctaaacccggtacccgttaaccgtttaaccggtttcgtttaacccggtttacccgttccctttaaacccccgg

SEQ ID NO: 127450 - DNA, 581 bp, Homo sapiens
  misc_feature: GYAE6OF01B7UEU.49.64.F09.1.454.CMB.1.raw
  modified_base (457)..(457): a, c, t, g, unknown or other
  misc_feature (457)..(457): n is a, c, g, or t
  modified_base (565)..(565): a, c, t, g, unknown or other
  misc_feature (565)..(565): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatctagtttcggccgggacaagtcagtagtattagactaacttaatttaaattggtatcagacaacggtaccccggggaagtcccctaagttactgtatctatgctgcagtacctaagtttgacgtaaggtcgggtacccaagtacgaaggttcaggtgacgaggtggtacgtcgtagggactagtaacttcgactctacacatcagctacgtctacacaactagtaagttagttaaggaaattactattacgtanaacgagtagttaacgtaatcgtactacgtagtttacgggacggtacggaaccgtagggtagaacgtaagtaacgaaaagtacgtaggtacggactacgactactactnttcgttcgttctaccg

SEQ ID NO: 127451 - DNA, 681 bp, Homo sapiens
  misc_feature: GYAE6OF01C3NT0.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatctatttggccgggcaagtcagtagtattagactaaacttaatttaaagttggtatacgacgacctaacggtaacccccggggaacggtacccccgttaaggttaccgtagtaacttccttaagtcgtactgaccgtacgtaccttaagtttacggacgtaaagggtccgggtaccctaagtacgtaacggttcgtaacggtggtacgtaggtggtagtcggtagggaacctagtaacttactaccttctaccaccacgtacacgctaagtcctacgtaccaacgttaagaagtttagtttaacggaaattactagtttacgaacgtaagtaaggttaacgttaaaccggtaattcgtacgttacgttacgggtttacggacgggtacggtaaccgtaaggggtacgaagtacgtaaacgaaaacgtagttaggtacggacttcgacctaaccttacttacttacgttccttccgtacg

SEQ ID NO: 127452 - DNA, 781 bp, Homo sapiens
  misc_feature: GYAE6OF01BVB65.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagctaacttatttaaattggtatcagcacgtaccccggggaagcccctaagttactgatctatgctgcagcctaatttcgacgtaaaacggttcggggtacccctaagttaccgtaaagggtttaccgaaggttcgggaccgtaaggttcgggtaacgttaccggttacgggggaacctaaacggtaaacgttttacccaacccgttacccttacccgaaaccctaacgttaccgaacggtaccgtaacgttaccgttacggtaacccgtaaacccgttaaggtaaacggtttaacgtttttaacgggtaaaacgtttaaccgtttaagtttacggttaaccgtaaacgtaacggtaaacggtttaaaccgggtaaaccgtttacgtaccgttacgtttaacggtttttaccggggacggggtaacggggtaacccggtaaagggttacgggtaaacggtaacgtaaaccggtaaaaacggtaaccgttagggtcggtaccgtaccggtaccgtaacccgtacttaccgttcgtttaccgttaccgttacccg

SEQ ID NO: 127453 - DNA, 605 bp, Homo sapiens
  misc_feature: GYAE6OF01CC1CJ.49.64.F09.1.454.CMB.1.raw
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatctatttgccggganaagtcagagtattagactaacttaatttaaattggtatcagcacgtaccccggggaagtcccctaagttacngatctatgctgcagcctaatttgacgaaaggtcgggtacccagtcgaaggttcagtggacaggtggatcgtagggaacagtaaacttcaactctacacatcagcagtctgacctaacgtagtaacgttagttttaggaaattacttattacgtaactaaacgtagttaacgttaacggtaaacttcggtaccttactaaggttttcgggacgggtacggtaaccgtaagggtcggtaaagtaacgttaacgaaaacggttactacgggttcggacgttacgaacctaccttagtaccttacggttccttctaaccg

SEQ ID NO: 127454 - DNA, 564 bp, Homo sapiens
  misc_feature: GYAE6OF01AUQDD.49.64.F09.1.454.CMB.1.raw
  modified_base (287)..(287): a, c, t, g, unknown or other
  misc_feature (287)..(287): n is a, c, g, or t
  modified_base (385)..(385): a, c, t, g, unknown or other
  misc_feature (385)..(385): n is a, c, g, or t
  modified_base (543)..(543): a, c, t, g, unknown or other
  misc_feature (543)..(543): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatcccagatgacccagtctccatccgccctgtctgcatctgtaggagacagagtccaccagtcatttgccgggcaagtcagagtattagctaacgtatttaaattggtactcagcacgtaccccggggagcccctaagttacngatctatgctgcagcctatttgacaaggtcgggccagtcaaggttcagtgcagtggactcgtaggacagacttcactctacacctatcacgctagtcngaccaccgtagaaacgttgttttaaggaagttacgtattcggtacaacgtagtaacgttaacggtaacttgtactcgttagtttccggacggaggtaccgagggtggtaacgaagttaacgaaaagtaccgttaggtcggaccttggacctaaccgtnttaccgtcttccttacgtacc

SEQ ID NO: 127455 - DNA, 680 bp, Homo sapiens
  misc_feature: GYAE6OF01BUWY8.49.64.F09.1.454.CMB.1.raw
tcagagtcgagagacacgaccggtgctcgatttagcgcgtatacaagggggagtcagtctcagtcaggacacagcatggacatgagggtcctcgctcagctccgtggggctcctgctactctggctccgaggtgccagatgtgacatccagatgacccagtctccatcccgccctgtctgcatctgtaggagacgagagtcaccatctatttcggccgggacaagtcaagagttattagactaacttaatttaaagttggtatcagacgaccggtaccccgggaacgtcccctaaagttactagtactctagtgctgactacgacctaattcgacgtaaggtcgggtacctagtacgtaaggtcgtaggtggacgtaggtaggtacgtcggtagggtaacagtaacttcctacgtcctacacctactacagtacagttcgtacgacctaaccgtagtaacgttaacgtttaggtaaacgttactagttacgtaactaacgtaagtaacggtaaccggttaacttagttaccgttacgttacggtttacgggaccgggtaacgggtaaccggtaagggtagggtaaacgtaacggtaaacggaaaaggtaacggttcgggtacggtaccgtaacggtacccgtaaccgttaacgttcgtttacccgttaccgtttaacccg

SEQ ID NO: 127456 - DNA, 706 bp, Homo sapiens
  misc_feature: GYAE6OF01C2Q8K.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccatcccgccctgtctgcatctgtaggagacagagtccacctatctagtttcggccgggacaacggtcaaggaagttattaacgactaaacttaattttaaaagttggtaattacaagacgtaaccggtaaccccgggggaacgtaccccgttaaagttacctggtaactctatcgctgcacgacctaagttcgacgtaaagggtcgggtaccctagtacgtaaggttcaggtcggacgtaggttggtaactcggtaggtaactaggtaacttccacgtctacctaccactacgacgtacgtacgtcgtacgtacctaaccgtagtaaaggttacgtttaggtaaacttacgtagttacgtaactaacggtaacggtaacggttaaaccgtaacgttcgtaccgttaccgttacggggtttaccgggaccggggtaacgggtaaccgtaaggggttaacgaacgtaacgtaaacggaaaaacggtccgttagggtacgtaccgtcgtacctaccgtacgttacgttccgtcgttcgtacccg

SEQ ID NO: 127457 - DNA, 658 bp, Homo sapiens
  misc_feature: GYAE6OF01E4XS2.49.64.F09.1.454.CMB.1.raw
  modified_base (301)..(301): a, c, t, g, unknown or other
  misc_feature (301)..(301): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgaccagtctccatccgccctgtctgcatctgtaggagacagagtcaccatctatttgccggcaagtcagagtattagactaactaatttaaattggtatcagcacgtaccccggggaacgacccctaagttactgactctatccccgtntcgcgtacgaccgtaatttacgaacgtaaacgggttccggggtaccctagttacgtaaggttacgaggtggacgtaggtcggattcggtagggactaagtaacttccacttacctaccaacctactcgaacgtctagttcctacgacctaaccgtgtaaagtttattttaagggaaacgtttacttaagtttacgaactaacgtaaggttaacgttaacggtaaacttcggtctacgttacggtttacggaccgggaagggtaaccgtagggtaggtaaacgtaagtaaccggtaaaagtaggttcggtaggaccgttacgaccctaccgtattccggttcgttccttaccgtaccg

SEQ ID NO: 127458 - DNA, 731 bp, Homo sapiens
  misc_feature: GYAE6OF01CMYYM.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagacaactatttaaattggtatcagcacgtacccgggaaggccctaagttactgtatctatgctgcacgacctattttcgacgtaaacggtcggggtacccacgtacgaaacggtttcgaggttaggttaggtaggtagttcgtaaggggaactaagtaacttctaaccgttcctaccgaaccctataccgacgtactacggttactcgaaccctaaaccgtaggtaaacgttaaggtttttaacgggaaaagtttaaccgttaagttacggttaaccgtaaacgtaaggttaaacggttaacggtaaactttcgtacgttaccgttacgtttttaccggggacgggtaacgggggtaacccgtaaagggggtacgggtaaagtaaacggtaaaccgtaaaaaacggtaacgtttagggtacgggtacccgttacgggaacccttaacccggtaagtttacccgtttacggtttacccctttacgtaccttttaccccccggg

SEQ ID NO: 127459 - DNA, 709 bp, Homo sapiens
  misc_feature: GYAE6OF01EF75S.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatcgacccagtcctccatcccgccctgtctgcatctgtaggagacagagtcaccatcatttcgccgggcaagtcaggagttattagactaactaatttaaattggtatcagcaacgtaccccgggaacggcccctaagttactagtatctatgactcgcacgtactaagtttgacgtaacggtcgggttccccaagttacgaaggtttacgaggtaggtcgaaggttggacgttaccgtaggggaactaacggtaaactttccaaccgttaccctactaaccctattaccgaacgccgttaacggtccttaacggaaccgtaaaccgtagttaaaacggttaacgttttaacgggtaaaaagtttaccttaaggttaacgactaaacggtaacggttaacgtttaaccggtaaactttcggtacctttacgttaacgggtttccgggacgggtaaagggtaaccgtaaagggtacggtaaagtaaagtaacgtaaaagggtacggtgggtacggacgttaccgacgtaaccgtattacgttcgttaaccttcctaccg

SEQ ID NO: 127460 - DNA, 673 bp, Homo sapiens
  misc_feature: GYAE6OF01E2TQX.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggcctcctgctactctgctccgaggtcgccagatgtgacatccagatcgacccagtcctccactcccgccctgtctgctatcgtgtaggagacagtacgtaccaacctatactagtttcggaccgggtacaacgtcgaagtagttattagacctaacttaatttaaagttgtatcagacaaccggtacccggggaacgtaccccgtaagttacgtagactactatgtcgtgacacgtaccttaagttcgaagtaacggtccgggtaccagttacgtaaggttcaggtgcgtaggtagtacgtcgtaggataacgtacgttacacgttaccaccgtacctatccgacgctacgtctacgaacctacgtagtaagttagtttacgggtaaattacgttattagtaactaacgtaggtaacggttaaccgtaagttcgtacgtttacgttacggtttacggggaccgggtacgggtaaccggaagggtacgaacgtaacgttaacggaaaagttacgtagggtcggtaccgtagaccctaacgtactacgttcgttcgtaccgttaccg

SEQ ID NO: 127461 - DNA, 522 bp, Homo sapiens
  misc_feature: GYAE6OF01ED10V.49.64.F09.1.454.CMB.1.raw
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (485)..(488): a, c, t, g, unknown or other
  misc_feature (485)..(488): n is a, c, g, or t
  modified_base (491)..(492): a, c, t, g, unknown or other
  misc_feature (491)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(503): a, c, t, g, unknown or other
  misc_feature (502)..(503): n is a, c, g, or t
  modified_base (505)..(505): a, c, t, g, unknown or other
  misc_feature (505)..(505): n is a, c, g, or t
  modified_base (507)..(508): a, c, t, g, unknown or other
  misc_feature (507)..(508): n is a, c, g, or t
  modified_base (510)..(510): a, c, t, g, unknown or other
  misc_feature (510)..(510): n is a, c, g, or t
  modified_base (512)..(514): a, c, t, g, unknown or other
  misc_feature (512)..(514): n is a, c, g, or t
  modified_base (518)..(521): a, c, t, g, unknown or other
  misc_feature (518)..(521): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatcgacccagtctccatcccgccctgtctgcatctggtaggagacagagtcaccatcatttgccggacaagtcagagtatagactaacttaatttaaagttggtatcagcaacgtaaccccggggaagaccccttaagtactgatctatgctgcagcctaatttcgacgtaaaggtcgggtacccagtacgtaaggttcaggtagctaggtgtagtccgtagggaactaaagntcatctcactacgcagccagtcgtanacgtaacngtaagttagtttaagaagtactaggttactacaacgtagtaagttaaccggtaactttaggtacccnnnncannananananannanannanannnacannnna

SEQ ID NO: 127462 - DNA, 594 bp, Homo sapiens
  misc_feature: GYAE6OF01A24Q0.49.64.F09.1.454.CMB.1.raw
tcagagtcgagagacacgaccggtgctcgatttagcgcgtatacaagggggaggtcagtctcagtcaggacacagcatggacatgagggtcccgctcagctcctggggctcctgctactctggctccgaggtgccagatgtgacatccagatgacccagtctccatccgccctgtctgcatctgtaggagacagagtcaccatcatttggccggcaagtcagtagtatagctaacttatttaaattggtatcagcacgtacccggggaacgtaccccgtaagtactagatctatgctgacagacctaagttcgactaaaggtcgggtacccagtcgtaaggttcaggtcgacgtaggtcggattcgtaggaactatacgtttcacgttcctacaccgatcgaagcctagtctagacctaacgtagtaattacgtttaaggaaacttagtattagtactaacagtaacgttaacgtaacttcgacttacgtacgtttacgggacggtacgggtacctaagggtagtacgaagttaacgaaaaggtacgtggtacggtactcgaccctacgtacttacgtcgttcttcgtaacccg

SEQ ID NO: 127463 - DNA, 778 bp, Homo sapiens
  misc_feature: GYAE6OF01D0E8J.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctgactccgaggtgccagatgtgacatccagatcgacccagtctccactcccgccctgtctgcatctgtaggagacagacgtcaccatctatttcgccgggacaagtcagtagttattagactaacttatttaaagttggtatcagacacggtaaccccggggacgtacccctaagttactgatctagtcgctgcacgacctattcgaacgtaaacggtcgggtacctagtacggtaacggttcgaggtcggacgtaggtaggtacgtcggaaggtacgaacgtaacgttcctaaccttcctaacctacctacgtaccgtacgtaccgtacgttaccgtacgaccgttaaaccgtaaggttaacggttttaacgttttaaacgggaaaacttttacgttacgtttaaccgtaacgtaaaccgttaacgggtttaaacggtttaaaccggttaaccgttttaccggtaccgtttaacggtttaacggggttttacccggggaaccggggtaaaccggggtaaccggttaaaggggtaccggtaaaggtaaaccttaaaacgggtaaaaacggtaccggttacgggtaccgggtacgttaccgaaaccccgttaaccggttacttaccgggttttacccttacccgttaccgttaaccccg

SEQ ID NO: 127464 - DNA, 865 bp, Homo sapiens
  misc_feature: GYAE6OF01C2NO4.49.64.F09.1.454.CMB.1.raw
tcagagtcgagagacacgaccggtgctcgatttagcgcgtatacaaggggggagtcagtctcagtcaggacacagcatggacatggagggtccccgctcagctccgtggggctcctgctactctggctccgaggtcgccagatgtgacatccagatcgacccagtcctccatccgccctgtctgcatctggaggacgacaggactaccacctatcgtaagtttcggaccgggactaaacgtcgaagtaaggttaattacgaactaaactttaattttaaaagttggtaactacgtaacgacgtaaccggttaacccccgggggaacggtaacccccttaaaggttaaccgtagtaacggtttacttaacgttcggtacgtacgaccgtaacggtaccttaaagttacgaaacggtaaacgggttcggggtaacccctaagttacggtaaacggtttcgaggttcgggacgaacgggtagtaacgtacggttaacgggaacctaaggtaaacctttcctaaccttacctaacccaactaacgtaccgtaacgtacgtacgtacctacgaacctaaaccgtaaggtaacgttaacgggttttaaaggtaaacgttaacgttagttaaccgtaaacgtaacggtaaggttaaacggtttaaaccgaaacgtttccgtaaccgtttacggttaaccgggtttaccggggaaccgggtaacggggttaaaccggaacggggttaacggaaacggttaaaactaaaaccgggttaaaaaacgggacggtttaagggtcccggtaaacggttacccgaacccgtaaccgttaaacgtttcccgttaaccggttacccttccgttaaaccccg

SEQ ID NO: 127465 - DNA, 659 bp, Homo sapiens
  misc_feature: GYAE6OF01AWNS8.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccatcccgcctgtctgcatctgtaggagacagacgtccaccatctagtttcggccgggacaagttcaagtagttattagactaaacttaatttaaagttggtatacagacaacggtaccccggggaagtaccccgtaagttactgtatctagtgctgcagacctaattgacgtaaaggtcgggtaccagtacgtaaggttcaggtggacaggtggatcggtagggaactaagtaacttcgactctaccaacctatcgagcagtctacgacctaactaggaaagttagtttaaggaaattaccttaagttcgtaactaacgtaaggttaacggttaacggtaaacttgtacttacgttaacgttttcgggacgggtaacgggtaaccgtaaaggggtaggaaacgtaacgttaaaccggaaaaagtaacggttacgggtacggtacgtacgtacctaaacccgtatttaccgttacgtttcccttacgttaacccg

SEQ ID NO: 127466 - DNA, 639 bp, Homo sapiens
  misc_feature: GYAE6OF01E1UBG.49.64.F09.1.454.CMB.1.raw
  modified_base (411)..(411): a, c, t, g, unknown or other
  misc_feature (411)..(411): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccactcccgcctgtctgcactctaggtaggacgacagacgtccaccatctagtttcggccgggacaagtcagtagttattacgactaacttaatttaagttggtactacgacgtaccgtaaccggtaaccccgggggaacgtaccccgtaagttacgtagtactcgtagtacgctacgacacgtacctaagttcgaacgtaaggtccgggtacctagtacgtaggttcaggtgacgtagtcgatcggnggactagtaactcactcacacatacgacgtctacgtcacgacctaacgtagtaagttagtttaacggaatttactagttacgaacgtaacgtaggttaaccgttaacggtaacttcgtacgtacgtttacggttaccgggaacggtacgggaaccgtagggtacgagaacgtaacgtaaacggtagtacggtcgactagaccctacgtactccttcgtcttactaccg

SEQ ID NO: 127467 - DNA, 613 bp, Homo sapiens
  misc_feature: GYAE6OF01BIEKF.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatcccgccctgtctgcatctgtaggagacagagtcaccatctagtttggccgggcaagtcagtagtattagctaaacttatttaaattggtatcagccacgtaccccggggaagccccttaagttactgatctatgctgcagtacctaatttgacgtaaaggtcggggtaccagtacgaaggttcaggtggacgagtcggatacgtagggacacgtaattcgacctctaccaactacgtacacgctacgtctacgaccgtaaccgtagtaagtagttttaaggaaacttacttattcgtacaacgtagtaacgtttaacgaactttcgacttacgtacgttttacgggacgggtaacgggaaccgtaagggtacgggaagtaacgtaacgtaaaaggtacgtaggtcggacttacggactaccgtaattcgtactccgttcctacccg

SEQ ID NO: 127468 - DNA, 680 bp, Homo sapiens
  misc_feature: GYAE6OF01D942K.49.64.F09.1.454.CMB.1.raw
tcagagtcgagagacacgaccggtgctcgatttagcgcgtatacaagggggagtcgagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggacagtcagagtatagactaacttaatttaattggtatacagcaacgtaccccggggaacgaccctaagttactgatctatgctgcagactaagtttagacgtaaggtcgggtacctagtacgtaacggttcgaggtggacgtaggtaggtacgtacggtagggaacgtaaggtaactttaccgtaaccttcctaccaacccttagtaccgaacgtacctacgttcgtaccgacgtaaacccgttaaggttaaacgtttaggtttttaaacggaaaaagtttaccttaagtttacgtaactaaacgtaaggtaaacgtttaaccggtaaatttcgacctttaaccggttaggttttaccggggacgggtaacgggtaaccggtaagggtacggaaagtaacgtaaacgaaaaggtacgtagggtcgacgttcgacctaaccgatttacgtccgttcttcttaccccg

SEQ ID NO: 127469 - DNA, 733 bp, Homo sapiens
  misc_feature: GYAE6OF01D2WRM.49.64.F09.1.454.CMB.1.raw
tcagagtcgagagacacgaccggtgctcgatttagcgcgtatacaagggggagtcagtctcagtcaggacacagcatggacatgagggtccccgctcagctccgtggggcctcctgctactctggctccgaggtgccagatgtgacatccagatcgaccagtctccactcccgcctgtctgcatcgtaggtaggacacgaggtactaccacctatctagtttcggaccgggactagtcagtaagttattagacttaaacttaagttttaaacgttgtaactacgaggaaccgtaaccggtaacccggggaaccgttaccccgttaagttaccgtgtacgtttacgtacgttacggcgttacgaccgtacgtaaccgttaacgtttacggaaacggtaacggggttccggtaaccgtagtaaccggttaacgttacggtaggtacggtagtagggtacgtacggtacggtacgggaattacgttacctctacctacgtaccaccgtactacgacgacgtacgtacgtacgtaacgtacgtaacgttaacgttaagtttaagtaacgttaacttagtacgtaacgtaacgtaacgtacgtaaccgttaacttacgtacggttacgttacggttcgggtaaaaaacggtcggaacggtaggtacggtagtaactaaacggtaacgtaggtaggtaccgtacgtacgactacgtacttacgtacttcgttctacccg

SEQ ID NO: 127470 - DNA, 705 bp, Homo sapiens
  misc_feature: GYAE6OF01EDF7R.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccactcccgccctgtctgcatctgtaggagacagagtcaccatctatttcggccggacaagtcagagttatagactaacttaatttaaagttggtatcagacgaacggtaaccccggggaacgtaccccgttaaagttacgtagactacgtatgctgcacgtactaatttgaacgtaacgggttcggtacctagtacgtaacggttcgtaggtggacgtaggtggtacgttacggtaggaactaagtaacttcgaccttacctaccgaacctataccgaacgtctacggtactacgaacctaacgtaaggtaacgttagtttaaggtaaacttacgttacttacgtaacgtaacgtaaggtaacggttaaccgtaacgttcgtaccgttacggttacggttttaccggggacgggtaaacgggtaaccggtaaaggggtacggtaaagtaaacggttaaacggtaaaacggttaacggtaggttacggaacgttaccgaccgttacgtacttaccgtttacgttaccgttccgttaacccgg

SEQ ID NO: 127471 - DNA, 743 bp, Homo sapiens
  misc_feature: GYAE6OF01EBTUL.49.64.F09.1.454.CMB.1.raw
tcagagtcgagagacacgaccggtgctcgatttagcgcgtatacaagggggagtcagggtctcagtcaggacacagcatggacatgagggtccccgctcagctcctggggctcctgctactctggctccgaggtgccagatgtgacatccagatgacccagtctccatccgccctgtctgcatctgtaggagacagagtcaccatctatttcgccgggcaagtcagtagttattagactaaacttaatttaattaggttatacgacgaccgtaaccggtaaccccgggggtaacggtacccccgttaaaggttaccttggtactactagtcgtctgaccgacgtaccttaagtttacgaacgtaacgggtaccgggtacctagtaccgtaaggttacgaggtcggtagaggtaggtacgtacggtacggtaactacgtacgttacctacttaccgtaccaacctataccgacgtacgtacggttacctacgtacccgtaaacgtggttaaaggtttacgggttttaaacgggtaaacgttactttaggtttaaccgtaacgtaacgtaaggttaacgttaaactaacggttaaaccgttccggttactttacgggttaacggtttcgggggaaccgggtaacggggtaccgttaaagggggtacggaacgtaacgtaaaacggtaaagtacggttgggtacgtacttaccggacctaacgtaccttcgttctccgttaacccg

SEQ ID NO: 127472 - DNA, 766 bp, Homo sapiens
  misc_feature: GYAE6OF01BIMIF.49.64.F09.1.454.CMB.1.raw
  modified_base (93)..(93): a, c, t, g, unknown or other
  misc_feature (93)..(93): n is a, c, g, or t
  modified_base (701)..(701): a, c, t, g, unknown or other
  misc_feature (701)..(701): n is a, c, g, or t
tcagagtcgagagacacgaccggtgctcgatttagcgcgtatacaagggggagtcagtctcagtcaggacacagcatggacatgagggtcccnctcagctccgtggggcttctgctactctggctcggaggtgccaggtatgtcgacactccgaagactgacccagtctccacgtccgcctgtctgcatctggtagacgacacgacgtccaactactactagtttcggaccgggtactaacgtacgaagtaagttacttacgactaacgtttaaatttaaagttcggtaacttacgagtaccgtaacggtaaccccgggtaacgtacccgttaaacggtacgtacgtaacttacgtacgttcggtacacggtacgtacggtaaccttaagtttacgaacggtaaacgggttcggtaaccgtacgtacggttaacggttcgaggtacggtcgtaaggtaggtaacgttcgggtacgggaaacctaggttacccttagtacccttacgaccttaacgctacgtaacgtacgtacggttacaacgtacctaagtacgttaaagttacgttaaggaacttactaatacgtaacaagtaggttaacgtaaccgtaactcggtacttaccggtttaggttacccgggaaggtaaccggtacgtaaacgggtggaaacgtaaactaacgggtaaacgttaccgggtancgggttacccaacggaaacccgttaaccgtgtttacccggttagtttccccctaagggttacccc

SEQ ID NO: 127473 - DNA, 649 bp, Homo sapiens
  misc_feature: GYAE6OF01EIRJU.49.64.F09.1.454.CMB.1.raw
  modified_base (435)..(435): a, c, t, g, unknown or other
  misc_feature (435)..(435): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccatcccgccctgtctgcatctagtaggagacagagtccaccatctatttcgccgggacaagtcagtagtattagactaattatttaaattggtatcagcaagtaccccgggaagaccccttaagtactagatctatgactgacagtacctaatttgaacgtaaaggtcggggtaccccaagttaccgaaggtttcgaggttaggacgtaggttacggataccggtagggaactaaggtaactttccaacttcctactaaccatacaacgntacgtactacgacaaccgtaagtaacggttagttttaaggtaaacgttataacgtttagtaacgtaaacgtaggttaacgttaaacgggtaacttagtcgttacgttaggtttacggacgggtaacggaccgtaagggtagaagtaacgtaaagaaaacggtataggtcgtacgtacgaacgtaccttaactacggttcttacgttcgtaaccg

SEQ ID NO: 127474 - DNA, 673 bp, Homo sapiens
  misc_feature: GYAE6OF01CSLBS.49.64.F09.1.454.CMB.1.raw
  modified_base (219)..(219): a, c, t, g, unknown or other
  misc_feature (219)..(219): n is a, c, g, or t
tcagagtcgagagacacgaccggtgctcgatttagcgcgtatacaaggggggagtcagtctcagtcaggacacagcatggacatgagggtccccgctcagctccgtggggctcctgctactctggctccgaggtgccagatgtgacatccagatgacccagtctccatcccgccctgtctgcatctgtaggagacagagtcaccatcatttgccggganaagtcagagtattagactaaacttattaaattggtatcagacacgtaacccgggaacgtaccccgtaagttactgtatacttatgctgacacgacctaatttcgacgtaaaaggtcggggtaccctataccgtaaaggttcaaggtcggacgtaggtggactcgtaggggacctaaggtaattaccaacctcgtaccaaccgataccagacctacgtacgtacgaccaaaccgtaggtaaagttaagttttaaggtaaaacttacgttagttaacgtacaaacgtaagtaacggtttaaaccggtaacttagttaccgtacgttacggttttacgggaacgggtaacgggtaaccggtaaagggttaggaaaggaacgttaaacgaaaaacgtaaggtacggtacgggtacctacggaactaccgtaacttccgttacttccgttcctaacccg

SEQ ID NO: 127475 - DNA, 673 bp, Homo sapiens
  misc_feature: GYAE6OF01CK9VL.49.64.F09.1.454.CMB.1.raw
  modified_base (227)..(227): a, c, t, g, unknown or other
  misc_feature (227)..(227): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtcgccagatgtgacatccagatcgacccagtctccatccgcctgtctgcatctgtacggagacagtacgtcacctatcgtagtttcggaccgggnaagtcagtagtattacgactaacttaatttaaacgttgtaatcgacgacgaaccgtacccggggtaacgaccccgttaagtacgtgtatacgtatcgtccgtagacgtagtacctaagtttcgaacgtaaggtcgggtaccaagttcgaacggtttcaggtgtacgtaggtcggtatacggtaggaacctagtaattccgtaacttccacctactacgtacgacggactacgtactacgtaccaacgttagaacgttagtttaacgaaacgttactagttacgacgtaacgtaggtaacgttaacgtaacttagcgtttacgtaggtttacgggaacggtacggacgtaacggtaggtaaaccgtactaaaaggtaaacgagttacggtcggttaacgacgtaacccttactaacggtttcgtaacctttcttacccgttaaccgg

SEQ ID NO: 127476 - DNA, 776 bp, Homo sapiens
  misc_feature: GYAE6OF01BIX99.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtagagacagagtcaccatctagttcgccgggactaagtcagtagtattagactaacttaatttaaagttggtatcagcaccgtaaccccggggcgtaaaaaaaacccctgttaactgactactatcgctcgctacgcctaagttacgacgtaaacggttcggggaccctagtaaccggtaaggttactaggtcgggactagggtaggtacgttcggtaagggtaacacgggtaaattcccgtaccttacgtaccgtaccctacgttaccgaacggtccgttaacgttacccgttacgaaccgtaaccgtaacggttaaacggtttaaggttttaaacggtaaagtttaacgtttacgtttaacggtaccttaaaccggtaagttaaccggttaaacggttaaccgttacgttacccgtttaacggttaccgggttttaccggggaacgggttaaccggggtaaccgggttaaaggggttacgggtaaaggtaaacggttaaaccggtaaaaacggtttacgtaccgggttcggtaccgttaccggacttaacccgtaacggtttcctttacggttccgttccgttaaccccg

SEQ ID NO: 127477 - DNA, 741 bp, Homo sapiens
  misc_feature: GYAE6OF01BYPL6.49.64.F09.1.454.CMB.1.raw
  modified_base (399)..(399): a, c, t, g, unknown or other
  misc_feature (399)..(399): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtgtccagatgtgacatccagatcgaccagtctccactcccgcctgtctgctatctgtaggagacagacgtcacctatctagtttcggccgggacaagtcaaggagttataacgactaaacttaatttaaagttggtatacagacacgtaaccccggggaagtccccgtaaagttacgtgtatctagtgcgtgacacgtactaattagacgtaacggtcggtaccaattaccgaggttacgagtaggacgtaggtacggtagttacgnggaacgtaagtaaacttaccgaacgtcctacgaccttaacgtcacggacttaacgtacgtaccgacgaaccgttaaaggaattttaggttaaacggtaaagttacgtttagttacgtaacgtaacgtaaggttaagtaaccggttaaacttccgtacgttcggtttaaacggtttcccggggaacggggtaccgggtaaacgtaacggggtaaagggtactaaaaccgggttaaacgtaaaaacggggttacggttaccggaacggtttacccggtaacggacccccgttaaataccggtttttacccgtaaggtttcccttaacccgttttaacccccggg

SEQ ID NO: 127478 - DNA, 667 bp, Homo sapiens
  misc_feature: GYAE6OF01D69AR.49.64.F09.1.454.CMB.1.raw
  modified_base (649)..(649): a, c, t, g, unknown or other
  misc_feature (649)..(649): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatccgccctgtctgcatctgtaggagacagagtcaccatctatttcgccggacaagtcgagtagttattagactaaacgttaatttaagttggtatcagacaacggtaacccggggaacgtaccccgtaagttactagattctatgctgacacgtacctaattgacgtaagggtcggtacccagtccaaggttcgagtcggcgagtaggtatacggtaggaacagtacttacacgttacctaaccgacctaagtccgtaacgtcgtacgtaccttacgaaccctaaacggtaggttaaagtttagttttaaaggtaaaacgttactttaaggtttaccgtaacgtaacggtaaaggtaacggtttaaacgtaaccgttgtaccgtttacgttacggtttacccgggagggtaaccgggtaaccggtaagggtcgaaaggtaactaaacggaaaacgtagttggtacggctagaccctagacttntaccgttctacgtacccg

SEQ ID NO: 127479 - DNA, 685 bp, Homo sapiens
  misc_feature: GYAE6OF01B1S8X.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcagtaccccggggaagccctaagttactgatctatgctgcagaccaatttgacaaaggtcgggtacccctaatacgtaaaggttcaaggttggactaggtaggatcgtagggaacagtaaacttcaacttacctccaacctatacgacgacaagtcctagaaccaacccgtagtaaacggttaatttttaagggaaaacttaacttaatttacggtaacctaaacgtaagtaacggtttaaaccggtaaaacctttgtaccttacgttaacgtttttaccgggaacggggtaacgggtaacccgtaaaggggttaaggaaacggtaaaacgttaaaccggtaaaaaaacggttaaacgttacggggttacggtacccgttagaacccgtaaaccctacgtttaccgttcggttttaccgttacccttaacccgg

SEQ ID NO: 127480 - DNA, 675 bp, Homo sapiens
  misc_feature: GYAE6OF01DPJZC.49.64.F09.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (578)..(578): a, c, t, g, unknown or other
  misc_feature (578)..(578): n is a, c, g, or t
tcagagtcgagagacacgaccggtgctcgatttagcgcgtatacaagggggagtcagtctcagtcaggacacagcatggacatgacgggtccccgctcagctcctggggcctcctgctactcgtggccgtccggaggtcgccagtatggtcacatccgaagactcgacccagttcctccactcccgtcctgtctgcatcgtagaggganacgagtacncaacctatcgtattcggccggganaacggtcagagttatacgacttaaactaagttttaagtggtactacgaagtaccgaaccggtacccggggacgtaacccgtaaggttactacgtataccgtagtacgtcgtagtaccaagttacctaaggtttcgaaccggtaaacgggtccgggtaaccaagttacggtaacggttaccgaggttcggacggacggttaaggtcggttacggtacggaagtacgtaacttacggtacctccttaaccacgtactacgaacgtcgtaacggctaacgactaacgttagtaagttacgttaagtacgttatatactaacaagacgtaagtagttacncgtactagtacgttacggacgtacgacggtagtcgtaagacgtaagaaaccgtagcggtacgacttacgacctagttctacgtactttctcgttacc

SEQ ID NO: 127481 - DNA, 810 bp, Homo sapiens
  misc_feature: GYAE6OF01DY5PB.49.64.F09.1.454.CMB.1.raw
  modified_base (436)..(436): a, c, t, g, unknown or other
  misc_feature (436)..(436): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtgccagatgtgacatccagatcgacccagtctccacgtcccgccctgtctgctatctgtaggagacagagtcctaccgtctagttcggccggacgtagtacgagtaagttattagactaaattaattttaagttggtatcgagacgaacggtaacccggggaacgaccccttaagttactgtatctagtgcctagacacgtaccttaattcggtacgtaaacggtcgggtaccacgttacgtaaggttccgagtaggtaccgtagtacggatttaccgggagggtaaccgaagtactttacccncgttaccaccgtaacctactaccaggtactacgtacgttccggaaaccttaaccgtaaggttaaacgttaaaggtttaagggtaaaccttttaaccggttattacggtaaaccgttaaagaacggttaaacgggtttaaccggttaaaaccgtttcgacgttttaaccgggtttacgggtttaacccggggtacggggtaaccggggtaaacccggtttaaaggggtaggtaaacggtaaccggtaaaaacggtaaaaacccggttaggggtttaaccggtcgggaaccgtttaacccggaaacccttaacccggttaacgttaccccttttaaggttttcccccaaaacgggttttccccttaaacccccggg

SEQ ID NO: 127482 - DNA, 675 bp, Homo sapiens
  misc_feature: GYAE6OF01DCIDN.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccactccgccctgtctgcatctgtaggagacagagtcaccatcatttcggccgggacaagtcagagtattagactaaacttaatttaaattggtatacagaccaacgtaccccggggaagacccctaaagttctgatctatgctgcacgctaattgacgtaaaggtcgggtaccagtacaaggttcaagtggacagtggatcgaggacagaacttcactctacactacgtacacgactacgtactacgacctaaaccgtaaggtaagtttaacggttttaaggaaaacggtttacttagtttacgtaaacccgaaacgttaagggttaacgtttaaacgggtaaacctttcggtaacctttacggttaacggttttccggggaacggggtaaaccgggtacggtaaagggttacgggtaacgtaaataaaccggtaaaaaggttaacgttcgggtaacgggactacggtaacctaaccgttacttaccgttcgtttacccttcgttaacccg

SEQ ID NO: 127483 - DNA, 687 bp, Homo sapiens
  misc_feature: GYAE6OF01ANVVH.49.64.F09.1.454.CMB.1.raw
tcagagtcgagagacacgaccggtgctcgatttagcgcgtatacaaggggggagtcagtctcagtcaggacacagcatggacatgaggggtccccgctcagctcctggggctcctgctactctggctccgaggtgccagatgtgacatccagatgacccagtctccatcccgccctgtctgcatctgtaggagacagagtcacatcatttcgccgggcaagtcagagtatagacaacttattaattggtatacagcacggtaccccggggaacggtacccctaagttactgtatctatgctgcagacctaagtttcgacgtaaaggttcggggtacccctagtacgtaaacggttcaggtgggtacgtaggtgggtacgttcggtagggtaactaagtaacttaccgacttacctacaacccgtatacacgtctaacggtcctacggaacctaccgtaaggttaaacggttagttttaacgggaaaactttaccgtttaagtttacgtaacctaaagtaacggttaacggttaaaccggtaacgtttgtaccgttacgttacggtttacgggaccgggtaacgggtaccggtaagggttacggaacggtaaacgtaacgaaaacggttacggttaggtacggtacctacgaccttaccgtattcccgttagttcccttcgttacccg

SEQ ID NO: 127484 - DNA, 835 bp, Homo sapiens
  misc_feature: GYAE6OF01EW6NJ.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggttccagatgtgacatccagatcgacccagtctccactcccgcctgtctgctatcgtggtaggagacgagacgtcaccatcctagtttcggccgggactaaacgtcaggaagttaattacgacctaaatttaaatttaaaagttcggttaactcgaacgaccgtaaccggtaaccccggggggtaaacgtacccccgtttaagttaactcggtaattacgtaagttcgtacgtcgacgaacgtacctaaagttttcggaaacgtaaagggttccggggttaccctaagtacgtaaacggttccgtaaggttcggtacgtagggtaggacgttcggtaacgggaaccgtaaggtaacttaccgtaccttacccgtaccaacgtacttaccgacgtacctacggttactaccggtaaccttaaacggtaaggttaaaggtttaacgttttaaacggggtaaactttaaccgttaacgtttaacgtaacctaaaccggtttaaaggttaaccggttaaacggtttaacttaccgtaccgtttaacggtttaaccgggttaccgggggtacgggaaaccgggtaacgggttaacgggtaaaggtaacgtaaaccggtaaaggttaaaaaccggtcgtagggttaccggtactacgggaaccctaaccggtacttcgtaaccggttttccttcgttaacccgtttccccg

SEQ ID NO: 127485 - DNA, 759 bp, Homo sapiens
  misc_feature: GYAE6OF01CSMZW.49.64.F09.1.454.CMB.1.raw
tcagagtcgagagacacgaccggtgctcgatttagcgcgtatacaaggggggagtcagtctcagtcaggacacagcatggacagtgacgggtccccgctcagcctccgtggggctcctgctactcgtggctccggaggtcgccagtatgtgacataccagactcgacccagtcctccatcccgccctgtcagcatcgtaggaggagacagtacgtacaacctagtccgttaagtttccgggacccgggtacaaaggtaccaagggtacgttaatttaacgaaccttaaacgtttaaattttaaaaggtttggttaactacgaacggtaccgtaaccggggtaaccccgggggaacggtaccccttaaagtttaccgtagtaacttacgtagtcgcgtaggacaacggtactaagtttcgaccgtaacgggtcggtaccagtacgtaacggttcaggtcgagaggtcgtacgtcggaggacctaagtacttacacttcacaccagtaccgagacctagtacagtaaccgtaacgttagtaaggtttaacggtttaggaaaactttcttaagtttacggaaactaacgggtaacggtttaacggttaacccgtaagtttccgtacgtaccgggtttaagggttcggggaaaccgggtacgtaaacgggtaggtacgggaaataacgtaaacggaaaacggtcggtaatccgggaacttaccgacctactttacggtgttaacccgttccttaacgtcccgg

SEQ ID NO: 127486 - DNA, 708 bp, Homo sapiens
  misc_feature: GYAE6OF01BST2U.49.64.F09.1.454.CMB.1.raw
  modified_base (146)..(146): a, c, t, g, unknown or other
  misc_feature (146)..(146): n is a, c, g, or t
tcagagtcgagagacacgaccggtgctcgatttagcgcgtatacaaggggggagtcagtctcagtcaggacacagcatggacatgagggtcccccgctcagctcctggggctcctgctactctggctccgaggtgccagatgtganatccagatcgacccagtcctccactcccgccctgtctgcatctggtaggagacagacgtcacctatctagtttcggaccgggactaagtcaggtaacgttagtaacgtactaaaactttaaattttaaacgttggttaactacgtaacgacctaaaccgggtaacccccgggggtaacggtaccccgttaaagttacgttagacttctagtcgtctgacgtacgtacctaatttacggacgtaaacgggttccggtacctacgttaacgtaacggttacgtaggtacggtacgtaggtggtacgtcggtaagggacgtacgtaaacttcctacgtcctaccgactacactacgactacgtacttcgaacctacgtagtaacgttagtttaacgtaacttagtacgtttacgacgtaacgtaacggtaaggttaaccgttaaggttctcgttaacgtttcgggttaacggtacggggaacgtacggtaaggacggtaacgtaaagtaacgaaagtgtaggtcgactcggaacctactacgttccgtttctacgttcctaaccg

SEQ ID NO: 127487 - DNA, 664 bp, Homo sapiens
  misc_feature: GYAE6OF01BHKA1.49.64.F09.1.454.CMB.1.raw
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
tcagagtcgagagacacgaccggtgctcgatttagcgcgtatacaagggggagtcagtctcagtcaggacacagcatggacatgagggtcccccgctcagctcctggggctcctgctactctggctccgaggtgccagatgtgacatccagatgacccagtctccatcccgccctgtctgcatctgtaggagacagatcaccatcatttgccgggcaagtcagagtattagcaacttattaattgtatcagacacgtacccgggagcccctaatacnatctatnctgcagtccagtttagacgtaaaggtcgggtaccctagtacgtaaggttcgtaaggtgacgaggtaggtacgtacgtaggggaaccaagttaaactttaccgaacctttacctaccgaaccctagtccaagaccgtaagttcctacggaaccttaacggtacgtaaagttaacgttttaagggtaaaacgttacgttaagttacgtaccgtaaactacgggttaacgttaaccggttaaacttcggtacctttacgttacggttttacgggaaccggtacgggtaaccgtaagggttacggaagtaacgtaaacgtaaaacggtaacgtggtacggtactaccggacctaaccgtagttacttcgttccttactaacccg

SEQ ID NO: 127488 - DNA, 671 bp, Homo sapiens
  misc_feature: GYAE6OF01E44FB.49.64.F09.1.454.CMB.1.raw
tcagagtcgagagacacgaccggtgctcgatttagcgcgtatacaagggggagtcagtctcagtcaggacacagcatggacatgagggtcccccgctcagctcctggggctcctgctactctggctccgaggtgccagatgtgacatccagatcgacccagtctccatcccgccctgtctgcatctgtaggagacagagtacaccatctagtttcggccgggcaagtcaggtagttattagactaaacttaattttaaagttggtatacgagacaaccggtaacccccgggggaacggtacccccgttaagttactgtatctatgctgcacgacctaagtttgacgtaaacggtcggggtacccagtacgtaaggttacgaggtcggacgaggtgggacttcggtacgggacaggtacgttcaaccttctacctaaccactacgacgccacggtcctggactacgtacgtagtaagttagttttacgtacgtttaagttttactttacgttcgtacgaacggtacgttaacgttaacttaagtttaccggttcggtttccgtttcggttttaccgggaccggtaaccggggtaaccgtaacgggtcgtagggtacgtacgtacgaaacggtacggtaacgtcggtaggtcctacgacctaccgtagttccg

SEQ ID NO: 127489 - DNA, 692 bp, Homo sapiens
  misc_feature: GYAE6OF01CD5XG.49.64.F09.1.454.CMB.1.raw
  modified_base (342)..(342): a, c, t, g, unknown or other
  misc_feature (342)..(342): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtgccagatgtgacatccagatcgacccagtcctccactcccgccctgtctgacatcgtggtagagacagacgtcaccatcagtttcggaccgggactaagtcagtagtattagacttaattaatttaagttaggtatacgacgtaccgaaccggtaaccccggggaacgtaccccgttaagttaccgtagtaattccgtagtcgccgtanaccgaacgtacttagttacgtaacggtacgggtaccgggtacctagtacgtaaccggttgacggtggtacgagtggtacgttcggaggtaactacgtactactaacccgttactaccacctacgtaccgtacgaccttaggtacctacgaaccgtaacgtaagttaacgtttagtttaaacgttaaacgtactttacgtaacgtactaaacggtagttaaacgggttactaacgttcgtaccgttagtttaccggttacgggaccggtaagtaaccgggaggtagactaaacggtaagtaaacgtgtacggtgacctacgacttactacttagtccttcgtcccttaccg

SEQ ID NO: 127490 - DNA, 727 bp, Homo sapiens
  misc_feature: GYAE6OF01BS51A.49.64.F09.1.454.CMB.1.raw
  modified_base (133)..(133): a, c, t, g, unknown or other
  misc_feature (133)..(133): n is a, c, g, or t
  modified_base (141)..(141): a, c, t, g, unknown or other
  misc_feature (141)..(141): n is a, c, g, or t
  modified_base (199)..(199): a, c, t, g, unknown or other
  misc_feature (199)..(199): n is a, c, g, or t
  modified_base (718)..(718): a, c, t, g, unknown or other
  misc_feature (718)..(718): n is a, c, g, or t
tcagagtcgagagacacgaccggtgctcgatttagcgcgtatacaagggggagtcagtctcagtcaggacacagcatggacatgacgggtccccgctcagctcctggggctctgctactctggctccgaggtnccagatgngacatccagatcgaccagtctaccatccgtcctgtactgacattcagggtacgacganagacgtaccactaatctaggtttcggcgggtactaagcgaagtagttactaacgacttaaattagtttaaacgttaggtaatcgaacgtaccgtaaccgggtaacccgggtacgtaaccccgttaagtacgtacgtactacgtagttacgcgtacgacacgtaaccttacgttacgaacggtaacgggtaccggtacctaaggtacgtaccggttaggacgtggtaacgtaggtcgtacggttacggtaggaacctaggttaacttcacttacctaccgtaactccgacgtacgtaccgtacggttaccgtacaccgttaaaccggtaggttaaaggttagtttaaaacggaacgtttaacgttacgttaacgtaaaccgaagttaccggtaaacggttaacgactttcgggtaattcccgtacgggtttacggaagggtaacccggtagaaaggggttaacacggtaaatacgggaagttaggacggttccgagttacgacctagtctacgttcgtcncggttaccg

SEQ ID NO: 127491 - DNA, 772 bp, Homo sapiens
  misc_feature: GYAE6OF01CVVLM.49.64.F09.1.454.CMB.1.raw
tcagagtcgagagacacgaccggtgctcgatttagcgcgtatacaagggggagtcagtctcagtcaggacacagcatggacatgacgggtccccgctcagctccgtggggctcctgctactctggctccgaggtgccagatgtgacatccagatcgacccagtcctccactcccgccctgtctgcatctggtaggagacagacgtacaccatcgtagttcggccgggacaagtcagtagttatagactaacttaatttaagtggtatacgagaccgaaccggtaacccggggaacgtaccccgtaagttacgtacgtactacttagtcgctagactacgtactaagttagaacgtaaacgggtcgggtacctaagtacgtaacggttacgaggtcggacgaggtagtacgttacgggaggtaactaagtaacttacaaccgttacctacctaacctaagtaccgtaacgtccgtaacgttaccgtaacgtaacccgtaaacgttaaggttaaaaggtttaacgtttttaaacgggaaactttaaccgtttaacgttaacggtaaacccgtaaggttaaacgggttaaaccggtttaaccggtaaacgtttccgtaacggtttaccgttaacgggttcgggaaccgggtaacgggtaaaccggtaagggtaaggaaacgttaaacgtaaacgtaaaaacgggttacgttagggtacgtaccgtacgaacccgttaacgtacgtttaccgttacttaccgttccgttaacccgg

SEQ ID NO: 127492 - DNA, 633 bp, Homo sapiens
  misc_feature: GYAE6OF01A86DX.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgcctgtctgcatctgtaggagacagagtcaccatctatttcgccgggcaagtcagagtattagactaacttatttaaattggtatcagcacgtacccgggaacgcccctaagttactgatctatgctgcagtacctaagttgacgtaaaggtcgggtacctagtacgtaaggttcaggtgacgtaggtgagtcgtaggactagtaacttcactctaccactatcagctagtctgacctaacgtagtaagttagttttaggaaacttacttagttacgtaactaacgtaaggtaacggttaaccggtaaactttcggtaccttacgttacggttttacggggacggggtaacgggtaaccgtaaaggggttacggtaagtaaacgttaaacgaaaaacggtacgttacgggttacgggacctacggtaccctaacgtacttccgttacgttccttaccgttacccg

SEQ ID NO: 127493 - DNA, 555 bp, Homo sapiens
  misc_feature: GYAE6OF01BRI9K.49.64.F09.1.454.CMB.1.raw
  modified_base (304)..(304): a, c, t, g, unknown or other
  misc_feature (304)..(304): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcaagtacccgggaaggcccctaagttactgatctatgctgcagccaatttgnaaagtgggtcccatcaagttcagtgcagtggatcgtggacagtattcacgtctcacatcagcagtctgccaactagaagtagtttaggtaaagtaactattcgtactaacgaagtaagttaacgtaaacttgtacttcgtaattttcgggacgtacgggaaccgtaagggtaggtacgtaagtaaccgtaaaagtaaccgtaggtcggactaggacctaaccgtacttacccttgttaccttgtaaccccg

SEQ ID NO: 127494 - DNA, 736 bp, Homo sapiens
  misc_feature: GYAE6OF01CWQJR.49.64.F09.1.454.CMB.1.raw
  modified_base (193)..(193): a, c, t, g, unknown or other
  misc_feature (193)..(193): n is a, c, g, or t
tcagagtcgagagacacgaccggtgctcgatttagcgcgtatacaagggggagtcagtctcagtcaggacacagcatggacatgaggtccccgctcagctcctggggctcctagctactctggctccgaggtgccagatgtgacatccagatcgaccagtctccatccgccctgtctgctatctggtaagganacagacgtcaacctatcctagttcggaccggacaagtactagagtattacgactaaactttaagtttaaagttggtaactacgtaacgaccgtaaccgggtaaccccggggaaacggtaaccccgttaagttaccacggttactacttagcgtacgtcgactaacgtccttaagtttacgaacgttaacgggtaccggtaccctaagtaccggtaacggttgtaacgggtcgtaagaaggtcggtaacgtcggtaacggtataacggtaacttccgtactacctaccactacgtacacgtctaccgtcgtactaaccgtaccgttaaggtaacgtttaacgttagtaaacgttactaggttactaacgaacgtaacgttaaggtaaccggtaacttacgtacgttcgttaacggtttacgggaacggtacgggtaaacggtaggtaacggaaacttaacggaaacgtaaacggtacggttacggtcggtaaccgtacgaacgtacttaccgttacgttaccggttccttaccgttaaccccgg

SEQ ID NO: 127495 - DNA, 833 bp, Homo sapiens
  misc_feature: GYAE6OF01BVAHZ.49.64.F09.1.454.CMB.1.raw
  modified_base (190)..(190): a, c, t, g, unknown or other
  misc_feature (190)..(190): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgaccagtctccatccgccctgtctgcatctgtagganacagacgtcaccatctatttcggaccgggacaacgtcaggtagttaattacgacctaaacgtttaattttaaaagttggtaacttacaacgtaccgtaaaccggttaacccccgggggaaacggttacccccttaaaggtttaacctggtaacttaccgtaagtcgtacctcggacctacggtaccttaagttttcggaacgtaaacgggttccgggtaacctaacgttacggtaacggtttacgaggttacggacggtacgtagggtaacgttacggtacggggaacctaaggttaacgttcctaaaccttctaaccgtaacctacgtcctaacggtactacggttactacgaaaccgtaaccgttaaggtaaacggtttaacgttttaacgggtaaaccgtttacctttaaggttaccgttaaacccgtaaaggttaaccgtaaggttaaaccggttaacgttccgtacgtttaccggttaaccggtttacggggtacggtacccgggttaaccgggtaaggggtacggtaaacggtaaaccggttaaaacgtaaaaacgggtcggttaaacgggtcggttaacctaccggtaaccctaaaccgttattaccccgggtttattcccggttaccgttacccg

SEQ ID NO: 127496 - DNA, 843 bp, Homo sapiens
  misc_feature: GYAE6OF01DZUJE.49.64.F09.1.454.CMB.1.raw
tcagagtcgagagacacgaccggtgctcgatttagcgcgtatacaagggggagtcagtctcagtcaggacacagcatggacatggacgggtcccccgctcagcctccgtggggctcctgctactctggctccggaggtcgccagatgtgacatccagatcgacccagtcctccactcccgcccttgtctgctatcgtaggtaggacgacgagtacgtaccaacctattcgtagtttcgggacccgggtactaacggtactaaggtaagttaattacgtaacttaaactttaagttttaaagttggtaactacgacgtaccgtaaccgggtaaccccgggggaaccgttaccccgttaagttacgtagtacttacttagtcgtctacgactaacgtacctaagttacgaacggtaacgggttccggtaccaagttacgtaacggttcgtaaggtcggacgtaggttagtacggttacggtacggtaaactaacgttaaccttacccgtacctaccgtacccgtaacgtacgtaaccgtacggttaccgtaaccggttaccgtaacgtaacccgttaaagttacggtttaaagtttaacggttttaaaggtaaacttttaacgtttagtttaaccgtaacggttaaagttaacgggttaaacgttaacgttaaccttcggttaaccgttacgtttacggggttaccggaacggggttaacgggaacgttaacgggaaggttaaaccgtaaacggtaaaacggttaaacggtacgggttacggtacggtaccgtaccgtaaaccgtaccgttacgtttacccgttccgttacttacccgttacccg

SEQ ID NO: 127497 - DNA, 724 bp, Homo sapiens
  misc_feature: GYAE6OF01ESKMT.49.64.F09.1.454.CMB.1.raw
tcagagtcgagagacacgaccggtgctcgatttagcgcgtatacaaggggggagtcagtctcagtcaggacacagcatggacatgagggtcccccgctcagctcctggggctcctgctactctggctccgaggtgccagatgtgacatccagatcgacccagtcctccatcccgccctgtctgcatctgtagagacagagtcaccatcattggaccggacaatcgagtagtattagactaactaatttaaattggtaatcagacaacgtaccccggggaagtacccctaagtactgtatactatgactcgcacgacctaattcgaagtaaaggtcgggtaccagtacgtaggttcaggtggactaggtggtacgtacggtggaactaacggtaaacttccgtactacctacccaacctacgtaccgaacgtaccgacgttaccgtacgaaccgtaaacctaggtaaaacggttagttttaaacggaaaacgtttaacctttaagtttacgtaaccgtaaaagtacggtaaacggttaacggaaaccgttttcacccggtttaacgttacggttttacggggaaccggggtacgggtaaaccgggtaagggtaacggaacgtaaagttaaaacccggtaaaaaggtaaacgggttcggtaacgccgttaaccggtacccgaaaccgttacgtttacccgttaccttaccgttaccttaaccccgg

SEQ ID NO: 127498 - DNA, 807 bp, Homo sapiens
  misc_feature: GYAE6OF01B7K1N.49.64.F09.1.454.CMB.1.raw
tcagagtcgagagacacgaccggtgctcgatttagcgcgtatacaaggggggagtcagtctcagtcaggacacaacatggacatgagggtccccgctcagctcctggggctcctgctactctggctccgaggtgccagatgtgacatccagatcgacccagtctccatcccgccctgtctgctatcgtagtaggagacgagagtccacctatctatttcggaccgggacaagtcaaggtagttatagactaaacttaagttttaaagttggtatacgacgaccgtaaccggtaacccgggggaacgtaccccgttaaacgtttacgtaggtactcttacgtcgtcgtacgaccacggtaccttaagttcgaacgtaaagggttccgggtaccagttacgtaacggttacgaggtaggtacgtaggtacggtacgtacggtagggaactaaggtaacctttccgaaccttctacccgaacctacgtacgacgtacgtaacgtactacgtaacccgttaacgtaagggtaacgtttaaggttttaaacggaaactttacgtttaagtttaaccggtaacctaaaggttaaacgtttaaccgggtttaaacgtaaccgtttacggtacccggttttaccggtttaaacgggtttaccggggaacgggtaaacggggttaaccggtaaaggggttcgaaactaaacggtaaaccgtaaaaggtaccggttggtaaccggtaccgttaacggaacccttaacgtacggttttacgttacccgtttaacttcccgttaaccgtttaccccccg

SEQ ID NO: 127499 - DNA, 701 bp, Homo sapiens
  misc_feature: GYAE6OF01DRU51.49.64.F09.1.454.CMB.1.raw
  modified_base (464)..(464): a, c, t, g, unknown or other
  misc_feature (464)..(464): n is a, c, g, or t
tcagagtcgagagacacgaccggtgctcgatttagcgcgtatacaaggggggagtcagtctcagtcaggacacagcatggacatgagggtccccgctcagctcctggggctcctgctactctgctccgaggtgccagatgtgacatccagactcgacccagtcctccactccgccctgtctgctatcgtgtagggagacagtacgtacaccatctagtttcgccgggactaagtcagtagtattagactaacttaatttaatggtatcagtaccacggtaaccccggggagtcccctaagttactaggatcgtatcggtcctgcctaagtaccttaagtttcgaacgtaaagggttccggggtaacctagttacggtaacggttcgtaagggtcgtacgtaggttagggtactcggtaacgggaataggtaaacttcgtaacttccaccgtaactctacggacnctacggtctacgactaaccgtgtaacgtttaggtttaacgtaaagtactttagtacgtaactaacgtaacgttaacgggttaacctaacgttcgtaaccgttaggttaaccggttttcggggaaaccgggtacggggtaaccggtaagggttaacggagtaaaccgttaaacggaaaacgggttactagggtagtcgtacgacgttacctagttcctacgtttcctaacgttacccg

SEQ ID NO: 127500 - DNA, 838 bp, Homo sapiens
  misc_feature: GYAE6OF01EUKYO.49.64.F09.1.454.CMB.1.raw
tcagagtcgagagacacgaccggtgctcgatttagcgcgtatacaaggggggagtcagtctcagtcaggacacaacatggacatgagggtccccgctcagctcctggggctcctcgctactctggctccggaggtgccagatgtgacatccagatcgacccagtctcccatcccgccctgtcctgctacttcgtggtaaggacgacgaggtacgtaccaacctattccgtagtttccggccgggacgtaaagtccaagggtacgtttataccgaaccttaaactttaagttttaaatttcgggtactacacggaccgtaaccgggtaaccccgggggtaaccgtaccccgttaaaggttactacggtcttactagttcggacgtcgaccgaacgtaccgttaacgtttacggaaccgtaaacggggttccgggtaccctaaggttaacggtacggttggacgtcgggacgtaggtacggtacgtacggtacggaactaacgtttactcctaaccctaccgttacaacccgtacgtacgtaccgtaccgtacgttaccgtaacgtaccgtaaaccggttaacggtaagttttaacggtttaacggttaaacgtttaccgttaaggtttaacgtaacccgtaagttaaaccggtaacggtttaaacggttaccgttacgtaccgtttaacggttagggttacccggggtaacgggtacccgggaacggttaaggggtacggtaaaggtaaaccgtaaacgtaaaggtaaccggttgggtaacggtaccgaccgtacctacgttacttcgtacggtttcccttaccgggtccccttacccg

SEQ ID NO: 127501 - DNA, 688 bp, Homo sapiens
  misc_feature: GYAE6OF01CRLXE.49.64.F09.1.454.CMB.1.raw
  modified_base (191)..(191): a, c, t, g, unknown or other
  misc_feature (191)..(191): n is a, c, g, or t
  modified_base (383)..(383): a, c, t, g, unknown or other
  misc_feature (383)..(383): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatccgccctgtctgcatctgtagganacagagtcaccatctattcggccggacaagtcagagtattagactaacttaatttaaattggtatcagcaagtaccccgggaagtacccctaagtactgtatctatgctgacagtacctaattgacaaagtcgggtaccagtacgaaggttcgaggtgacgagtggagttcgaggacagtaattccactccnctacatacaacgtctaggtctacgacctaaccgtaggtaacgttagtttaaggaaacgtttactagtttaccgtaaccgtaaacgtaagggtaacggtttaaacgtaaaccgtttcggtaacctttacggttaacgggttttaccggggaacggggttaaaccggggtaacccggttaaaggggttacggtaaacggtaacttaaaacgggaaaaaacggttacgttaggggttacggtaacccttacgggtaaccctacccgttaaattcccgttttaacggtcccgtttaaccgttaaccccg

SEQ ID NO: 127502 - DNA, 827 bp, Homo sapiens
  misc_feature: GYAE6OF01C6I4Y.49.64.F09.1.454.CMB.1.raw
  modified_base (187)..(187): a, c, t, g, unknown or other
  misc_feature (187)..(187): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtgccagatgtagacatccagatcgacccagtctccacgtcccgccctgtctgccntcgtaggtaggagacgagacgtaccacatctagttcggaccggacagtcaagtagttactacgactaaactttaagtttaaagttggtaactcgacgtaccgtaaccgggtaacccccggggtaacgtaaccccgttaagttaccgtagtaacttctaagtcgtcgtacgacgtacgtaccttaagttacgaacgtaacgggtccgggaacctagtacggtaacgttcgaagggtcgtacggacgtggtaacgtcggtaggaactagtacttacaccgttccacctacgacgtaccacgtaccgtagttaccgaccgtaacggtaaacgttacgttaaacgttttacggtttaaaggtaaaccggtttaacttacggttaacgtaaccgtaaacggtaacggttaaacgggttttaaccgtaaacgtttccggttaaaccgttcggtttaaaccggggttcggggaaacccgggttaacgggaaaccggggttaaacgggaacggtaaacggttaaaccgtaaaaacgggttaaaacgggtaccggtttacggggtaccgtaacgttaaccccgggttaacgtaaaccccgtttactttacccggttttaccgtttaccgttcccccgttttaaacccgg

SEQ ID NO: 127503 - DNA, 890 bp, Homo sapiens
  misc_feature: GYAE6OF01A4L47.49.64.F09.1.454.CMB.1.raw
tcagagtcgagagacacgaccggtgctcgatttagcgcgtatacaagggggagtcagtctcagtcaggacacagcatggacatgagggtccccgctcagctccgtggggctcctgctactctggctccgaggtcacgagtagtgtacgacactccgaagtacgtaccgaccgtacgtcctacctccgtccccgtccgttcgttaccgtcgtactacgttcgtaggtaacggacgtacgtagtacgtacctactactacgttacggttaccggaccggtacgtaacggtacgtaaggtaacgttaagtacgtaacttaactttaaagttaagttcgtaactacgacgtaaccgtaaccggggtaacccgggtaaccttacccgtaaggttacacgtacgtacgtacgtcgtactacgacgtacctacgttagtacgaacggtacgggttaccgtaacctagttaacggtacggtacggtacggtacgtaggtacggtactacggttacgggacgtaacttaacgtccttaaccgaccgtttaccacccgtaacgtactaccggaacgttccgtaacgtaccccgttaacggtaaaccgtaaaccggttagtttaaaacgggtttcgtttaaaccggtaacgttttaaccttagggtaacttaacccggggtaataaaccgggttttaacggaacccgtttagtacccgttaccgtttaacgggttttacccgggttaacgggggaaccggttaaacgggcgggtttaaacggtacgtaaaaccggttaaaccggtaaaaccggttacgggaacgtttcgggaaaccgttcgtaacccgtaaaccgttaccttcgggttaaccgtttcctacccgttaacgggttacccccc

SEQ ID NO: 127504 - DNA, 719 bp, Homo sapiens
  misc_feature: GYAE6OF01BWG93.49.64.F09.1.454.CMB.1.raw
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtgccagatgtagacatccgagatcgaccctagtcctccatcccgccctgtctgctatcgtgtacggagacgagactcacctntctagttcggccggganacgtagagacgtagtagtactaaacttaattttaaagttagttatacacgaccgtaacggtaacccggggtaaccgtacccgttaagttactacgtatctacgtcgactgacacgtacttagttagacggtaacggtcgggtacctagtaccgtaggtcgtaggtcggtacgtagggtcgtacggtaggtacggaacgtaacgtacttaccgtacttacctaccgaacctacgtaccgactacgaacgttcgtaaccgaacgttaccttaaggtaaacgtttacgtttaaggtaaacggttacttagttacgtaacgaacgtaacggtaacggtaaccgttaacttcgtacttacgttaacggtttcggggacgggtaacgggtaacgtaggggtagaacggtaaacgaacggtaaagttacgggtacgttaccggtaccggtctaaacgtacctttaccgtatttacccggtcttccgttaaccccg

SEQ ID NO: 127505 - DNA, 666 bp, Homo sapiens
  misc_feature: GYAE6OF01D3TMA.49.64.F09.1.454.CMB.1.raw
  modified_base (305)..(305): a, c, t, g, unknown or other
  misc_feature (305)..(305): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatcgaccagtctccatcccgccctgtctgcatctgtaggagacagagtcaccattctatttcggaccgggacaagtcgaagtagtattagactaacttaatttaaagttggtatcagactacggtaaccccggggaacgacccttaagttctanatctatgctcgacacgtactatttcgacgtaacggtcgggtaccctagtacgaaggttcaggtcggacgtaggtacggactcggtaggaactagtacttcacctctacactatacacgtacgagtctacgaacctacgtaaggtaacgttagtttaagtaaacgtacttatacgtaacgtaacgtaggttaacgtaaccgttaagttcgtaacgttacgttaacggtttaccgggaacgggtacgggtaacggtaaagggttacgaaacggtaactaaacgaaacggttaaccggtaggttacggaccgtacgtaaacccgtacgttaccgttacgtttccgtttccttaacgttaccccg

SEQ ID NO: 127506 - DNA, 595 bp, Homo sapiens
  misc_feature: GYAE6OF01DQ9N2.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttcgccgggacaagtcagagtattagactaaacttatttaaattggtaattcgagcacgtaaccccggggaacgccctaagttactgatctatcgctgcagcctaatttgacaaggtcgggtaccagtacgaaggttcaggtggacagtggattcgaggaactaggtaattcactctacacatcagtcagtctagactaacgtagtaagtagtttagaaagttactagttcgtacgaacgtaaggtaacggttaacgtaacttcggtacttacgtacggttttcgggacgggtacgggaaccgtaagggtacggaagtaagtaaacgtaaaagtaacgttggtaggaccgtgaccgtaacctattacgttacgttcgttccgtaacccg

SEQ ID NO: 127507 - DNA, 609 bp, Homo sapiens
  misc_feature: GYAE6OF01E1L0Z.49.64.F09.1.454.CMB.1.raw
  modified_base (303)..(303): a, c, t, g, unknown or other
  misc_feature (303)..(303): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggacaagtcgaagagtattagacaaactatttaaattggtatacagcacgtacccggggaacgccccgtaagtactagatctaacttgctnacacgtcctaatttgacgtaaaggtcgggtacccagtacgaaggttcgagtggcagtgagtcgtaggactagtattcactctacactatcaagccgtagtccgtacgaccgtaacctaggtaacgttaagttttaacggaaagtttacttaagttcgtaataacgaggttaagttaaccggtaaacttgtaccgttacgtacgttttcgggaacgggtacgggtaaccgtagggtgaacgtagaaacgtaaagaacgttggacgtacgtacgactaccgttaagtcctttacgtcttcgttacccg

SEQ ID NO: 127508 - DNA, 669 bp, Homo sapiens
  misc_feature: GYAE6OF01A4JTH.49.64.F09.1.454.CMB.1.raw
  modified_base (168)..(168): a, c, t, g, unknown or other
  misc_feature (168)..(168): n is a, c, g, or t
  modified_base (458)..(458): a, c, t, g, unknown or other
  misc_feature (458)..(458): n is a, c, g, or t
  modified_base (593)..(593): a, c, t, g, unknown or other
  misc_feature (593)..(593): n is a, c, g, or t
  modified_base (604)..(604): a, c, t, g, unknown or other
  misc_feature (604)..(604): n is a, c, g, or t
tcagagtcgagagacacgaccggtgctcgatttagcgcgtatacaagggggagtcagtctcagtcaggacacagcatggacatgagggtccccgctcagctcctggggctcctgctactctggcctccgaggtgccagatgtgacatccagatcgaccctagtctccnctcccgcctgtctgcatcgtaggtacggagacgagacgtacacctagtctagttcggaccggacgtaacgtcgtaggtagttaacgtaacggacctaaactttaaagttttaaagttcggtaactacgtaacgtaccgtaaccggtaaccccggggtaaccgtaccccgttaagttacctagtacttcgtactcgcgtgctacgtctaattcgacgtaacggtcggtaccatacgtacgtgacgtgtagtacgtgtacgtcgagactacgtacttacgactcactactanaccgacgtactacgtctacggtaacctaacgtaagtaagttaacgttaagtacctagttatacgtaacaagtagtacgttaacgagtcgtatttacggtggttacgggacggtaacggtagtagggtaacgtaanacgttaaacgngttaacggtacgggtctaccggtaacacccgttacgtaggttaccgtcctttcacgtttaccccg

SEQ ID NO: 127509 - DNA, 752 bp, Homo sapiens
  misc_feature: GYAE6OF01A82LU.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtcctccactcccgccctgtctgcatctggtaggagacagagtccaacctatctattcggccgggacaagtcagtagtattagactaacttaatttaaagtgtatcgagccgtaacgtaccccggggaagtaccccttaagttacctagtactactagtcgctcgcacgcctaagttcgacgtaacggtcgggtcctaagtacgacggttcgaggtcgcgtaggtcgtacgtacggtaggaacgtagtaacttccgaacttccctaccgtaaccaacgttacctaccggtactaccgtacgtaccgtaacctaaccggttaaggttaaacgtttaaggttttaacggtaaacgtttaaccgttagtttaaccggtaaacctaaacggtaaggttaaccgggtttaaacgttaaccgttacggtaccgtttaaccggttacggttttacccggggaacgggttaaccgggaaccgggttaaagggtacgggtaaacgtaacggttaaaaccgaaaagggttacggtcgggttacggaccgtacgtacctaacccgttacgttacccgtttcgttcccgttacccttaaccccgg

SEQ ID NO: 127510 - DNA, 703 bp, Homo sapiens
  misc_feature: GYAE6OF01D8WY7.49.64.F09.1.454.CMB.1.raw
tcagagtcgagagacacgaccggtgctcgatttagcgcgtatacaagggggagtcagtctcagtcaggacacagcatggacatgagggtcccccgctcagctcctggggctcctgctactctggctccgaggtgccagatgtgacatccagatgacccagtctccactcccgccctgtctgcatctggtaggagacagagtacaccatctatttcggccggaccaagtcagtagtattagtactaaacttaatttaaagttgttaatcagccgtaaccgtaacccggggtaacgaccccgttaagttactagtatactagtgcgtgacagacctaattcgtaacgtaacggtcgggtacctagtacgtaacggttcgaaggttcgacgtagtcggtagtcggtaggactagtaacgttcctactacctaccaacctatacacgcgtactcgtagacctaacgtagttaacggttaagttttaaggtaaacgttaacgtttacgttacgtaaccgggtaaacgtaacggttaacggttaacgttaaacggttcgtacccgttacggtttaccgggttttaccggaaccggggtacgggtaaacgtaacggggtaggtaaacgaacgttaaacgtaaaacggtagttagggtccgtacgtacgtacccgtaccgttactaccgttccgtttcctccgttaacccg

SEQ ID NO: 127511 - DNA, 751 bp, Homo sapiens
  misc_feature: GYAE6OF01DDKXE.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtcctccatccgccctgtctgcatctgtaggagacagagtcaccatctatttggccgggcaagtcagagtattagacaacttatttaaattggtatcagcacgtacccggggaacgtccctaagttctgatctatgctgcacgtacctaagtttacgacgtaaagggttccggggtaccctaagttacgtaaacggtttccgaagggtagggtaccgtaaggttgggtaacttccgggtaggggtaacccgtaaggttaaaccttcctaaccttccctaccctaaccgtacgttaccgacggtacctaaggttcccgttacggtaccctaaaccgttaaggtaaaggttttaaggtttttaaacgggaaaacgtttactttagtttaccggttaaccaaaaggttacggtaaacgggtttaaacccggtaacgtttcgtacccgtttagttacgggttttcggggaaccggggtagggtaaacccgtaaggggtaggaacggttaagtaaacccggtaaaaaggttcgttaggggttggcccgttacggaccctaacggttaaccttgttaaccgttcctttacttacccccg

SEQ ID NO: 127512 - DNA, 605 bp, Homo sapiens
  misc_feature: GYAE6OF01B6AB5.49.64.F09.1.454.CMB.1.raw
  modified_base (190)..(190): a, c, t, g, unknown or other
  misc_feature (190)..(190): n is a, c, g, or t
  modified_base (581)..(581): a, c, t, g, unknown or other
  misc_feature (581)..(581): n is a, c, g, or t
  modified_base (593)..(593): a, c, t, g, unknown or other
  misc_feature (593)..(593): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatccgcctgtctgcatctgtagganacagagtcaccatctagtttgccggtacaagtcagtagtatagacaacttaatttaattggtatcagcacgtacccggagccctaagtactgatctatcgctgacagccttaattacgacgtaaacggttcgggtacccagttaccgtaaggttcgaagtggtacgtaggtaggtacgtagtacgggaactaagtaacttctaaccgtcctaccgtaacctactaccgagtaccgtaacgttcctacgtaacctaaccgttagtaaacgttaagttttaaacggtaaacgttacgtattcgtaacgtaactaaggtaacgtacgtaattcgcttacgtagtttcggacgtacggacgtaggtagagacgtaagaaacgtgtaggtcgtacngacactactccngttctcgtaccg

SEQ ID NO: 127513 - DNA, 963 bp, Homo sapiens
  misc_feature: GYAE6OF01AV4TR.49.64.F09.1.454.CMB.1.raw
tcagagtcgagagacacgaccggtgctcgatttagcgcgtatacaagggggagtcagtctcagtcaggacacagcatggacatgagggtcccgctcagctcctggggctcctgctactctggctccgaggtgccagatgtgacatccagatgaccctagtctccatcccgccctgtctgctactcctggtacggacgacgagacgtccaacctatactagttttcgggccgggtaactaaaggtcctaaggtagtttactttaaggacctaaaactttaaagtttttaaaaggtttcggtaagttaccgacggtaacccgtaaccggggttaaccccccggggggtaacggtaaccccccgtttaaagtttacgtacggtaactttacgtaacgttggtaccttacggcctaacgtaccgttaaagttttacggaaccgtaaaacggggttcccgggtacctaacggttaaccgtaacggggttttacccgaagggtttcgggaaccgtaacgggttacgggtaacgtttaccgggagggggttaaacctaacgggttaaacctttacccggaaacctttccggttaaacccgaacccgttaagtacccgtaaccggttacgtaaacggtttcccaacgggttaaaccctaaacccggttaagggttaaaaccgggttttaacggttttaaaggggtaaaaacctttaccgtttaaacgggttaaccgtaacccggtaaaccgggttaacgggtttaaacgggttttaaaccccggaaaacgttttcccggtaaacgtttaaccgggttttaaccggtttacgggggaaacggggtaaccgggttaacggtaaacggggttacgggtaaacgtaaaccggttaaaccggaaaaacgggtccggttaaggtccggtaaaccgttctaccggtaacttcggtagttccgttactacggttacccc

SEQ ID NO: 127514 - DNA, 860 bp, Homo sapiens
  misc_feature: GYAE6OF01E0Z7I.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacgagagtcaccatctatttcggccggacaagtcagtagtattagactaacttaatttaaattggtactacagtacgaacgtaaccccggggaacgtacccctaagttacctgtactacgttagtcggctgaccgacgtacctaagtttacgacggttaaaacgggttccggggtaaccccctaagttaaccggtaaacgggttacgtacgggttacgggactaagggttcgggtaacggttaccggtaacggggtaaccgtaaagggtaaaccttttaacccgtaaacccgtttccgtaacccttaacccgttactacccgtaaacggtccgtacggtttaccccgtaacgtaaaccccggtaaaccgtttagggtaaaacggttttaacggtttttaaacggtaaaacgttttaaacgttaacgttttaccgggtaaacttaaaaccggtagggtttaaacggtttaaaccggtaaaccgtttacggtacccgttttaacggttaccgggtttttaccggggaaccggggtaaacggggtaaccgtaaaggggttaccgggtaaaggtaaccttaaacggtaaaaacggtaccgtttaagggggtctaaccggtacgaacccgttaacgttaacgttccggtttacggtttacccttcgttaaccccg

SEQ ID NO: 127515 - DNA, 764 bp, Homo sapiens
  misc_feature: GYAE6OF01BGUYC.49.64.F09.1.454.CMB.1.raw
  modified_base (231)..(231): a, c, t, g, unknown or other
  misc_feature (231)..(231): n is a, c, g, or t
  modified_base (365)..(365): a, c, t, g, unknown or other
  misc_feature (365)..(365): n is a, c, g, or t
tcagagtcgagagacacgaccggtgctcgatttagcgcgtatacaagggggagtcagtctcagtcaggacacagcatggacatgagggtcccccgctcagctcctggggctcctgctactctggctccgaggtgccagatgtgacatccagatgacccagtctccatccgccctgtctgcatctgtagagacagagtcaccatcatttgccgggcaagtcagagtattagnaactattaaattgtatcagcactacccgggacgccctaacgttactagagtctatgcctagcagcctaatttgcgtaaagtcggggtacccagtaccgtaaggttcaggtaggactagtaggatcgtaggtaanacgtaagttactactctacgaacctatcgtaacgcctaagttacctcgtacccgtaaccttacgggtaaagtaagtttttaacggtaaaacgttaccgttaagtttacggtaacgtaaacccgtaagggttaacggtttaaaccggtaaaccttaggttaccccgtttaccggttaaagggtttttcccggggtaaccgggggtaaacggggttaaaccccggtaaagggggtttaacggggaaaacccgttaacggttaaaacccggtaaaaaagggtaaccccccggttttagggtaaccgggggttacccggttttaaccgggaaccccgtttaaaccccctaaaggtttaccccgtttaccggtttaaaccccgttttccgggtttaaaaccccc

SEQ ID NO: 127516 - DNA, 775 bp, Homo sapiens
  misc_feature: GYAE6OF01BF3T7.49.64.F09.1.454.CMB.1.raw
  modified_base (230)..(230): a, c, t, g, unknown or other
  misc_feature (230)..(230): n is a, c, g, or t
tcagagtcgagagacacgaccggtgctcgatttagcgcgtatacaaggggggagtcagtctcagtcaggacacagcatggacatgagggtccccgctcagctccgtggggctcctgctactctggctccgaggtgccagatgtgacactccagatcgaccctagtcctccactcccgccctgtctgcatcgtgtaggagacagacgtaccactatctagttcggccgganaacgtcgaggtagttaatacgactaaactttaagttttaaagtggtaactacagaccgtaaccgggtaacccggggtaaccgtacccgttaagttacgtagtacttacgtcgtgaccgtcgaccgtacgtaccttaagttcggaacgtaacgggtaccgggtacctagtaaccgtaggtacgaggtcggagtacggtagacgtacgggtaggtaacacgtactactacgtacctacctacatcctaagtcgtacgtactacgtaaaccgtaagttaacggtaacgtttaaggtttaaacggtaactttactttacggtaactaacgtaacggttaacgttaacggttaaaccggttatttaccggtacgtttacggttacggggtttacccgggaagggtaaccgggtaacggttaaggggtacgttaaaacggttaaaccgtaaaaccggttaaacgggtaggtttacggggtaccaacccggttacgtaaacccgttaactaccggtttaccttttacggttacccttacccttacccccggg

SEQ ID NO: 127517 - DNA, 674 bp, Homo sapiens
  misc_feature: GYAE6OF01BRU1I.49.64.F09.1.454.CMB.1.raw
  modified_base (488)..(488): a, c, t, g, unknown or other
  misc_feature (488)..(488): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatcccgccctgtctgcatctgtagagacagagtcaccatcatttcgaccggacaagtcaagagtatagactaactaatttaatgtatacagacacgtacccggggaacgtaccctaagtactgatactatgctgacacactaagttgaacgaaggtcgggtaccagtacgtaaggttacgaggttcgagtacggttagtagtacggtaggaacgtaaggtaaactttccgaaccttcgactaaccgactacacggactaccgttcgtacaacgtaaaccgttagaaagtttaagtttaacggaaaacgtttactaacggttanaaccgtaaaagtagggttaacggtttaaacccgaagtttacgtacccgttacggtttaacggtttaccggggacccgggtaaaggtaaacccggtaaggggtaccgaaggttaaaacgtaaccgaaaaagttcggacggttagaccttaagaccctaactagttaccttacttcgttaacgtaccg

SEQ ID NO: 127518 - DNA, 718 bp, Homo sapiens
  misc_feature: GYAE6OF01A16RO.49.64.F09.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtgccagatgtcgacatccagactcgaccctagtctccactcccgccctgttctgctatctgtaggagacagngtccacctntctacgtttcggccgggactaagtcgagtagttatagactaacttaatttaagttgtatcgacgaccaacggtaccccggggaacgtccccgtaagttacgtagtattcgtagtcgtcgtgcacgtcgtacgtttagaacgtaaacgggttcgggtaccctaagtaccggtaacgttcgaggtcgggatggtaggcggtacgtagggaactagtaacgttcctaccttcctaactacgtactccacggtctacggttcaccgtactaaccggtagtaacgtttacggtttaacggtaaacgtttcgttaatttacgaacgtaacgttaaggttaacgtttaacgggtaaaccgttggtaccttaaacgggttttcggtttaccggggacgggtaacgggtaaccggtagggttaacgggacttaaacggtaaacgtaaaacgggtcgttaacgggtgaacccgttgaccctacgttactccggttttctccgtttccgtaccccg

SEQ ID NO: 127519 - DNA, 702 bp, Homo sapiens
  misc_feature: GYAE6OF01DLQ70.49.64.F09.1.454.CMB.1.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtgccagatgtagacatccagatacgaccagtctccactccgccctgtctgctatcgtaggtagganacgacgagtccacctatctagtttcggaccggganaacgtcgagtaggttattacgactaaacttatttaaagttcggtaatcgacgaccgaaccggtaaccccggggaacgtacccgttaaagttacgtggtaacttctaagtcggtcgtcgaacacggtactaagttacggacgtaaacgggtcgggtaaccctagtacgtaacggtcgtaggtacggacgtaggtcggtacgttcgggtacggaactacggttaacttaccgacttccgtaaccacgttagtaccgacgtacgtacgtcgacgtaaccgtaacgtaagtaacgtttacgtttaaggaacgtttaacttacgtagtaaccgaacgtacggttaacgttaacggtaacttacggtacttacgtacgggttacgggaacggtacgggtaacgtagggtaacggtagtaacttaaacgggaaataggtggtcgtacacgactactacgtctacggtcctcgtacc

SEQ ID NO: 127520 - DNA, 689 bp, Homo sapiens
  misc_feature: GYAE6OF01D8D9A.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctcactccgccctgtctgcatctggtaggagacagagtccaccatctatttcggccggacaagtcagagtatagacaattatttaaattggtatcagacgtaacggtaccccggggaacgtacccttaagttacctagtactctagttgctgacacgactaattgaacgtaagggtccggtaccagtaccgtaaggttcaggtgacgtaggtgtagtacggtagggaactacgtaattccgtactccgtacactacgtactacgacgtacgtcgtacgaccgtaaaccttaggtaagtttaacggtttaaagtaacgtttaacttacgtttaacgtaactaacgttaaggtaacggttaaaccggtaatttcggtaccgttcgtttacggtttcggggaaccgggtagggtaaccgtaagggtagggtaaacgtaacgttaaacggtaaacggttaagttggtaccggtacttacgggaacccttacgttaccgttccggtttacgttacccgttacggttaaccccg

SEQ ID NO: 127521 - DNA, 793 bp, Homo sapiens
  misc_feature: GYAE6OF01B6S6W.49.64.F09.1.454.CMB.1.raw
  modified_base (72)..(72): a, c, t, g, unknown or other
  misc_feature (72)..(72): n is a, c, g, or t
  modified_base (585)..(585): a, c, t, g, unknown or other
  misc_feature (585)..(585): n is a, c, g, or t
tcagagtcgagagacacgaccggtgctcgatttagcgcgtatacaagggggagtcagtctcagtcaggacanagcatggacatgagggtccccgctcagctcctggggctcctgctactctggctccggaggtgccagtacgtgtgacatccagatcgaccagtctccatccgcctgtctgacattcgtagtagagacagagtcacatacgtagttcggaccggacagtacaggtaagtatacgaactaacgttaaatttaagttaggtaacttacgaagtaccgtaaccggttaaaccccgggggaacgtaccccgttaagttactacggtactagttacgtcgactacggtctacggtaaccttaagttacgtaacgggtaaacggtccggggtacctaacgttcggtaaacggtacgtacggtacgggtgtaacggtagaaccgtttacggtaaccggaagtaaacgtttaacctacgtaccctactaccggaacttacgacgaacggttacaccggtttacgtacggtaaccaaacggtttacgtaaaggtttacgtttaacggtaaaacttgtttaaacncggtaaacgttaacggtaaagttaaaccggttaccgtaaagtttaccggtacctttaacgggttaacgtttaccggggaccgggtaaacggaacccgggtagggttaacgaacggttaaaccgttaaaagtaaccgggttacgtaacggtggtacccgtaaaggaccctaccggttacgttaccgtacgtcccgtttaagtaccccgg

SEQ ID NO: 127522 - DNA, 829 bp, Homo sapiens
  misc_feature: GYAE6OF01A3PH0.49.64.F09.1.454.CMB.1.raw
  modified_base (582)..(582): a, c, t, g, unknown or other
  misc_feature (582)..(582): n is a, c, g, or t
tcagagtcgagagacacgaccggtgctcgatttagcgcgtatacaagggggagtcagtctcagtcaggacacagcatgacatgagggtccccgctcagctcctggggctcctgctactctggctccgaggtcgccagatgtgactatccagatcgacccagtcctccactcccgccctgtctgctatcgtgtaggagacagtacgtaccactatctagttcggccggacgtaagtacagagttagttacgactaaacttaattttaaagttacggtatacgtagtacctaaccggtaacccccggggtaacggtaccccgttaacgttacctagtactacgttatcgtcgtacgaccataaccgtattacgaagtaaacgggttacgggtacctaacgtagtaaccggtcgaaggttcgacggtacgtgggtactcggtagggaactacggtaacgtacctaaccgttcgacccgttacctaactaccgttacggaaccgtttacgtacccgtacgtaacctaaaccgggttagtaaaggtttaaaccgggttttaagtttaaacttacgtttaaacggttntaaaaccggttaaccgttaaacggttaaagggtttaaccccgttaaagttttccggaccttttaacgggtttaaagttaccgggggttaaggggaaaccggttaaccggtttaaagggacgggttaaacgtaacctaaaacggggttaaaagtcccgggtttaacggggaccgttaccggttaaacccgaccttaacccgggttaaccttaggggttttaacccgtacccgtttaacggttaccccc

SEQ ID NO: 127523 - DNA, 702 bp, Homo sapiens
  misc_feature: GYAE6OF01BK7N1.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatcccgccctgtctgctatctgtaggagacagagtcacatctagtttcggccggacaagtcaggtagtattagactaacttaatttaaagttggtactacagactaaccggtaaccccggggaacgaccccgttaagttactggtactacgtacgtcgacgtcgactacgtacctaagtttacgacgtaaagggttccgggtaccctaagtacgtaagttcgtaggtacggtacgtaggtggtactcggtaggaacgtacgtacttacctacttacctaccaacctagtaccacgtactacgttcgacgtaccctaagtaggttaaggttacgttttaacggaaacgtttacgtttaagtacggtaacgtaacgtagggttaacggttaccgtaacttcggtaccttacgggttagtttacccggggcggtaacgggtaaaccggtagggtacggtaactaaggtaacgtaaacggtacgtggtacgggtacctacgtaccgtaacttacgttagttacgttccgttcgtaaccccg

SEQ ID NO: 127524 - DNA, 844 bp, Homo sapiens
  misc_feature: GYAE6OF01BH0L8.49.64.F09.1.454.CMB.1.raw
tcagagtcgagagacacgaccggtgctcgatttagcgcgtatacaagggggagtcgagtctcagtcaggacacagcatggacatgagggtcccgctcagctcctggggctcctgctactctggctccgaggtcgccagatgtgacatccagatcgacccagtcctccatcccgccctgtactgcatctggtacggagacagacgtcacctatctacgtttggccgggtacaaggttcaggagttattacgactaacttaatttaaacgttggttaactacgtacgtactaacgttacccggtacgggggtaaaccggtacccccttaaaggtttaccgtacgtacgttcctaacgtcggtcttacggaccgtacgtaccttaagtttacgaccggttaaacggttccggggtacccctaacggttaccgtaacggttacgtaacggttcgggaccgtaggtacgggtacgttcgtacgggtacaacgttaacttccgaacgttcctacggaacctctacgacggtactcgtaccgtcggtaacctaaccgtttagggaaacttttaggtttaaccgggtaaacgtttacgttaacggtttacgtaaacccggtaaaggtaaccgggtttaacgtttaaacccgggttaacgtttacggttacccgtttaacgggttacgggttttaaccccggggaagggggttaaccccggggtaaaccgtaagggggttaccggggaaaaggttacccgttaaaacggggaaacggggttaccggttacgggaaccggggttctaacccgggccgtaaccgtttaagtccccggttagttaccccgtacccg

SEQ ID NO: 127525 - DNA, 918 bp, Homo sapiens
  misc_feature: GYAE6OF01BOYLG.49.64.F09.1.454.CMB.1.raw
  modified_base (359)..(359): a, c, t, g, unknown or other
  misc_feature (359)..(359): n is a, c, g, or t
  modified_base (379)..(379): a, c, t, g, unknown or other
  misc_feature (379)..(379): n is a, c, g, or t
tcagagtcgagagacacgaccggtgctcgatttagcgcgtatacaagggggagtcagtctcagtcaggacacagcatggacatgagggtccccgctcagctccgtggggcctcctgctactctggctccgaggtgccagatgtagacactccaagatccgaacccacgttcctccctacgtcccgtcccgttgttctgaccattacgtaggtaggaagacgaggtacgtaccacctattctagttcggaccggacgagtagaacggtagttataacgtactaatttaatttaagttagtatcgacgacgtaccggtaacccggggaccgtaccttacgttactagtacgtacttacgtncgtacgacgactacttagtnaacggtaggtaccggtactacgtacgtacggtacgtaggcggtacgtaggtgtacgtggacggtactagtattacgtactaccgtactacgtactacgtaacgtcgttagtacccgtacgtaccgtaacgttaacggtttaacgtttaacggtttaaacggtaaacgtttacgtttaacgttaacggttaaaccgtaacggttaaacggtttaacggttaaaccggtttaagtttacccggtttaacgggttttacccgggttttaaaccggggttacggggtaacccgggggtaaacgggttaaccgggggttaaaacggggggttaaacgggttaaacgggtaaaaaccgggttaaaccgggtttaaaaaacccgggttttaggggggtaacccgggttttacccggggtaaaacccgtttaaccccgggggttaaacccggtttttaaccccggtttaaaccccggggtttttaacccccgtttttaacgggtttaacccccgttttaaaacccccgggggtttttaacccccccg

SEQ ID NO: 127526 - DNA, 756 bp, Homo sapiens
  misc_feature: GYAE6OF01D3WWM.49.64.F09.1.454.CMB.1.raw
  modified_base (192)..(192): a, c, t, g, unknown or other
  misc_feature (192)..(192): n is a, c, g, or t
tcagagtcgagagacacgaccggtgctcgatttagcgcgtatacaagggggagtcagtctcagtcaggacacagcatggacagtgagggtcccgctcagctcctggggctcctgctactctggctccgaggtgccagatgtgacatccagatcgacccagtctcatccgcctgtctgctatcgtagtagganacgagagtccacctatctagtttcggccgggtacaagtcagtagttacttagactaaacttaagttttaaagttcggttaatcgtaaggaccgtaaccggtaaccccggggtaacggtaccccttaaaggttacctaggtattacgtagtcgtctacggactacggtacctaagtttacgacgttaaacgggtcgggtaaccctagtaccgttaacggttacgacgggttacggacgtacggtagggtaacgtcggtacgggtaactacggtaacttcctacgttcctaacgtaacctagttaccgaacgtacgtacgttccgtaagaccctaaacgttaggtaaacggttttacgtttaaacggtaaacgttctttaacgtttacgtaaacgtaaacggttaagggttaacgttaaaccggttaaacttcgggtacctttacgtttacgggtttaccggggaacgggttacggaacggtaagggttacgaagtaacgtaaacggaaacgttacgtagggttccacgtagacccgtacttagtaccttgttaacctcgttaccc

SEQ ID NO: 127527 - DNA, 715 bp, Homo sapiens
  misc_feature: GYAE6OF01CRNK0.49.64.F09.1.454.CMB.1.raw
  modified_base (453)..(453): a, c, t, g, unknown or other
  misc_feature (453)..(453): n is a, c, g, or t
  modified_base (517)..(517): a, c, t, g, unknown or other
  misc_feature (517)..(517): n is a, c, g, or t
tcagagtcgagagacacgaccggtgctcgatttagcgcgtatacaaggggggagtcagtctcagtcaggacacagcatggacatgagggtccccgctcagctcctggggcctcctgctactcgtggctccgaggtcgccagatgtgacatccagatcgacccagtcctccacgtcccgccctgtctcgctactcgtggtaaggacgacagacgtaccacctattctagtttcggaccggagaagtcgagtacgttatacgtactaactttaagtttaagtggtactacgacgaccgtaaccggtacccggggaacgtacccgttaagtactagtactactagtcgactcgaccacgtactagttacgacgtaacggtccggtactagtacgtacgtacgacgtggtacgtaggtcggtagtcggacggtaactagtactctacgtacactacnctacgacgtactacgtctacgaactacggttaagtagtttaggttaacgtaacgtttaacgttnttaccgaactaacggttaacgttaccgttaaccgtaacttcggtaacgttccgttaaggggttccgggaacgggtacggtaaaccggtagggtacgtaaacgtaactaaacgggtaaaccgttcggttagggtcccgttaaccgacggttaccctaacggtttaccctgttttaaccccgtcgtttccctaaccccgg

SEQ ID NO: 127528 - DNA, 780 bp, Homo sapiens
  misc_feature: GYAE6OF01AKJ4B.49.64.F09.1.454.CMB.1.raw
  modified_base (131)..(131): a, c, t, g, unknown or other
  misc_feature (131)..(131): n is a, c, g, or t
  modified_base (568)..(568): a, c, t, g, unknown or other
  misc_feature (568)..(568): n is a, c, g, or t
tcagagtcgagagacacgaccggtgctcgatttagcgcgtatacaagggggagtcagtctcagtcaggacacagcatggacatgaggtcccgctcagctcctgggctcctgctactctggctccgaggtcnccagactgtgactactccagatcgaccctagtctccactcccgcctgtctgctatcgtgtacgagacagtctacactagtctattcggaccggataagtcaggtacttagttacgactaaactttaagttaagttacggtatacgtaacgaccgtaaccggtaaccccggggtaacgtaccccgttaagttacgtacgtactttacgtacgtacgtcgtacgaccgtacgtacctaagttcgaacgtacgggtaccggtacctagttacgtagggttactacggtacggtacgtacggtacggtacgttacggtaacggtactaagttacccgtgtaccccttagtaaccctacgtactacggacgttcgtaacgttccgaccgtaacgttaacgttaacggttaaacgtttacgggtttaaacggaaaccgttttnttaaacgttaccgtaacgtaaaggggtaaccgggtttaaagttaaacccggttaacgttacgccgggttttaaacgtcgggtttaaccgggaccggtaaaaggtcggtaacgttaagggtacctaaaggtaaaccggttaaacggtaggtacgttacggtacccgacctaacgttcttacttagggtaacccttttcgaaccgttaccccgg

SEQ ID NO: 127529 - DNA, 513 bp, Homo sapiens
  misc_feature: GYAE6OF02FQCRI.49.64.F09.1.454.CMB.1.raw
tcagagtcgagagacacgaccggtgctcgatttagcgcgtatacaaggggagtcgagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccgggaaggccctaagttactgatctatgctgcagccaatttgcaaagtgggtcccatcaaggttcagtggcagtggatctgggacagaattcactctcaccatcagcagtctgcaacctgaagattttggaaagtactattgtcaacagagttacggaaacttgcttcattttcgcgggtaggaaccgaaggtggagtagtaacgaaaagtaactaggtacgacgtaggaccacctagttctcgttcttactacc

SEQ ID NO: 127530 - DNA, 486 bp, Homo sapiens
  misc_feature: GYAE6OF02F44GO.49.64.F09.1.454.CMB.1.raw
tcagagtcgagagacacgaccggtgctcgatttagcgcgtatacaagggggagtcagtctcagtcaggacacaacatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccgggaagcccctaagttactgatctatgctgcagccaatttgcaaagtgggtccatcaaggttcagtggcagtggatctgggacagaattcactctcacatcagcagtctgcaacctgaagatttggaaagttactattgtcaacagagttacggaacttgctcattttcggcgaggaccgaaggtggagatacaaagaactagtaggctgcacatctgtcttcatcc

SEQ ID NO: 127531 - DNA, 504 bp, Homo sapiens
  misc_feature: GYAE6OF02IVZ8E.49.64.F09.1.454.CMB.1.raw
  modified_base (501)..(501): a, c, t, g, unknown or other
  misc_feature (501)..(501): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtccatcaaggttcagtggcagtggatctgggacagaattcactctcaccatcagcagtctgcaacctgaacgtattttaggaaagttacttaattgtactaacagtaagttaacggaaacttgacttctattttcggcggaggaccaagggtggagatacgaaaagaactggtggctgcacatctgtcttntac

SEQ ID NO: 127532 - DNA, 489 bp, Homo sapiens
  misc_feature: GYAE6OF02JEKOM.49.64.F09.1.454.CMB.1.raw
  modified_base (486)..(486): a, c, t, g, unknown or other
  misc_feature (486)..(486): n is a, c, g, or t
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtcccatcaaggttcagtggcagtggatctgggacagaattcactctcaccatcagcagtctgcaactgaagatttggaaagtctattgtcaacagtagttacggaaacttgactctagttttcggcggtaggaccaaggtggagatacgaaaagactgtgctgcacatctgtctntac

SEQ ID NO: 127533 - DNA, 559 bp, Homo sapiens
  misc_feature: GYAE6OF02F7MS3.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccggggaagcccctaagttactgatctatgctgcagccaatttgacaaaggtcgggtcccatcaaggttcagtgcagtgatcgtgggacagaattcactctacaccatcagcagtctgacaactgaagtattttaggaaagttacttattcgtacaaactaggtaagttaacggaaacttgacttacgtacgttttcgggacggtagggaaccgtaagggtcggagtaagtaacgaaaaaggtaacgttaggtacggtacgttaggacctaacctagttccgttacggttccttacgtaacg

SEQ ID NO: 127534 - DNA, 501 bp, Homo sapiens
  misc_feature: GYAE6OF02HCV1G.49.64.F09.1.454.CMB.1.raw
  modified_base (429)..(429): a, c, t, g, unknown or other
  misc_feature (429)..(429): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcatacctggggaagcccctaagttactgatctatgctgcagccaatttgcaaagtggggtccatcaaggttcagtggcagtggatcgtgggacagaattcactctcaccatcagcagtctgcaacctgaagtatttaggaaatactattgacaacagagttaacggaacttgccttntattttcgggacggaagggtaccaagggtgagaagtacgaaaagtactgtaggctgcacatctagtcttacg

SEQ ID NO: 127535 - DNA, 505 bp, Homo sapiens
  misc_feature: GYAE6OF02JDOM0.49.64.F09.1.454.CMB.1.raw
  modified_base (501)..(501): a, c, t, g, unknown or other
  misc_feature (501)..(501): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagattttggaaagttactattgtcaaacagtagttaacggaaactttgcttacgattttcggcggagggaccaagggtgagatcgaaaagactggtggctagcaccatctgttccttntacc

SEQ ID NO: 127536 - DNA, 500 bp, Homo sapiens
  misc_feature: GYAE6OF02HOXL1.49.64.F09.1.454.CMB.1.raw
  modified_base (344)..(344): a, c, t, g, unknown or other
  misc_feature (344)..(344): n is a, c, g, or t
  modified_base (497)..(497): a, c, t, g, unknown or other
  misc_feature (497)..(497): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtcccatcaaggttcagtgcagtgatctggganagaattcactctcaccatcagcagtctgcaactgaagtatttaggaaagttactattgtacaacagtagttaacggaaacttgactactagttttcggacgggtaggaaccgaaggtggagatacgaaagaactgtggctgcacatctgtctntac

SEQ ID NO: 127537 - DNA, 500 bp, Homo sapiens
  misc_feature: GYAE6OF02HTWB2.49.64.F09.1.454.CMB.1.raw
  modified_base (376)..(376): a, c, t, g, unknown or other
  misc_feature (376)..(376): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtcccatcaaggttcagtggcagtggatctgggacagaaattcactctcaaccatcagcagtctncaacctgaagtattttaggaaagttactattgtacaacagagttacgaaacttgactcattttcggcggtaggaccaaggtggagatacgaaaagactgtggactgacacatcgtgtcttctac

SEQ ID NO: 127538 - DNA, 539 bp, Homo sapiens
  misc_feature: GYAE6OF02G5PNK.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgccagccaatttgcaaagtggggtcccatcaaggttcagtggcagtggatctgggacagaattcactctcaccatcagcagtctgcaacctgtaaagtattttaggaaaagttacttaattagtacaaactagtaagttaacggaaacttgactactagttttcggacggtagggaaccgaaggtaggagagtacgaaaagtaaccgttggtacggcgtagactacctagttcctgttccttactacg

SEQ ID NO: 127539 - DNA, 567 bp, Homo sapiens
  misc_feature: GYAE6OF02HQWNY.49.64.F09.1.454.CMB.1.raw
tcagagtcgagagacacgaccggtgctcgatttagcgcgtatacaagggggagtcgagtctcagtacaggacacagcatggacatgagggtccccgctcagctcctgggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaaggcccctaagttactgatctatgctgcagccaatttgcaaagtgggtcccatcaaggttcagtggcagtgatctgggacagaattcactctcaccatcagcagtctgcaacctgaagtattttggaaaagttactagtttagtacaaactaagtaggttaaccggtaaactttggaccttctagtttttccgggcgggtaagggaacccgtaaagggtcgggaagtaacgtaacgaaaaaggtaaccgttaggtaggaccttggaccaacccgtaattccgtacgtttaccttcttaaccg

SEQ ID NO: 127540 - DNA, 498 bp, Homo sapiens
  misc_feature: GYAE6OF02H8P2D.49.64.F09.1.454.CMB.1.raw
  modified_base (495)..(495): a, c, t, g, unknown or other
  misc_feature (495)..(495): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtcccatcaaggttcagtggcagtggatctgggacagaattcactctcaccatcagcagtctgcaacctgaagtattttaggaaagttactattagtacaacagtaagttacggaaacttgacttctattttcggcggagggaccaaggtggagatacgaaagaactgtgctgcacatctgtcttntac

SEQ ID NO: 127541 - DNA, 496 bp, Homo sapiens
  misc_feature: GYAE6OF02HSXFA.49.64.F09.1.454.CMB.1.raw
  modified_base (493)..(493): a, c, t, g, unknown or other
  misc_feature (493)..(493): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaaggcccctaagttactgatctatgctgcagccaatttgcaaagtgggtccatcaaggttcagtggcagtgatctgggacagaattcactctcacatcagcagtctgcaacctgaagatttaggaaagttactattgtacaacagagttacggaaacttgactcattttcggacggaggacaaggtcgagatacgaaaagaacctggtacgctagacacatctagtcttntac

SEQ ID NO: 127542 - DNA, 600 bp, Homo sapiens
  misc_feature: GYAE6OF02FZ6GA.49.64.F09.1.454.CMB.1.raw
  modified_base (365)..(365): a, c, t, g, unknown or other
  misc_feature (365)..(365): n is a, c, g, or t
tcagagtcgagagacacgaccggtgctcgatttagcgcgtatacaagggggaggtcgagtctcagtctaggacacagctaatggacatgagggtccccgctcagctcctggggctcctggctactctggctccgagggtcgccagatgtgacatccagatgaccctagtctccatccgccctgtctgcatctggtaggagacagagtcgaccgatcgatttggccgggcaagtcagagtattagcaactattaaatggtatcagcacgtaccccggggaaggcccctaagtactgatctatgctgcagccaattgcaaagtgggtaccatcagttcagtgcagtgatcgtggacagattcactcncacatcagcagtctgacaacctagaacgtattttaggaaacgttacttagttacgtacgaacgtaggtaacgttaaccggaaactttcgacttacgtacgttttaccgggggaacggtacccgtaaagggtaggtaacggtacgttaaccgaaaaggtaaccgttacggttacgggtacctacggaccgtaacccgtagttcccgttacggtccctttacgaccgtttaccccgg

SEQ ID NO: 127543 - DNA, 495 bp, Homo sapiens
  misc_feature: GYAE6OF02H6OD6.49.64.F09.1.454.CMB.1.raw
  modified_base (492)..(492): a, c, t, g, unknown or other
  misc_feature (492)..(492): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaatttgacaaagtgggtccatcaaggttcagtgcagtgatctggacagaattcactctcacatcagcagtctgcaactgaagtattttaggaaagttactattgtacaacagtagttaacggaaacttgacttctagttttcggacggtaggacctaaggtgagtatacgaaagactggtgctgcacatctgtctntac

SEQ ID NO: 127544 - DNA, 730 bp, Homo sapiens
  misc_feature: GYAE6OF02GOGGR.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcaggtatagtagactaacttaatttaaagttaggtatacgacgactaaccggtaaaccccgggggaaccggtacccccgttaaacgtttacgtagtactacttaagtcgtcgtcgacgacgaccttaagtttcgaacgtaaagggttccgggtaccctactacggtaacggttacgtaaggtcggacgtaggtaggtacttcggtacgggaacgtaagttaacttacgtaccttcctaccgaacctactacgacgacgtacgtcgtcgaacctaaccgtaaggtaacgtttaagtttaagggtaaacgttaacgttaagttacgtaacaaacgtaaggttaacggttaaaccggtaaacgttcgtacgttacgttacggttttaccgggaacgggtaacgggaaccgtaagggtaggagtaacgtaaacgaaaacgttaacgttaggtacggttaccgttaccgtaaccgtacgttaccgttacgtttaccttacgtacttttacccccgg

SEQ ID NO: 127545 - DNA, 487 bp, Homo sapiens
  misc_feature: GYAE6OF02GCKUH.49.64.F09.1.454.CMB.1.raw
  modified_base (484)..(484): a, c, t, g, unknown or other
  misc_feature (484)..(484): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagtactgatctatgctgcagccaatttgcaaagtgggtcccatcaaggttcagtggcagtggatcgtgggacagaattcactctcaccatcagcagtctgcaactgaagatttggaaatactattgtacaacagagttacggaaacttgacttcattttcggcggtaggaccaaggtggagatacaaagactgtggctgcacatctgtctntac

SEQ ID NO: 127546 - DNA, 490 bp, Homo sapiens
  misc_feature: GYAE6OF02JHKGH.49.64.F09.1.454.CMB.1.raw
  modified_base (487)..(487): a, c, t, g, unknown or other
  misc_feature (487)..(487): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtcccatcaaggttcagtggcagtggatctgggacagaattcactctcaccatcagcagtctgcaactgaagatttggaaagtactattgtcaacagtagttacggaaacttgctactattttcggcggtaggaccaaggtgagatacgaaagactgtaggctagcacatctgtcttntac

SEQ ID NO: 127547 - DNA, 532 bp, Homo sapiens
  misc_feature: GYAE6OF02GFEPH.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccgggaaggcccctaagttactgatctatgctgcagccaatttgcaaagtgggtccatcaaggttcagtgcagtgatctggacagattcactctcacatcagcagtctgcaacctgaagtattttaggaaagtactattgtacaacagtaagttaacggaaactttgacttactagtttttcggacggtacgggtaaccaagggtaggagacgttaacgaaaaaggtaacgttggtaggtacgtagaccaaccgtattcctagttccttataccg

SEQ ID NO: 127548 - DNA, 562 bp, Homo sapiens
  misc_feature: GYAE6OF02HE6F7.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcatacccgggaagccctaagttactgatctatgctgcagccaatttgcaaagtgggtcccatcaaggttcagtgcagtggatcgtgggacagaattcactctcaccatcagcagtctgcaactgaaagtattttaggaaagttacttaattgtactaaactaggtaacgtttaacggaaactttggaccttacgtacgttttcgggacgggtaagggacccgtaaagggttgggagtaacgtacgaaaaaaggtacgttagggtacggtactaggacctaaccgtaattccgttacgttccttacgtaacc

SEQ ID NO: 127549 - DNA, 487 bp, Homo sapiens
  misc_feature: GYAE6OF02HL76V.49.64.F09.1.454.CMB.1.raw
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtggggtcccatcaaggttcagtggcagtggatctgggacagaattcactctcacatcagcagtctgcaactgaagatttggaaattactattgtcaacagagttaacggaacttgcttcattttcggcggaggaccaaggtggagatacgaaagaactgtagctgcaccatctgtcttctac

SEQ ID NO: 127550 - DNA, 528 bp, Homo sapiens
  misc_feature: GYAE6OF02IXYES.49.64.F09.1.454.CMB.1.raw
  modified_base (417)..(417): a, c, t, g, unknown or other
  misc_feature (417)..(417): n is a, c, g, or t
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtatagcaactatttaaatggtatcagcagtacccgggaagcccctaagttactgatctatgactgcagcctaatttgactaaagtcgggtacccagtctaaggttcaggttgcaggtggatcgtagggactagaattcgactctacacatcagcagtctgacaactgaagtatttaggaaattatattgacaanaggtaacgttaacggtaattgacttacgtagtttcggacgtagggacctaagggtgagtataaccggaaaatactggtacggctagaccgactattgtacgttctataccg

SEQ ID NO: 127551 - DNA, 494 bp, Homo sapiens
  misc_feature: GYAE6OF02GJMLW.49.64.F09.1.454.CMB.1.raw
  modified_base (491)..(491): a, c, t, g, unknown or other
  misc_feature (491)..(491): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtcccatcaaggttcagtggcagtggatctgggacagaattcactctcaccatcagcagtctgcaacctgaagattttaggaaagttactattgtacaacagagttaacggaaacttgcttctagttttcggcggtaggaccaaggtggagatacgaaagactgtgctgacacatctgtctntac

SEQ ID NO: 127552 - DNA, 533 bp, Homo sapiens
  misc_feature: GYAE6OF02IKJEP.49.64.F09.1.454.CMB.1.raw
  modified_base (370)..(370): a, c, t, g, unknown or other
  misc_feature (370)..(370): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgacaaagtgggtcccatcaaggttcagtgcagtgatcgtgggacagattcactctcaccatcagcagtcngacaacctgaagtatttaggaaagttactattagtacaaacagtaagttaacggtaaactttgactctagttttcggacgggtaggaaccgtaagggtggagagtaacgaaaagtaactaggtcggactaggactaaccgtattacgtagttccttactaccg

SEQ ID NO: 127553 - DNA, 497 bp, Homo sapiens
  misc_feature: GYAE6OF02GIL7F.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtggggtccatcaaggttcagtggcagtggatctgggacagaattcactctcaccatcagcagtctgcaacctgaagattttggaaagtactattgtcaacagaagttacggaaacttgctctattttcggcggtaggacaaggtggagatacgaaaagaactggtaggactgacaccgatctcgtctctac

SEQ ID NO: 127554 - DNA, 500 bp, Homo sapiens
  misc_feature: GYAE6OF02GK32U.49.64.F09.1.454.CMB.1.raw
  modified_base (497)..(497): a, c, t, g, unknown or other
  misc_feature (497)..(497): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaatttgcaaagtgggtcccatcaaggttcagtggcagtggatcgtgggacagaattcactctcacatcagcagtctgcaacctgaagtattttaggaaagttactattgtacaacagagttaacggaaacttgacttctattttcggcggtaggacaaggtggagagtacgaaagactaggtagctgacacatctgttctntac

SEQ ID NO: 127555 - DNA, 489 bp, Homo sapiens
  misc_feature: GYAE6OF02FXB1K.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccgggaagcccctaagtactgatctatgctgcagccaatttgcaaagtgggtcccatcaaggttcagtggcagtggatctgggacagaattcactctcaccatcagcagtctgcaacctgaagattttggaaagtacttattgtcaacagagttacggaaattgactcattttcgcggagggaccaaggtggagatacgaaaagaactagtgctgacacatctgtcttctac

SEQ ID NO: 127556 - DNA, 558 bp, Homo sapiens
  misc_feature: GYAE6OF02G3XWI.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcacgtaccccggggaacgcccctaagttactgatctatgctgcagcctaatttgacgtaaaggtcggggtcccaagtacgtaaggttcaggtggctaggtggatcgtgggacagtaattcactctcacatcagtcagtctgacaactgtaagtagttttaggaaaactttcgttattgtacaaagtagtagttaacggaaacttgtactactacgtttacggcgggacggtaaccgtaggtaggagtaagtaacgaaaagtaacgttaggaggtctacgacacacttacgtcgttcttctaaccg

SEQ ID NO: 127557 - DNA, 523 bp, Homo sapiens
  misc_feature: GYAE6OF02JCX4F.49.64.F09.1.454.CMB.1.raw
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
tcagagtcgagagacacgaccggtgctcgatttagcgcgtatacaaggggaggtcagtctcagtcaggacacagcatggacatgagggtcccgctcacgctcctgggctcctgctactctggctccgaggtgccagatgtgacatccagatgacccagtctccatccgccctgtctgcatctgtaggagacagagtcaccatcatttgccgggcaagtcagagtattagcaactatttaaatggtatcagcataccccgggaagcccctaagttactgatctatgactgcagccaatttgcaaagtgggtacccatcaagttcagtganagtgatcgnggacagaattcactctcaccatcancagtctancaactgaagtatttaggaaagtacttaattgtactaacagtaagttacggaaactttgacttactattttcgggcggtaaggaccaagggtcggagagttacgaaaagtacttaggtggtacttagacctacgattcgtagttcttacgtac

SEQ ID NO: 127558 - DNA, 527 bp, Homo sapiens
  misc_feature: GYAE6OF02IJL22.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccgggaagccctaagttactgatctatgctgcagccaatttgacaaagtgggtcccatcaaggttcagtgcagtggatctgggacagaattcactctcaccatcagcagtctgacaacctgaagtattttaggaaagttactattagtacaacaagtagttacggaaactttgacttctattttaccgggacggacgggtaaccaagggttaggacgtataaccgaaaagtaacgtggttaggctaggcaacctatcctgttcttactac

SEQ ID NO: 127559 - DNA, 531 bp, Homo sapiens
  misc_feature: GYAE6OF02JAWZY.49.64.F09.1.454.CMB.1.raw
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
tcagagtcgagagacacgaccggtgctcgatttagcgcgtatacaagggggagtcagtctcagtcaggacacagcatggacatgagggtccccgctcagctcctgggctcctgctactctggctccgaggtgcccagatgtgacatccagatgacccagtctccatccgccctgtctgcatctgtaggagacagagtcaccatcatttgccgggcaagtcagagtattagcaactattaaattggtatcagcataccccgggaagcccctaagttactgatctatgctgcagccaatttgcaaagtgggtaccatcaaggttcagtgcagtggatctgggacagaattcactctacacatcancagtcngacaacctgaacgtatttacggaaagttacttagttagtactaacagtagttaacggtaaactttgacttcgttagtttcgggacggaaggaccgaagggttgagtatacgaaaagtaacgtaggtagtacgtgacactactacgtcgttaccttactaccg

SEQ ID NO: 127560 - DNA, 532 bp, Homo sapiens
  misc_feature: GYAE6OF02I8GX5.49.64.F09.1.454.CMB.1.raw
  modified_base (409)..(409): a, c, t, g, unknown or other
  misc_feature (409)..(409): n is a, c, g, or t
tcagagtcgagagacacgaccggtgctcgatttagcgcgtatacaaggggagtcagtctcagtcaggacacagcatggacatgagggtccccgctcagctcctgggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagtactgatctatgctgcagccaatttgacaaagtgggtcccatcaaggttcagtggcagtggatcgtgggacagtattcactctcacatcagcagtctgcaactgaagtattttggaaattacttattcgtacaaanagtagttaacggtaaacttcgacttactagtttttcgggacggtagggaaccgtagggtaggagaagtacgaaaaacggacttaggtcggacttgaccactacgtcttacgtcctttctaccg

SEQ ID NO: 127561 - DNA, 613 bp, Homo sapiens
  misc_feature: GYAE6OF02I0LSZ.49.64.F09.1.454.CMB.1.raw
tcagagtcgagagacacgaccggtgctcgatttagcgcgtatacaagggggaggtcagtctcagtcaggacacagcatggacatgagggtccccgctcacgctcctggggctcctggctactctggctccgaggtgccagatgtagacatccagatcgacccagtcctccatccgccctgtctgcatctgtaggagacagagtcacctatccatttcgccgggtcaagtcagagtattagactaattatttaaattgtatacagcacgtacccgggaagtccccgtaagttacctgactctagtgtctgcagcctaatttcgacgtaaaggtcgggtaccctagtacgtaacggttcaggtggacaggtggatcggtaggaacagtaattccacttcctacacctatcagctagtctcacctaacgtagtaagtagttttaggaaattacttacgttagtaactaacgtagtaacgttacggaaactttcggtaccttacgttacgtttaccgggaacggtacggaaccggtaaggtacggataacgtaacgtaaaagggtctaagggtcggactccgacgtaacctagttacctacgtttcctactaacccg

SEQ ID NO: 127562 - DNA, 550 bp, Homo sapiens
  misc_feature: GYAE6OF02I7GGO.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagccctaagttactgatctatgctgcagccaatttgcaaagtgggtcccatcaagttcagtggcagtggatcgtgggacagaattcactctcaccatcagcagtctgacaacctgaagtattttaggaaaattacttaattgtacaaactagtaagttaacggaaactttgaccttcgttaattttccgggacgggtaacggaaccgtaagggtacgggagtaacgtaacgaaaaggtaacgttaggtcggtacgtggaccaaccgtatccttgttacttctaccg

SEQ ID NO: 127563 - DNA, 562 bp, Homo sapiens
  misc_feature: GYAE6OF02GFJTU.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtatgcatctgtaggagacagagtcaccatcatttgccgggcaagtcagagtattagcaactattaaattggtatcagcataccccgggaaggcccctaagttactgatctatgctgcagccaatttgcaaagtgggtcccatcaaggttcagtggcagtggatcgtgggacagaattcactctcaccatcagcagtctgcaacctgaagtattttaggaaagtacttattcgtacaactagaagtttaacggaaactttgacttcgtaagtttttccgggacggtaagggtaacccgaagggttggaggtaagttacgaaaaaggtaaccttaggtaggtaccgttaggacctaacccgaagttccgtagttacccttacttaacccg

SEQ ID NO: 127564 - DNA, 586 bp, Homo sapiens
  misc_feature: GYAE6OF02HZYO5.49.64.F09.1.454.CMB.1.raw
tcagagtcgagagacacgaccggtgctcgatttagcgcgtatacaagggggagtcagtactcacgtcagggacacacgcatggacatgagggtccccgctcagctcctggggctcctgctactctggctccgaggtgccagatgtcgacactccagatgacccagtctccatccgccctgtctgcatctgtagggagacagagtcaccatcattgccgggcaagtcagtagtattagcaattatttaaattggtatcagcacgtaccccggggaagcccctaagttactgatctagtgctgcagcctaatttgacaaaggtcgggtacccatacaaggttcagtggcagtggatcgtagggacagtaacttcactcctacaccatcagcagtctcgacaacctagaagtagttttaggaaattacgtattcgtacaagtaagtagttaacggaaactttgacgttacgtagttttcgggacggtacgggaaccgtaagggtaggaagtaagtaacggtaaaaaggtaacgtttaggacggtaccgtacgacctaaccctagttccgtttaggtaccttacgtaccg

SEQ ID NO: 127565 - DNA, 575 bp, Homo sapiens
  misc_feature: GYAE6OF02HPJV6.49.64.F09.1.454.CMB.1.raw
  modified_base (352)..(352): a, c, t, g, unknown or other
  misc_feature (352)..(352): n is a, c, g, or t
tcagagtcgagagacacgaccggtgctcgatttagcgcgtatacaagggggagtcgaggtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcactaccccggggaaggcccctaagttacctagattctatgctgcagcctaatttgactaaagtgggtcccatcaaggttcagtggacagtggatcgngggacagaattcactctcaccatcagcagtctgctaacctgaaagtatttaggaaagttactattcgacaacgtagtacgttaacggaaacttgacttacgtagttttccgggacgggtaaggtaaccgtaagggtcggagtacgtaacgaaaaacggtaccttaggtacggaccgttacggaccgtaacccgtagttccgttacgttcccttacctaacccg

SEQ ID NO: 127566 - DNA, 563 bp, Homo sapiens
  misc_feature: GYAE6OF02F4TRQ.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagtactgatctatgctgcagccaatttgcaaagtgggtcccatcaaggttcagtggcagtggatcgtgggacagaattcactctcacatcagcagtctgactaactgaaagtattttaggaaagttacttaattgtacaaactagtaacgttaacggaaactttgacttacgtagttttcgggacggtaagggtaccgtaagggttaggagtaagtaacgaaaaaggtaacgttagggtacggtacgtaggtacctaaccgtagttccgttaggttaccttacgtaaccg

SEQ ID NO: 127567 - DNA, 513 bp, Homo sapiens
  misc_feature: GYAE6OF02I8Y16.49.64.F09.1.454.CMB.1.raw
  modified_base (508)..(508): a, c, t, g, unknown or other
  misc_feature (508)..(508): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactggatctatgctgcagccaatttgcaaagtgggtccatcaaggttcagtggcagtggatcgtgggacagaattcactctcaccatcagcagtctgcaacctgaagtattttaggaaagttactattgacaacagtagttacgtaaacttcgacttacgtattttcgggacggtagggaccaagggtgagatacgaaaagtaactggtggctggcaccatctgttccttntaccg

SEQ ID NO: 127568 - DNA, 596 bp, Homo sapiens
  misc_feature: GYAE6OF02IN065.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgcctgtctgcatctgtaggagacagagtcaccatcatttgccgggcaagtcagagtattagctaactatttaaattggtatcagcagtaccccggggaagcccctaagttactgatctatgctgcagccaatttgacaaaggttcgggtacccatcgtaaaggttcaagtggactagtggatcgtgggacagaacttcgactctcactatcagactagtctgacaaccttagaaagtaagttttaggaaaacgtttacttattacgtactaacgtaagtaacgttaacggtaaacttcgtacttacgttacgttttacgggacgggtaagggtaaccgtaagggtacggaagtaacgtaacgtaaaaaggtaacgtaggtacggtacgtacggtactaccgtaagtaccgttagttaccttactaccg

SEQ ID NO: 127569 - DNA, 545 bp, Homo sapiens
  misc_feature: GYAE6OF02IT079.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaatttgctaaagtgggtcccatcaaggttcagtggcagtggatcgtgggacagaattcactctcaccatcagcagtctgacaacctgaacgtattttaggaaattacttattagtacaacaggtaagttaacggaaactttgacttacgtagttttccgggacggtaacgggtaccaaggggtgagtaagtacgaaaaaggtactggtacggtctaggacctaccgtagttccgtagttccttactacg

SEQ ID NO: 127570 - DNA, 562 bp, Homo sapiens
  misc_feature: GYAE6OF02HYLN7.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagcctaatttgacaaagtcggggtacccatcaaggttcagtggcaggtggatcgtagggacagtaattcactctcacatcagcagtctgactaactagaagtaattttaggaaaacgttacttaattacgtacaaacgtagtaagttaacggtaaactttcgacttactaagttttccgggacgggtaacggaaccgaagggtaggagtaataacgaaaaggtactaggtacggactaggacctacgtacgtcgttagttcctactaccg

SEQ ID NO: 127571 - DNA, 565 bp, Homo sapiens
  misc_feature: GYAE6OF02JC94B.49.64.F09.1.454.CMB.1.raw
  modified_base (367)..(367): a, c, t, g, unknown or other
  misc_feature (367)..(367): n is a, c, g, or t
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttcgccgggcaagtcagtagtattagcaactattaaatgtatcagcacgtaccccggggaagtccccgttaagtctgatctatgctgcagccaatttgccaaagtgggtcccatcaaggttcagtgcagtggatctgggacagaattcactctcacatcgancagtctgacctaacctgaatatttacgggaaattactattccgtacaaactagtagttaacgggtaaacttggcttacgtagtttttccgggacggtaacgggaaccgtaagggttggaacgtagttaaccgaaaagtaaccgtgggttacggcttacggacctaacctattaccgtacggtttccttaacttcccgg

SEQ ID NO: 127572 - DNA, 527 bp, Homo sapiens
  misc_feature: GYAE6OF02JIVWE.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagtactgatctatgctgcagccaatttgctaaagtgggtcccatcaaggttcagtgcagtgatcgtggacagaattcactctcaccatcagcagtctgacaacctgaagtagttttaggaaagttactattagtacaacagtagttaacggaaacttgactactagttttcggacggtacggaaccgaaggtaggagtaatacgaaaagtaacgtaggtacggtacgtagaccgaccatccgtagtcttctaccg

SEQ ID NO: 127573 - DNA, 571 bp, Homo sapiens
  misc_feature: GYAE6OF02HRP80.49.64.F09.1.454.CMB.1.raw
  modified_base (249)..(249): a, c, t, g, unknown or other
  misc_feature (249)..(249): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgcgggcaagtcagagtattagcaactatttaaattggtatnagcatacccgggaaggcccctaagttactgatctatgctgcagcctaatttgactaaagtgggtacccaatccgaaggttcagtggacagtggatcgtagggacagtaattcactctcaccatcagctagtctagcaacctgaaagtattttaaggaaagttactaattgtacaaacaagtagttaagtacggtaaatttcgacttacttacgttttccgggacggaacgggtaccgaaggtagggaagtaacgtaacgaaaaacggtacgtaggtacggtacgtacggaccaaccgtacgttaccgttagtcctttaaccg

SEQ ID NO: 127574 - DNA, 512 bp, Homo sapiens
  misc_feature: GYAE6OF02GGJM2.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtcccatcaaggttcagtggcagtggatctgggacagaattcactctcaccatcagcagtctgcaacctgaagattttagggaaatactaattgtacaaacgtagagttaacggaaacttgacttctagttttacggcggagggtaccaagggtggagagtacgaaaagactggtagcgtagctaccgatctgtcttctac

SEQ ID NO: 127575 - DNA, 520 bp, Homo sapiens
  misc_feature: GYAE6OF02I9EWB.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaattgcaaagtgggtccatcaaggttcagtggcagtgatcgtgggacagattcactctacaccatcagcagtctgcaaccgtgaagtattttaggaaattactattgtacaacgtagtagttacggaaacttgactagtagttttccggacggtacggaacgtaaggtggagtagtacgaaagtaaccgtggtcgcgtagacactattctagttcttacgtacc

SEQ ID NO: 127576 - DNA, 574 bp, Homo sapiens
  misc_feature: GYAE6OF02HS091.49.64.F09.1.454.CMB.1.raw
  modified_base (280)..(280): a, c, t, g, unknown or other
  misc_feature (280)..(280): n is a, c, g, or t
tcagagtcgagagacacgaccggtgctcgatttagcgcgtatacaaggggagtcagtctcagtcaggacacagcatggacatgagggtcccgctcagctcctgggctcctgctactctggctccgaggtgccagatgtgacatccagatgacccagtctccatccgccctgtctgcatctgtagagacagagtcacatcattgcgggcaagtcagagtattagcaactaattaaatgtatcagctactaccgggaagccctaagtacctagactctatcntgcagcctaatttgacaaagtcgggtaccatacgtaaggtacagtagcagttaggactgtagggacaagtaaactcactctacaccatccagactaagtctagacacgtacgaaagtacgtttaagaaaagttactaattacgaactactaagaaggtttaaaccgaaacttacgcttacaagtttttccgcggggtaaacggtaacgaacgggttggaacgggtaacttacggaaaaagtaaacctgggtaacggtacgtacgacgaacctattccggtattcctagttaacc

SEQ ID NO: 127577 - DNA, 580 bp, Homo sapiens
  misc_feature: GYAE6OF02HI437.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagccctaagtactgatctatgctgcagcctaatttgctaaagtcgggtcccatcaaggttcagtggcagtggatctggacagattcactctcaccatcagcagtctgacaacctgaaacgtagttttagggaaagttacttaatttacggtaacaaactaaggtaacggttaaacgggtaaaactttggacctttacgttagttttaccggggacgggtaacgggtaactaaggggtaggagtaagtaaccgaaaaaggtacctagggtagaccgtaggtacccaccgtaagttccttaggtcctttactaaccg

SEQ ID NO: 127578 - DNA, 501 bp, Homo sapiens
  misc_feature: GYAE6OF02IF0KU.49.64.F09.1.454.CMB.1.raw
  modified_base (499)..(499): a, c, t, g, unknown or other
  misc_feature (499)..(499): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagatattagcaactattaaattggtatcagcataccccggggaagccctaagtactgatctatgctgcagccaatttgacaaagtgggtacccatcaaggttcagtgcagtgatctgggacagaattcactctcacatcagcagtctgacaaccgtagaagtattttaggaaagttactagttagtacaacagtagttaacggaaacttgacttctagtttcgggacggaggaccaaggtgagatacgaaagactggtgctagcacattctcgtacttnac

SEQ ID NO: 127579 - DNA, 606 bp, Homo sapiens
  misc_feature: GYAE6OF02JHDQU.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaatttgacaaagtcgggtcccatcaaggttcagtggcagtggatcgtggacagaattcactctcacatcagcacgtctcgacaacctgaacgttagtttaggaaacgttacgttattacggtactaaaacgtcggtaagtttaaccggtaaaacttcgtaccgtttaccttaaggtttttccgggacggggtaacgggtaacccgtaaggggttacgggtaacgtaacgtaacgtaaaaacgggtacttagggtacggtaccgttaggacccgtaaccgttacgttaccgttcggttacgttcctaaccg

SEQ ID NO: 127580 - DNA, 690 bp, Homo sapiens
  misc_feature: GYAE6OF02IDYJW.49.64.F09.1.454.CMB.1.raw
tcagagtcgagagacacgaccggtgctcgatttagcgcgtatacaagggggagtcagtctcagtcaggacacagcatggacatgaggtccccgctcagctcctggggctcctgctactctggctccgaggtgccagatgtgacatccagatgacccagtctccatccgccctgtctgcatctgtaggagacagagtcaccatcatttgccgggcaagtcagagtattagactaacttaatttaaattggtatcagcacgtaccccggggaagcccctaagttactgatctatgctgcagcctaatttgacgtaaaggttcggggtaccctagtacgtaaggttcaggtggcgtaggtgacgtcgtagggactaagtaacttcaccttcctaccaaccatcacgcctagtcctacgacctaaccgtagtaacgttaagttttaacgggaaacgtttacgttaagtttacgttaactaaacgtaaggttaacggtttaaaccgggtaaacctttacggtacccttacggttacgtttttaccggggaccgggttaacggggaacccgtaaggggttacggtaacggttaacgtaaccggtaaaaacggtaaccggttagggtaacgggttaccgtacggtacccgtaaccgttaaccgttaccgtttacggtttccctttacgttaaccccg

SEQ ID NO: 127581 - DNA, 672 bp, Homo sapiens
  misc_feature: GYAE6OF02IQI7V.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattgtatcagctacgtacccgggacgaccctaagtactgatctagtcgctcgcacgacctaagtttcgacgtaagggtcgggtaccagtacgtaaggttctaggtggctaggtaggtagttcgtagggaactaagtaattccactttcctacaaccctagtccaagacgtacgtctacgaccaaccgttaggtaacgttagttttaacgggaaatttacttagttacgtaacaaacgtagttaacggtaacggttaaacgttagtcttaacgttacggttttaccgggaccggggtaacgggtaaacccggtaaggggttacgggtaacgtaacggtaaaccggaaaaacggttaacggttcgggtaacgggtaccgttaacggacccgttaacccgtagttaccgttacggtttaccttaccttaacccg

SEQ ID NO: 127582 - DNA, 601 bp, Homo sapiens
  misc_feature: GYAE6OF02GGWDX.49.64.F09.1.454.CMB.1.raw
tcagagtcgagagacacgaccggtgctcgatttagcgcgtatacaagggggaaggtcagtctcagtcaggaccaccagcatggacatgagggtccccgcgtcagctccgtggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcataccccggggaaggcccctaagttactgatctatgctgcagcctaatttgacaaagtcggggtacccatcgaaaggttcaagtggcgagtcggatcgtggacagtaattcgactctacaccatacagcagtctagcaacctgaacgtagttttaggaaagttacttagttacgtacaaactaggtaacggttaacggtaaactttcgtacttacgttacgttttaccgggacgggtaacgggtaaccgtaaggggtcggaagtaacgtaacgaaaaaggtaacgtaggtaacggtcgttaggacctacccgtagttccgtacgtttaccttcttaacccg

SEQ ID NO: 127583 - DNA, 535 bp, Homo sapiens
  misc_feature: GYAE6OF02H8OM3.49.64.F09.1.454.CMB.1.raw
  modified_base (418)..(418): a, c, t, g, unknown or other
  misc_feature (418)..(418): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactaatttaaattggtatcagcataccccggggaagcccctaagttactgatctatgctgcagccaatttgcaaagtgggtcccatcaaggttcagtggcaggtggatcgtagggcaagtaattcactctaccacctatcagcagtctgcaacctgaagtatttaggaaagttatattagtacaanagtagtttaacggaaacttgctactagttttcggacggtaggacgaagggtggagtaagtacgaaaagtaactaggtacgtacgtgaccaccgtattcgttacgttacttctaaccg

SEQ ID NO: 127584 - DNA, 522 bp, Homo sapiens
  misc_feature: GYAE6OF02F9L2O.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagttactgatctatgctgcagccaatttgacaaaggtgggtcccatcaaggttcagtggcagtgatcgtgggacagaattcactctcaccatcagcagtctgacaacctagaagtagttttaggaaattacgttaattacgtacaaactagtaagttaacggaaacttgacttctagttttcggacggtaggaaccgaagggtggagagtacgaaagacgtagtagcgtagacacatctgttcttctac

SEQ ID NO: 127585 - DNA, 542 bp, Homo sapiens
  misc_feature: GYAE6OF02II507.49.64.F09.1.454.CMB.1.raw
  modified_base (336)..(336): a, c, t, g, unknown or other
  misc_feature (336)..(336): n is a, c, g, or t
  modified_base (407)..(407): a, c, t, g, unknown or other
  misc_feature (407)..(407): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtccatcaaggttcagtgcagtgatcngggacagaattcactctcaccatcagcagtctgacaacctgaagtatttaggaaagttactattgtacaanagtagttaacggaaactttgacttactagttttcgggacggtaagggtaacctaagggtggaagtagtaacgaaaaggtaaccgtggtacgggacttaggaccaacccgtagttcctagttcccttactaacccg

SEQ ID NO: 127586 - DNA, 523 bp, Homo sapiens
  misc_feature: GYAE6OF02FYK5J.49.64.F09.1.454.CMB.1.raw
  modified_base (436)..(436): a, c, t, g, unknown or other
  misc_feature (436)..(436): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagccctaagttactgatctatgctgcagccaatttgacaagtgggtccatcaaggttcagtgcagtggatcgtggacagaattcactctcacatcagcagtctgacaacctgaagtattttaggaaagttacttattcgtactaagaagtaagttaacggaaacttgacttntagttttcggacggaggtaaccgaaggtaggagagtacgtaaaaggactaggtacggcgtagcacctatcgttcgtaccttgtaccg

SEQ ID NO: 127587 - DNA, 571 bp, Homo sapiens
  misc_feature: GYAE6OF02HQVRB.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagcaactatttaaattggtatcagcataccccggggaagcccctaagttactgatctatgctgcagccaatttgactaaaggtcggggtacccagtactaaggttcagttcggcaggtggtaatcgtagggacagtaattcactctacacatcagcagtctgacaacctgaagtagtttaggaaattactatttgacaaacgtagtaagttacgaaactttggacttacgttagttttacgggacgggtacggaacccgtaagggtacggagtaacgtaacgaaaaggtacgtagggtacggtacgttcggactaccgtaagttccgtacgttacttctaaccg

SEQ ID NO: 127588 - DNA, 524 bp, Homo sapiens
  misc_feature: GYAE6OF02FSRQ2.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccgggaagcccctaagttactgatctatgctgcagccaatttgcaaagtgggtcccatcaaggttcagtgcagtgatctgggacagaattcactctcaccatcagcagtctgcaacctgaagtattttaggaaattactattgtacaactagagttaacggaacttgacttactagttttcggacggtaaggaccgtaagggtggagagtacgaaaaaggtacgttaggtaggactagctaaccagttcctaggttccttactaccg

SEQ ID NO: 127589 - DNA, 570 bp, Homo sapiens
  misc_feature: GYAE6OF02ISC1N.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcacgtaccccggggaagcccctaagttactgatctatgctgcagcctaatttgactaaaggtcgggtcccatcgaaggttcagtggcaggtggatcgtagggacagtaattcactctacacatcagcagtctagactaactagtaagtagttttaggaaagttactattgtactaaacgtagtaagttaacggtaacttgacttacgtagttttccggggacggtaacgggtaaccgaagggtggaagtacgtaacgaaaaggtaacgtagggtagtacgtagacctaacgtacttcgttacgttaccttactaccg

SEQ ID NO: 127590 - DNA, 554 bp, Homo sapiens
  misc_feature: GYAE6OF02IDR6G.49.64.F09.1.454.CMB.1.raw
tcagagtcgagagacacgaccggtgctcgatttagcgcgtatacaagggggagtcagtctcagtcaggacacagcatggacatgagggtccccgctcagctcctgggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcagtaccccgggaagcccctaagttactgatctatgctgcagccaatttgacaaaggtgggtcccatcgaaagttcagtggcagtgatcgtagggacagtaatcactctcacctatcagcagtctagccaactgtaagtattttaggaaatttactagttagtacaactaagtagttaacggtaaattcgacttagttacgttttcgggcggtaagggacctaagggtggaacgtaagtaaccgaaaaggtaacgtggtacggtactgaccgtaaccgtattcgttacgttcctacttaaccg

SEQ ID NO: 127591 - DNA, 717 bp, Homo sapiens
  misc_feature: GYAE6OF02H9PRN.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcacatctatttgccgggacaagtcagagttattagactaacttaatttaaattggtatcagtcacgtaacccggggaagtacccctaagttactgatctatgctgcagtacctaatttcgacgtaaaggtcgggtacccaagtaccgtaaaggttacaggttacggcgtaaggtcggatcggtagggaactaagtaacttcgactcctacaacctatacgacgactacgtctacgacctaacgtagaaagttagtttaaggaaaacgtttacttaagttacgtaactaaacgtaacggttaacggttaaaccggtaaactttcggtaacttacgttaacggtttttacggggaaccgggtaaacgggtaaaccggtaaggggttacggaacgttaaacgttaaaccggtaaaaaacgggtaaccggttacggggttaacgggtaccgttaaccggtaacccgtaaacccggttaacgtttaccggtttaccggtttaccctttaaccggtttaaccccg

SEQ ID NO: 127592 - DNA, 663 bp, Homo sapiens
  misc_feature: GYAE6OF02JAUPR.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtcctccatccgccctgtctgcatctgtaggagacagagtcaccatcattgccgggacaagtcagagtattagactaactatttaaattgtactcagcaacgtacccggggaagccctaagttactgatctatgctgctagctaattgactaaaggtcgggtaccatacgaaggttcagtggacaggtaggtatacggtagggaactaggtaaacttcgtaacctctaccaaccgtactaccgtagaactaggtactcgaacctaaacgtagtaaacgtttaagttttaaggaaacgtttacttaagttacgtaactaaacgtaaggttaaacggttaaacggtaaacctttacgggtaccttaacgttaacggttttccggggaacggttaaaccgggaaccgggtaaagggtacgggaagtaacgttaaacgaaaaacggtaacgttacgggtaggtaccttacggactaccctagttaccgtggtttaccctaccgttaccg

SEQ ID NO: 127593 - DNA, 528 bp, Homo sapiens
  misc_feature: GYAE6OF02FIJKE.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccggggaagcccctaagttactgatctatgctgcagccaatttgcaaagtgggtcccatcaaggttcagtggcagtggatctgggacagaattcactctcaccatcagcagtctgcaacctgaagtattttaggaaattactaattgtacaacagtagttaacggaaacttgacttactagttttcgggcggtaagggaccgtaaggtggagataacgaaaaagaccttaggtacggtactagtacaccaattccgtagttacttctaacg

SEQ ID NO: 127594 - DNA, 527 bp, Homo sapiens
  misc_feature: GYAE6OF02JSYAU.49.64.F09.1.454.CMB.1.raw
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtagagacagagtcaccatcatttgccggcaagtcagagtattagcaactatttaaatgtatcagcatacccgggaagccctaagtactgatctatgctgcagccaatttgactaaagtcgggtccaatcaaaggttcaagtgcagtgatcgtgggactagaattcactctacacatcagtcagtctgacaactagtaagtattttaggaaatttactattgaacaagacgtaagtaaccggtaattgacttataagtttcgaaggtaggtaacctaagggtgatagtaacgaaaaggtacctggtaacgtctacggacacctagttctacgttcttactaaccg

SEQ ID NO: 127595 - DNA, 545 bp, Homo sapiens
  misc_feature: GYAE6OF02GEKVT.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccggggaagcccctaagtactgatctatgctgcagccaatttgactaaaagtggggtacccagtcaagttcagtggcagtgatcgtgggacagaattcactctcaccatcagctagtctgaccaactgaagtagtttaggaaatactattgtacaatagagttacgtaaacttgactactacgttttcgggacggtaggaaccgtaaggtaggagtaacgtaacgaaaaacggtaacttaggtacggtacgtagaccaacctaacgtccttcgttaccttactaaccg

SEQ ID NO: 127596 - DNA, 543 bp, Homo sapiens
  misc_feature: GYAE6OF02F7X5P.49.64.F09.1.454.CMB.1.raw
  modified_base (282)..(282): a, c, t, g, unknown or other
  misc_feature (282)..(282): n is a, c, g, or t
  modified_base (348)..(348): a, c, t, g, unknown or other
  misc_feature (348)..(348): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagctaactatttaaattggtatcagcagtaccccggggaagcccctaagttacngatctatgctgcagcctaatttgacaaaggtcgggtcccatcaaggttcagtggcaggtggatcgngggacagtaattcactctacaccatcagcagtctgaccaacctgtaagtagtttaggaaacttacttagttgtacaactagtaagttaacgaacttgacttactagtttcggacggaggtaccgaaggtagagagtaacgaaaggtactaggtacggtactacgaccgtacctagttcgtagttaccttctaccg

SEQ ID NO: 127597 - DNA, 200 bp, Homo sapiens
  misc_feature: GYAE6OF02H4HNX.49.64.F09.1.454.CMB.1.raw
  modified_base (200)..(200): a, c, t, g, unknown or other
  misc_feature (200)..(200): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcan

SEQ ID NO: 127598 - DNA, 555 bp, Homo sapiens
  misc_feature: GYAE6OF02IXDGC.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgcaggcaagtcagagtattagcaactatttaaattggtatcagcataccccggggaaggcccctaagttactgatctatgctgcagccaatttgacaaagtggggtcccatcgaaggttcagtggcagtgatctggacagaattcactactcaccatcagcagtctgacaacctagaagtatttagaaagttactattgtacaagagtaaggttaacggaaacttagcttactacgtttttcgggacggtaaggggacctaagggtaggaaggtaagtaacgaaaaaaggtaacgtaaggtacggtacgttacgacgtaaccgacgttacgttaggtcctttaaccg

SEQ ID NO: 127599 - DNA, 542 bp, Homo sapiens
  misc_feature: GYAE6OF02I578S.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtgggtccatcaaggttcagtggcagtgatcgtgggacagaattcactctcacatcagcagtctgcaacctgaagtattttaggaaattacttaattgtactaaacgtagtaaggtttaacggaaactttggacttacgtacgtttttcgggacggtacgggaaccgaagggttcggagagttaacgaaaagtacgtaggtggactaggacaccgtattcctgttacttctaccg

SEQ ID NO: 127600 - DNA, 917 bp, Homo sapiens
  misc_feature: GYAE6OF02HCOIN.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagcccctaagtactgatctatgctgcagcctaattttcgacgtaaagggttcggggtaccccaagttaccgtaaagggtttccgaagggttcgggaccgtaagggttacgggtaactttccggttagggggaaacctaaaggtaaacttttacccgaaccctttccttaacccgtaacccgtaagttcccgaaacggtacccgttaaacggtttcccgttacgggaacccttaaaaccccggttagggttaaaaacggtttaacggtttttttaaacggggaaaaaacgtttttaaacccgtttaaacggtttttacgggttaaacccgtaaaaaccggttaaacgggtttaaaacgggtttttaaaacccggggttaaaaaccgtttttccgggttaaacccgtttttaaacccgggttttaacggtttttttttaacccggggggaacccggggggttaaaaccgggggttaaaccccgggttaaaagggggggtttacggggtaaacggttaaaccggttaaaccgggtaaaaaaaacgggttaaacccggtttaagggggttaaccggggtacccgtttaacgggtaaccccgtaaacccgttaacgttcccggtttaacggttttaccctttacccgtttaaccccg

SEQ ID NO: 127601 - DNA, 552 bp, Homo sapiens
  misc_feature: GYAE6OF02H8YX8.49.64.F09.1.454.CMB.1.raw
  modified_base (429)..(429): a, c, t, g, unknown or other
  misc_feature (429)..(429): n is a, c, g, or t
  modified_base (545)..(545): a, c, t, g, unknown or other
  misc_feature (545)..(545): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcactaccccggggaagcccctaagttactgatctatgctgcagcctaatttgacaaaggtcgggtccagtactaaggttcaaggtcggactaggtaggtatcgtaggggacaagtaacttccacgtctacacctatcacgcagtctcgacactagaagttatttaggaattatattntacaacagtagttaacgaacttgactctagtttcggacggtacggacctagggtgagtacgtaacgaaaggaacttggtacgtacgtacgtacgacctacgttctacgttaccttntaacccg

SEQ ID NO: 127602 - DNA, 544 bp, Homo sapiens
  misc_feature: GYAE6OF02FYR9A.49.64.F09.1.454.CMB.1.raw
  modified_base (364)..(364): a, c, t, g, unknown or other
  misc_feature (364)..(364): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagccctaagttactgatctatgctgcagccaattgcaaagtgggtccatcaaggttcagtggcagtggatcgtggacagaattcactctcaccatcagcngtctgacaacctgaagtagtttaggtaaagtactattagtactaactagtaagttaacggtaaacttgacttactagttttcggacggtaacgggacgtaagggtggtagtacgtacgtaaaaggaacttaggtacggtacgtaggtaccaccgtacttcgtacgttaccttacttaccg

SEQ ID NO: 127603 - DNA, 639 bp, Homo sapiens
  misc_feature: GYAE6OF02JL945.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcacgtaccccggggaagtcccctaagttactgatctatgactgcacgccaatttgactaaaggtcgggtaccagtcgtaacggttcaggttcggactaggtaggtatcggtagggactaaggtaacttcacttctcacctatcagtcagtctcgactaaccgttagaaacgttagtttaaggtaaacttaacgtttagttacgttaactaaacgtaacgtaacggttaaacggtaaactttacgtacgttacgttaacgtttttaccgggacgggtaagggtaaccgtaagggttacggagtaagtaacggtaaaacggtaacgttaggtacggtacgtacggtaccgaaccgttacgttaccgttcggttactttacgttaacccg

SEQ ID NO: 127604 - DNA, 623 bp, Homo sapiens
  misc_feature: GYAE6OF02G2948.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagccaccatcatttgccgggcaagtcagagtattagcaacttatttaaattggtatcagcacgtaccccggggaagcccctaagttactgatctatgctgcagcctaatttgacgtaaaggtcgggtacccagtacgtaaggttcaggtggcgtaggtaggtagtcgtagggacaggtaattcactctacaccatacacgtacagtctcgacaaccgtagtaaacgttacgtttaggaaacgttacttagttacgtactaaacgtaggttaacgttaacggtaaacttgtacttacgttacgttttaccgggacgggtacgggtaaccgtaaggggtacggtacgtaacgtaacggaaaacggtacgttagggtacgtaccgttacgtaccgtaaccgtacttccgttacggtttaccttacgtacccg

SEQ ID NO: 127605 - DNA, 593 bp, Homo sapiens
  misc_feature: GYAE6OF02GH178.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcactaccccggggaagcccctaagttactgatctatgctgcagccaattgcaaaggtgggtcccatcaaggttcagtgcagtgatcgtgggacagattcactcacaccatcagcagtctagctaacctagaacgtagttttaggaaacgttacttagtttacgtacaaacgtagtaaggtttaaccggaaactttgacctttacgttagtttttaccggggacgggtaacgggtaaccgtaacgggtaggtaaggaactaacggtaaaaaacggtaacggttagggtaacgggaccgtaggtaccctaacccgtagttcctacggtttcccttacctacccg

SEQ ID NO: 127606 - DNA, 542 bp, Homo sapiens
  misc_feature: GYAE6OF02GOSS6.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtcccatcaaggttcagtggcagtggatcgtgggacagaattcactctcaccatcagcagtctgcaacctgaagtagttttaggaaagttacttattgtactaaactagtaagttaacggaaacttgacttacgtagttttcggacgggtaggaaccgaagggtcggagagtacgaaaaggtaacgtaggtaggtacgtagaccaccgattaccgtcgttaccttacgtaccg

SEQ ID NO: 127607 - DNA, 603 bp, Homo sapiens
  misc_feature: GYAE6OF02JXYEX.49.64.F09.1.454.CMB.1.raw
  modified_base (373)..(373): a, c, t, g, unknown or other
  misc_feature (373)..(373): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcacgtaccccgggaagccctaagttactgatctatgctgcagcctaatttgacaaaggtcgggtacccatactaaggttcagtggcaggtgatcgtaggacagtacttcactctacaccntcagcacgtctcgacctaaccgttgaaagttagttttaagggaaacttacttagtttacgacgtaaactaggtaacgttaaccggtaaactttcgacttacgttagttttccgggacggggtaaggaacccgtaagggtaggagttaacggtaacgaaaaggtaacgttcgggtaaggtaccttagggaaccctacgtacttaccgttggtttaccctacggttaacccg

SEQ ID NO: 127608 - DNA, 541 bp, Homo sapiens
  misc_feature: GYAE6OF02HB03Q.49.64.F09.1.454.CMB.1.raw
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagacaactatttaaatggtatcagcacgtaccccggggaagaccctaagttactgatctatgctgcagcctaatttgacaaaggtgggtacccatcaaggttcagtggacagtgactcgtgggacagtaactcactctcacatcanctatcnacaactgaagtattaggaattatattagtacaactagtaagttaacggtaaacttgtacgtacttagtttcggacgggacggtaaccgaagggtaggagtaagtacgaaaagtaacgtggtcggtactaggaccactaagttcgtcgtttactacttaccg

SEQ ID NO: 127609 - DNA, 528 bp, Homo sapiens
  misc_feature: GYAE6OF02HYJAC.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagccctaagttactgatctatgctgcagccaatttgcaaagtgggtccatcaagttcagtgcagtgatctggacagattcactctcacatcagcagtctgcaacctgaagtattttaggaaagtacttaattgtacaacagagttaacggaacttgactctattttcggacggaacggaccaagggtggagagtaacgaaaagtaacgttagtacgggacttaggaccgtaacctacgttacgtgttaccttacgttaaccg

SEQ ID NO: 127610 - DNA, 506 bp, Homo sapiens
  misc_feature: GYAE6OF02H6IYV.49.64.F09.1.454.CMB.1.raw
  modified_base (281)..(281): a, c, t, g, unknown or other
  misc_feature (281)..(281): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagacaactatttaaattggtatcagcagtaccccgggaagcccctaagttacngatctatgctgcagccaatttgacaaagtgggcccatcaaggttcagtggcaggtgatcgtaggacagaattcactctcaccatcagcagtctagacaaccgtgaacgtagtttaagaaagttatattgtacaacagtagttaacgtaaacttgactgtagtttcggacggaggaccaagggtgagatacgaaagtaacgtggtgctgcacntctntctactacg

SEQ ID NO: 127611 - DNA, 588 bp, Homo sapiens
  misc_feature: GYAE6OF02JHFSQ.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagctaactatttaaattggtatcagcacgtacccgggaagccctaagttactgatcgtatgactgcagacctaatttcgacgtaaaggtcgggtaccccagtacgtaaggttcagtggacaaggtggatcgtaggacagtaattcactctacactatcagtcagtactagacctaacgtgtaagtatttaaggaaagttactagttacgtacaagtagtaagttacggtaaacttgaccttacgttacgttttcgggacggtaagggtaacctaaggggtacgtataacgtaagaaaacggtaacgttggaacggtacgtacgacctacctaacgttcgttagttacccgttataacccg

SEQ ID NO: 127612 - DNA, 665 bp, Homo sapiens
  misc_feature: GYAE6OF02JGCIE.49.64.F09.1.454.CMB.1.raw
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
tcagagtcgagagacacgaccggtgctcgatttagcgcgtatacaagggggaggtcagtctcagtctaggacaccagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaaattggtatcagcataccccgggaaggcccctaagttactgatctatgctgcagccaatttgcaaagtgggtcccatcaaggttcagtggcggtggatcgnggganagaattcactctcaccatcagcagtctgcaacctagaagtagttttacggaaagttacttaattagtacaaactagtaacggtttaacggaaacttcgtacttaccgtaagtttttaccgggacgggtaaacggggtaacccgtaaaggggttacgggtaacggtaacgttaaaccggtaaaaaacggttaaaccggttaacgggttaacggggtaacccgtttacgggtaaaccccgttaaaccccgtaaaccgtttacccggtttaaccggtttacccgttttacccgttaaaccgttttttaacccccccgg

SEQ ID NO: 127613 - DNA, 632 bp, Homo sapiens
  misc_feature: GYAE6OF02JZPST.49.64.F09.1.454.CMB.1.raw
  modified_base (214)..(214): a, c, t, g, unknown or other
  misc_feature (214)..(214): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggnaagtcagagtatagcaactatttaaatggtatcagcatacccgggagccctaagttactgatctatgctgcagcctaatttcgactaaaggtcggggtaccccagttactaaacggttcaaggttgggaccaggtaggtaattcgtgggtaacctaaggtaacttacgaactacttccaaccgtatccaagctaagtcctagacctaaccgtagaagttagttttaaggaaagtttaactatttacggtaactaactacggtaagtttaaccggaaactttagtaccttacgttaagtttaccgggaggtaacgggaaccgtaaggggtacgtaaggaacttaacggaaaacggtaacgttagggtaggtacgtacggaacgttaaccacgtttaccgtaggttccttacgttaaccg

SEQ ID NO: 127614 - DNA, 580 bp, Homo sapiens
  misc_feature: GYAE6OF02IG01T.49.64.F09.1.454.CMB.1.raw
  modified_base (279)..(279): a, c, t, g, unknown or other
  misc_feature (279)..(279): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagctaactatttaaatgtatcagcataccccggggagacccctaagttacngatctatgctgcagcctaatttgacgtaaaggtcgggtacccatacgaaggttcaggttgacaggtggaatcgtaggggacaagtaattccgactctccaactatcagcagtctgaccaacgtagaagttagtttaggtaaagttactatttacgtacaagagtaagttaaccgtaaattcgacttacgtacgttttcggacgggtaacggaccgtaagggtacggagtaacgtacgaaaaggtaacgttcggtagtacgtacgtaccgaccgtacgttacgttacgttacttacttaccg

SEQ ID NO: 127615 - DNA, 646 bp, Homo sapiens
  misc_feature: GYAE6OF02J2GC1.49.64.F09.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (617)..(617): a, c, t, g, unknown or other
  misc_feature (617)..(617): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagngtcaccatcattgccgggnaagtcagagtattagcaactattaaattggtatcagcagtaccccgggaagcccctaaggttactgatctatgactgcagccaatttgactaaaggtcgggtaccctatacgtaacggttcgaggttggctagtcggatcgtacgggaacagtaacttcgactcgttaccaccacttacacgtacgtacgtaccgttggtaccctaaacccgtaggtaaacgttagttttaacgggaaaaagttttccgttaaatttacggtaactaaacgtaggttaacggttaaccggtaaacgtttcggtacctacgttaggttttaccggacgggtaaacggacgtaagggttagggacgtaaatacgaaaacggtattaacgggtggtaccgtacggtacccttaacncgtttaccgttgttaccgttactaccccg

SEQ ID NO: 127616 - DNA, 633 bp, Homo sapiens
  misc_feature: GYAE6OF02IC6EZ.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcacatcatttgccgggcaagtcagagtatagacaattaatttaaattggtatcagcacgtaccccggggaagcccctaagttactgatctatgctgcagacctaatttcgacaaaggtcgggtaccagtacaaggttcaggtggactaggtgacgttcgagggtactaagtaattacgtacctcgtacctaccactacacgtactacgtactacgacctaaccgtagaaagttagtttaaggtaaacgttacttagttacgtacaaacgagtaagttaaaccggtaaactttctacgttacgttacgttttacgggacgggtaacgggtaaccggtaagggtacggaaggtaacgtaaacggtaaaacgtacggttaacgggttcggaccgtcgtaccgtaacctaaccgttacgttcgttaccttaccgtaccg

SEQ ID NO: 127617 - DNA, 564 bp, Homo sapiens
  misc_feature: GYAE6OF02IHL0E.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaagccctaagttactgatctatgctgcagccaattgcaaagtgggtccatcaaggttcagtgcagtgatctggacagatcactctcacatcagcagtctgcaactgaagtatttaggaaagtacttagttgtacaactagtaagttaacggaaactttgactttacgtagtttttaccgggacgggtaacggggaaccctaagggtaggtacgtaataaccgaaaaaggtaacgttagggttacggtaccgttaggaccctaacccgtaagttaccgttacggttacctttactaacccg

SEQ ID NO: 127618 - DNA, 615 bp, Homo sapiens
  misc_feature: GYAE6OF02GUT32.49.64.F09.1.454.CMB.1.raw
  modified_base (507)..(507): a, c, t, g, unknown or other
  misc_feature (507)..(507): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcaggtatagtacaactaatttaaatttagtagtactagacacgtaaccccgggtaaccgggacccgtaaccgttaacttacgtacgtactactagtcgtcgtcgacgaccgtaacttagtacgaaacggtacgggtccgtactacgtaacggtacgtacgtaggtcgagtaggtagtacgtggacgagaatactactactctaccactcacgactacgtctcgacaaccgtagaagtagtttagtaaagtacttattgtacaactaagtaacgttacgtaaaccgttntctacgtacgttttcggacgggaagggtacgaacggtgaggtataacgtaaaagacgttcggtaggccgtagtccgaactacttcgttcgttacttccgtacttcccg

SEQ ID NO: 127619 - DNA, 611 bp, Homo sapiens
  misc_feature: GYAE6OF02IQSRE.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcagtcagagtatagacaacttatttaaattggtatcagcacgtaccccggggaaggccctaagttactgatctatgactgcaggccaatttgacaaaggtcgggtacccagtaccaaggttcaggtggcgaggtggattcgtagggacctaagaacttcctacttccgtaccaacctatccaagcgtacgtcgcgtaccaacttagtaacgtaagtttttaggaaaagtttaacttacgtttacgtaacaaactaggtaacggtttaaccggtaaacgtttcgaccgttacgttagttttaccggggtaacggggacggtaaccggtaagggtaggtaggaagttaacgaaaaggtacgtacggtggacctagacaactatcgtcgttacctctacc

SEQ ID NO: 127620 - DNA, 618 bp, Homo sapiens
  misc_feature: GYAE6OF02IOGE1.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggacagtcagagtattagctaactatttaaattggtatcagcacgtaccccggggacgaccctaagtactgatctatgctgcagcctaatttgacgtaaggttcgggtaccctagtacgtaaggttcgaggtggtcgtagtggatcgtgggacagtacttacactctacacctatacagtcgagttcacgtacctaacgttaggtaacgttaacgttttaacgggaaaatttaccgttaagtttacggtaacctaaaccggtaagggtaacggtttaaacggtaaaccgtttcggtacttacgttacgttttaccggggacggtacgggtaacgtagggtagagtaagtaacgaaagttacgtggtcggactacggacctacctagttccgtgttactccgtaccg

SEQ ID NO: 127621 - DNA, 573 bp, Homo sapiens
  misc_feature: GYAE6OF02FEZ5E.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacgagtcccaggatcgacccagtcgtccagtccgacccgtgtcctagtcatctgtaggagacagagtcaccatcatttgccggcaagtcagagtattagcaactattaaattggtatcagcataccccgggagcccctaagtactgatctatgctgcagccaatttgctaaaagtggggtccccatcaaggttcagtggcaggtgatcgtggacagaattcactctcaccatcagcagtctgcaaccgtgaagtagttttaggaaagtaccttagttcgtacaacgtagtaacggttaacgaaactttggtaccttacgtacgtttttacgggacgtaacgggaccgtaagggttacggtagaacgtacgtaaaaacggtaacgttaggtacggactgacgtaacctacgttctacggttcttacttaccc

SEQ ID NO: 127622 - DNA, 772 bp, Homo sapiens
  misc_feature: GYAE6OF02H3FDU.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcagtaccccggggaagcccctaagttactgactctatgctgcacgcctaaagttttcgacgtaaacggttcggggtacccctagtacgaaaggtttcgaagttcgggacacggttggaacgttcgtagggaacctaaggtaaactttccgaaccttcctaaccaaccctaattacccaaggtcctaagttcctaggaccctaaacccgttaggaaacgtttaaagtttttaacgggaaaaacgttttaaccgttaagtttacggtaaactaaaccggtaaagggtttaaacgtttaaaccggggttaaaaccttttggtacccttaacggtttaaccggtttttacgggggaccggggtaaacgggtaacccggttaaaggggtacgggaaacgttaacgttaaacggttaaaaaacggtaacccggtttaagggtaaccggggtaccgttacgggtaaccccgtaaccttaaaccggtttcctttaaccgggtttccccttttaaccgttaaccccgg

SEQ ID NO: 127623 - DNA, 610 bp, Homo sapiens
  misc_feature: GYAE6OF02HEEZP.49.64.F09.1.454.CMB.1.raw
  modified_base (595)..(595): a, c, t, g, unknown or other
  misc_feature (595)..(595): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgcctgtctgcatctgtaggagacagagtcaccatctattcgccgggacaagtcagagtattagacaacttaatttaattggtatcagcacgtaccccggggaacggacccctaagttactgtatctatgctgacacgacctaatttgacgtaaaggtcggggtaccctagtacgaacggttcaggtggtacgaggtggtacgtcgtagggaactaagtaactctacctcctacacctatcagtactacgtctcgactaaccgtagtaaggtagttttaaggaaagtttacttaagttacgtactaaacgtaggtaacggttaacggtaaaccgttgtaccttagttacgtttacgggacgggtacgggaacgtagggtaggagagtaacggaaagtacgttggtacgtacgtacgactactacgtntacttcttactaccg

SEQ ID NO: 127624 - DNA, 596 bp, Homo sapiens
  misc_feature: GYAE6OF02HWX9O.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctcatccgccctgtctgcatctgtaggagacagagtcaccatcatttgccgggcaaagtcagagtattagacaacttaatttaaattggtatcagcataccccgggaagtacccctaagttactgatctatgactgcagccaatttgactaaaggtcgggtacccatcaaggttacagtaggcagtgatcgtaggacagattcacctctcactatcacgctagtactgacctaaacctaggtaaacgtaattttagggaaaacgtttacttaacgtttaggtaactaaaccgtaggtaacggtttaacggtaaaactttcggacttaccgtacgttttacggaccgggtaaggaccgtaagggtaggacgtataaccgaaaagtaacctaggttacgactagaccaaccgtatataccggttacttacgtaacccg

SEQ ID NO: 127625 - DNA, 570 bp, Homo sapiens
  misc_feature: GYAE6OF02JADL5.49.64.F09.1.454.CMB.1.raw
  modified_base (215)..(215): a, c, t, g, unknown or other
  misc_feature (215)..(215): n is a, c, g, or t
  modified_base (532)..(532): a, c, t, g, unknown or other
  misc_feature (532)..(532): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggnaagtcagagtattagcaactatttaaattggtatcagcacgtaccccggggaagcccctaagttactgatctatgctgcagcctaattgacaagtcgggtcccatcgaagttcagtgcagtgatcgtggacagatcactctacacatcagcaagtctagcaacctgaagttagttttaggaaacgttatttattacgtacaaactagggtaacgtttaaccggtaaactttcgtaccttaccgttaaggtttttccgggacgggtaaacgggtaaccgtaagggttacggagtaacgtaacgaaaaggtacttaggngtacgtgacctaccgtattcgtacgttcccttctaccg

SEQ ID NO: 127626 - DNA, 543 bp, Homo sapiens
  misc_feature: GYAE6OF02GSMYM.49.64.F09.1.454.CMB.1.raw
  modified_base (380)..(380): a, c, t, g, unknown or other
  misc_feature (380)..(380): n is a, c, g, or t
  modified_base (538)..(538): a, c, t, g, unknown or other
  misc_feature (538)..(538): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcacgtaccccggggaagcccctaagttactagatctatgctgcagcctatttgacaaaggtcgggtacccatcgaaggttcagtggcaggtgagtcgtggacagtattcactcacacatcagcagtcngaccaactagaagtagtttaggaaatacttattcgtacaacgtagtaagttaacggtaacttgacttacgtagttttcgggacggtacgggtaaccagggtagagacgtaacgaaaagtacgtaggtagcgtagacctacgtactacgtcgttacctntaccg

SEQ ID NO: 127627 - DNA, 541 bp, Homo sapiens
  misc_feature: GYAE6OF02GJV2J.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattgtatcagcataccccgggaagcccctaagttactgatctatgctgcagccaatttgacaaagtcgggtaccagtcaaggttcagtggcaggtgatcgtgggacagtaatcactctacacatcagcagtctgacaacctgaagtatttaggaaagttacttaagttagtactaacgagtaacgttaacggtaacttgacttactagttttcggacggtaacggaaccgtaaggtggagtagtacgaaaaggtaactaggtacggtacgtagaccacgtactctcggttacttctaccg

SEQ ID NO: 127628 - DNA, 789 bp, Homo sapiens
  misc_feature: GYAE6OF02JQ8XE.49.64.F09.1.454.CMB.1.raw
  modified_base (131)..(131): a, c, t, g, unknown or other
  misc_feature (131)..(131): n is a, c, g, or t
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
tcagagtcgagagacacgaccggtgctcgatttagcgcgtatacaaggggagtcgagtctcagtcaggacacagcatggacatgagggtcccgctcagctcctgggctcctgctactctggctccgaggtnccagatgtgacatccagatgacccagtctccatccgcctgtctgcattctgtagganacagagtcaccatcatttgcggganaagtcaggatattagcaacttattaaagtggtactacgtagactaacgtacccccggggaaggtcccccttaaggttaccttaggacttacgtaattcggtaccttaggacctacggtaccttaaagttttcggaaccgtaaaagggttcggggtaaccccctattaaccggtaaggtttcagggttacgacaggttaggacttacggtgggaacctaggtaactttcccgtaactcgtttaacccgacctaagttaccgaggtaccctaacggttccgtaacgtaccgtaaaaccccgttaggtaaaccggttaacgtttttaacggggtaaaaactttaccgtttaagttaacccgggttaaactaaaccgttaagggttaaacgtttaaacccggggttaaaactttccggttaaaccttacggtttaacggtttttaccgggaaccggggttaaacgggaaccgttaaacgggttgggtaacttaaacggtaacgtaaaaaccgggttatttacgggaacggttctacgttaaccgacttacgtacccggtttgtacccgtttacgtaaccc

SEQ ID NO: 127629 - DNA, 720 bp, Homo sapiens
  misc_feature: GYAE6OF02H0R9V.49.64.F09.1.454.CMB.1.raw
tcagagtcgagagacacgaccggtgctcgatttagcgcgtatacaagggggagtcagtctcagtcaggacacagcatggacatgagggtccccgctcagctcctgggctcctgctactctggctccgaggtgccagatgtgacatccagatgacccagtctccatccgcctgtctgcatctgtaggagacagagtcacatctatttcggccgggacaagtcagtagtattagactaacttaatttaaagttggtaatcgagcaacggtaccccggggaacgtaccccgttaagttactgtactctatcgctgcacgacctaagtttgaacgtaacggttcggggtacccctagtacgtaaggttccgaggttggacgtaggtggtacgtacggtagggaaccgtaagtaactttacctaccttacctacccgtaacctacttaccgagtacccgtagtcctacgacctaaacgtacggtaaagttagttttaaacggaaacgtttacgttaagtttacgtaacaaacgtacggttaaaggttaaacccggttaacgtttacgtaccctttaacggttaccggttttaccggggaccggggtaaacggtaacccggtaaggggttacggaaacgttaacgtaaccgtaaaaagggtacgttagggtacggtaccgtaggttcccaacgttacttccggttacttcccgttaccttacccgg

SEQ ID NO: 127630 - DNA, 599 bp, Homo sapiens
  misc_feature: GYAE6OF02G64VA.49.64.F09.1.454.CMB.1.raw
  modified_base (380)..(380): a, c, t, g, unknown or other
  misc_feature (380)..(380): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttacctgatctatgctgcagcctaatttgactaaaggtcgggtacccatacaaggttcagtggcagtggatcgtaggacagaatcactctcaccatcagctagtcngactaaccgtagaagtagtttaggtaaaagtacttagttacgtacaaacgtagtaagttaaccggtaaacgtttcgtaccttacgttaagtttttaccgggacgggtaaacgggtaacccgaagggtacggaggtaacgtaaccgtaaaaagtaccgttaggttacggtacgttacggtacctaaccgtacgttccgttacgttacctttacctaaccg

SEQ ID NO: 127631 - DNA, 567 bp, Homo sapiens
  misc_feature: GYAE6OF02G445S.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttattaaattggtatcagcacgtaccccggggaagccctaagttactgatctatgctgcagcaatttgacaagtcgggtacccatcaaggttcgagtggctagtggtactcgtggacagtaacttcactctcacatcagcgagtctcgactacctagtaacgtagttttaggaaacgttacttagtttcgtaacgtaactaggtaacgttaacgggtaacttacgtcttgtttaacgtttacgggacgggtacgggtaactaaggggtgagtaacgtaacgtaaaacgacgttagacggtctacgactacgtactacgttcgtcttactaccg

SEQ ID NO: 127632 - DNA, 569 bp, Homo sapiens
  misc_feature: GYAE6OF02HKMTV.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagacaacttatttaaattggtatcagcacgtaccccggggaagaccccttaagttactgatctatgctgcagcctaatttgacgtaaaggtcgggtaccagtcaaggttcagtggcagtggatcgtgggacagtaattcactctcacatcagcagtctgcaacgtagaagtattaggtaaagttactattagtactaacgagtaacgttaacgtaaacgttgtacttacgtacgttttcggacgggtaggtaaccggaaggtaggagtaacgtaacgtaaaaggtacgttaggtacggtacgtagaccgtaactacgttaccgtacgttccgttactacccg

SEQ ID NO: 127633 - DNA, 532 bp, Homo sapiens
  misc_feature: GYAE6OF02GHFHY.49.64.F09.1.454.CMB.1.raw
  modified_base (215)..(215): a, c, t, g, unknown or other
  misc_feature (215)..(215): n is a, c, g, or t
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggnaagtcagagtattagcaactatttaaattggtatcagcacgtaccccggggaagccctaagttactgatctatgctgacagcctaatttcgacgaaaggtcgggtaccatcgtaaggttcagtggcagtgatcgtagganagattcactctacacatcagcngtctgacactgaagtattaggaaagtacttatntacaatagtaacgtaacggtaacttgacttgtagtttacgggaggtacgggaacgtaggtacggagtataacgaaagtacgtaggtcgacgttgactacctattcgtacgttcttactaccg

SEQ ID NO: 127634 - DNA, 594 bp, Homo sapiens
  misc_feature: GYAE6OF02GZ6HK.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtagagacagagtcaccatccatttgccgggcaagtcagtagtattagctaacttatttaaattggtatcagcacgtaccccgggaagcccctaagtacctgatctatgctgcacgctaagtttcgacgtaaggtcgggtacccagtacgtaacggttcaggtcggacgtaggtaggtacgtcgtagggaactagtaaacttcgacttccgtacaccgtatacgacgtacgtacgtctcgtaactaaccgtaggtaacgtagtttacggaaatttacgtattacgtacaactaaggtacgttaagaacttgtactactacgtttccgaggtacggtaacgtggtagacgtacgtagaaaagtcgttaggcgtacgacgtaccgacttagtccttacggttacttctaaccg

SEQ ID NO: 127635 - DNA, 594 bp, Homo sapiens
  misc_feature: GYAE6OF02G5ZJS.49.64.F09.1.454.CMB.1.raw
  modified_base (218)..(218): a, c, t, g, unknown or other
  misc_feature (218)..(218): n is a, c, g, or t
  modified_base (443)..(443): a, c, t, g, unknown or other
  misc_feature (443)..(443): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtcctccatccgccctgtctgcatctgtaggagacagagtcaccatctatttggccgggnaagtcagagtatagacaacttatttaaattggtatcagcacgtaccccggggaagacccctaagttactgatctatcgctcgcagacctaatttcgactaaaggtcgggtacccagtacgaaggttacaggtggactaggtggatcgtagggacagtaattcactctcacatcagcatctcgactacgtagtaagtatttaaggaaattacttattagtactaanagtaacgttaacggtaacttgtacttacgttacgtttacgggacgggtaacggtaaccgtaagggaggtagtacgtaaacgaaaacggtaacgttaggtacggaccgttacggacctaccgttactaccgtttagttacctaccttaaccg

SEQ ID NO: 127636 - DNA, 584 bp, Homo sapiens
  misc_feature: GYAE6OF02I92XO.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaatggtatcagcagtaccccggggaagccctaagtactgatctatgctgcagccaatttgactaaaggtcgggtacccagtcgaaggttcaggtggcagtggatgtggacagattcactctcacatcagcagtctgacaacctgaacgtagtttaggaaagttacttagttcgtaactaagtagtaacgttaacggtaaacttcgacttacgttacgttttccgggacgggtaacggtaaccgtaagggttaggacgtaacgtaacggaaaaggtaaccgtagggttacgggaccgtaggtaacccgtaccgtaacgttccgttcgttaccgttacttaacccg

SEQ ID NO: 127637 - DNA, 558 bp, Homo sapiens
  misc_feature: GYAE6OF02HCB0M.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcacgtaccccggggaagcccctaagtactgatctatgctgcagcctaatttcgactaaagtcgggtacccaagtcgaagttcagtggcagtggatcgtaggacagtactcactctcaccatcacgctagtctgactaaccgtagaagtagttttaggaaattacttaattagtactaaacgtagtaacgttaacgtaacttgacttacgttagtttcgggacggaaggtaaccgaagggtaggagaagtacgaaaagtacttaggtacgtcgtagacctaccgtattccgtagttacttacgtacc

SEQ ID NO: 127638 - DNA, 680 bp, Homo sapiens
  misc_feature: GYAE6OF02IKP2I.49.64.F09.1.454.CMB.1.raw
  modified_base (305)..(305): a, c, t, g, unknown or other
  misc_feature (305)..(305): n is a, c, g, or t
tcagagtcgagagacacgaccggtgctcgatttagcgcgtatacaagggggagtcagtctcagtcaggacacagcatggacatgagggtccccgctcagctcctgggctcctgctactctggctccgaggtgccagatgtgacatccagatgacccagtctccatccgccctgtctgcatctgtagagacagagtcacatcatttgccggcaagtcgagagtattagactaaacttaatttaaagttggtaatactagactacgtaaccccggggaagaccccttaagttactagatctatgtcngcagacctaagtttacgacgtaaggtcgggtacccatacgtaagttcagtggactagtggtagtacgtaggacaaggtaacttaccgtacgtcctaccaacgtactacgtaacgactacggtactagtacctaaaccgtaggtaaacgtttaagtttttaacgggaaaaacggtttacttaaacggttacgttaaacccgaaaacgttaacgggtaacggtttaaaccggtaaaacgtttcggtaaccgttacgttaacggttttaccggacgggggtaaacggtaaccgtaagggtacggaagtaacgtaaacggtaaagtaaccttgggtacgtaccagtaccactacgttccgttaacgttcctacttaccg

SEQ ID NO: 127639 - DNA, 566 bp, Homo sapiens
  misc_feature: GYAE6OF02HC1LN.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcagtaccccggggaagcccctaagtactgatctatgctgcagcctaatttgacaaagtcggggtcccatacaggttcagtggcagtgatcgtgggacagaatcactctcactatcagcagtctgcaacctgaacgtagtttaaggtaaagtacttaatttagtacaaacgtaggtaacgttaacggtaaactttgacttcttaaggttttcgggacgggtaacgggtaaccgaagggttggagtaataacgtaaaaggtaactagggtacgcgtacgaccctaacgtacttacgtacggttcctacgttacccg

SEQ ID NO: 127640 - DNA, 574 bp, Homo sapiens
  misc_feature: GYAE6OF02G2UUS.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaatggtatcgagcactaccccgggaagccctaagttactagactactatgctgcacgacctaattgacctaaagtcggggtacccagtacgaaggttcagtggctagtggatcgtagggacagtaacttcacttacacacatcagacacgtcagacaacgtagaagtaagttttaggaaacgttacttaagttgtacaaagtagtacgttaaacggtaacttgacttacgttagtttcgggacggtaacggacgtaagggtggtagaacgtacgtaaaaagtacgttggtacgacgtacgaccgacgtattcgttaccgttacttacgtaaccg

SEQ ID NO: 127641 - DNA, 881 bp, Homo sapiens
  misc_feature: GYAE6OF02G0939.49.64.F09.1.454.CMB.1.raw
tcagagtcgagagacacgaccggtgctcgatttagcgcgtatacaagggggagtcgagtctcagtcaggacacagcatggacatgagggtccccgctcagctcctgggctcctgctactctggctccgaggtgccgagatgtgacatccagatgacccagtctccatccgcctcgtctgcatctgtaggacgtacgagagtcaccatcctacgtttcggaccgggtacaaggttcgagtagtattacgactaacttatttaaacgttcggtaactacgacgacgtaacgtacccccgggggaagtacccccttaaaggttacctaggtaacttcgttaagttcgaccgttacggcctaacggtaccccgttaaagttttcggaaccggttaaaaacggggttccgggggttaaccccctaagtttaccggtaaacgggttttccgtaaacgggttcgggtacggtaacgggttacgggtacttccgggtacggggaactaacggttaacttaccgtaccgttccgtacccgtaacccggtacgtaccgtaacggccgtaacggttacccgtacgtaaccgtaaacccggttaggtaaacggtttacggttttaaacgggaaacgtttaacggtttaagtttaccggtaacgtaaacggtagggtttaaacgggtttaaaccgggttaaaccgtttcgggtaccgtttacggttaaccgggtttttaccggggaaccggggttaaacgggtaaccggttaacgggtacgggtaaccggtaacgttaaaccgggaaaacgttaaccggttacgggtacggtaccgttaaccggacccgttaaccggttacttcccggtttacggttccccttacgtaaccccg

SEQ ID NO: 127642 - DNA, 571 bp, Homo sapiens
  misc_feature: GYAE6OF02F9SP6.49.64.F09.1.454.CMB.1.raw
  modified_base (387)..(387): a, c, t, g, unknown or other
  misc_feature (387)..(387): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccgagatgtgacatccagatgtacccagtctccatccgccctgtctgcatctgtaggagacaggagtcaccatcatttgccgggcaagtcagagtttattagcaactatttaaattggtatcagcataccccggggaagcccctaagttactgatctatgctcgcagaccatttgacgtaaagtcgggtaccccatacaacggttcagtggacagtaggatcgtggacagaattcactcctcaccatcgagacngtctgaccaacctagaagtattttaggaaagttacttattgtaactaaacagtaacgttaacggaaacttgacttcgtagttttaccggacggtacgggaacctaagggttgaacgtaactacgaaaacggtacgtggtacggcttacggacctaccgtagttccgttgttccgttataacccg

SEQ ID NO: 127643 - DNA, 590 bp, Homo sapiens
  misc_feature: GYAE6OF02HSC9F.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggacaagtcagagtattagactaacttaatttaaattggtatcagcacgtaccccggggaagacccctaaagttactagatctatgctgcagcctaatttgactaaaggtcgggtacccagtacgaaggttcaggtggactaggtggactcgtagggacagtaattcactcacacatcagcagtctagactaacgtgtaagtagttttaggaaaagtttactaattcgaacaaacgtaggtaacgttaacggtaaacttgacttacgtagtttccgggacgggtaacggaacgtaagggtaggagtaagtaaacgaaaaggtacgtaggtacggtacgtacggacctaaccgtattcccgtagttccttacgtaccg

SEQ ID NO: 127644 - DNA, 777 bp, Homo sapiens
  misc_feature: GYAE6OF02IS1I8.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccatcccgccctgtctgcatctgtaggagacagacgtcacatctatttcggccgggacaagtcagtagttattacgactaaacttaatttaaattggtaatcgaagctaacggtaacccccgggggaacgtacccccttaaagtttacctagacttaccgttatcggcttcggacaacggtacctaagtttacgacgttaaagggtccggggtacccctaagtaccgtaagggttacgaggtacgggacgtaaggttcgggtaacttcgggaacggggtaaccaaggttaaactttccgtaaccttccgtaacctaacccgtaagtccgtaagtacgtaacgttcgttaacgaccctaaacgttaggtaaacgtttaaggttttaacggaaaacgtttacctttaaggtttacgtaaactaaacggttaaaggttaacggttaaaccggtaacgtttccgtacgtttacgttaaccgggtttacggggaaccgggtaacgggtaaaccgttaagggtagggtaacgttaacgtaacggtaaaaaggtccgtttggggtaaaccgtcgttaacggacctaaccgttcgttaccttcgtttacctccgttaaccg

SEQ ID NO: 127645 - DNA, 613 bp, Homo sapiens
  misc_feature: GYAE6OF02IE2QK.49.64.F09.1.454.CMB.1.raw
  modified_base (394)..(394): a, c, t, g, unknown or other
  misc_feature (394)..(394): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgcctgtctgcatctgtaggagacagagtcacctatcatttcgcgggcaagtcagagtattagcaacttaatttaaatggtatcagcacgtacccgggaagccctaagtactgactctatgactgacagcctaatttgataaacggtcgggacctatacgtaaggttcagtgcagtgattcggaggtacagtaagtccacgtctacactatcagacgtactcgtanacctaacgtagtaagtacgtttaaggtaaacttacgtattacgtaacgaactaaggtaacgttaaacggtaaacttcgacttacgttacgttttaccgggacgggtaaacggaaccggttaaagggtacgtaagaacgttaacgtaaaacggttacggttaggtaccggtacgttacgacctaaccggagtttaccgttcggttaccttacgttacccg

SEQ ID NO: 127646 - DNA, 590 bp, Homo sapiens
  misc_feature: GYAE6OF02GZ72O.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcagtaccccgggagccctaagttactgatctatgctgcagcctaatttgacaaagtgggtacccagtcaaggttcagtggcagtggatcgtgggacagattcactctacaccatcagcagtctgacaaccgtgaagtagttttaggaaagttacttagttacgtacaaacgtagtaagtttaaccggaaactttgtacttacgttaacgtttttaccggggacgggtaacgggtaaccgtaaggggttacgggaagttaacgttaaaccgaaaaaggtaacgttaggtacgggtactacggacctaacctagttaccttacgttcctttactaacccg

SEQ ID NO: 127647 - DNA, 749 bp, Homo sapiens
  misc_feature: GYAE6OF02G4EII.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgcctgtctgcatctgtaggagacagagtcaccatcatttggccgggacaagtcagaagtatagacaaacttatttaaattggtatcagcaacggtaaccccggggaacgtacccttaaagttactagacttactatgactgacacgactaatttcgactaaaggttcgggtacccagtacgtaaggttcgaacggtggacgtacggttaggaacgtcggttaacggggaaactaacggttaaactttacgtaaccgttcctaacccgtaaccgtaactacgaaaggtaccgtaacgggtttcctaacggaaccctaaacgtaacggttaaacggttaacgtttttaaagggaaaaacgttttaacttaagttttaaccggtaactaaaacgttaacgggttaaacgtttaaaccgggtaaaacgtttcgtaaccgttacgtttacgtttttaacggggaacccgggtaaacggggtaaccgtaagggtaacgggtacgtaaagtaaacggtaaaaacggtaacttaaggggacgtaacgtagaccgtaactacgttacgtttcggttaccttcgttaaccg

SEQ ID NO: 127648 - DNA, 639 bp, Homo sapiens
  misc_feature: GYAE6OF02F72NN.49.64.F09.1.454.CMB.1.raw
  modified_base (411)..(411): a, c, t, g, unknown or other
  misc_feature (411)..(411): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtccaccatctatttggccgggacaagtcagagtattagactaacttaattttaaagttggtattcagtcaacgtacccccggggaacgtacccccgttaagttacgtgatctatgctgcagcctaagtttgactaaaggtcgggtacccatacgaaggttcagtggacgagtaggatcgtggacagtaacttcactctacgacatcagtcagtcngacctaacgtagtaaagtcgttttaaggaaagttacttaagttacgaacgtaaacgtacggttaacgttaaccgtaacttgtaccttacgttaacggttttccgggacggtaacgggtaaccgtaaggggtacggtaagtaacgtaacgtaaaacggtacggtacgggttacgtacggtcgtaacccgtaacttaccggttacgtcggtttaccttacgttaaccccg

SEQ ID NO: 127649 - DNA, 566 bp, Homo sapiens
  misc_feature: GYAE6OF02JZ8AD.49.64.F09.1.454.CMB.1.raw
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (534)..(534): a, c, t, g, unknown or other
  misc_feature (534)..(534): n is a, c, g, or t
tcagagtcgagagacacgaccggtgctcgatttagcgcgtatacaagggggagtcgagtctcagtcaggacacagcatggacatgagggtccccgctcagctcctggggctcctgctactctggctccgaggtgccagatgtgacatccagatgacccagtctccatccgcctgtctgcatctgtaggagacagagtcaccatcatttcggccgggcaagtcagagtattagcaactatttaattgatcagcataccccggggaagtacccctaagttactgatactatgctgcagcctaattgacaagtcgggtccatcaaggtcaggtgactaggtaggatcggtaggataacgtaattccgaactctacctacctanacgtaanctaagtctcgaacctacgtagaagttatttaggtaaacgttactagttagtaacaagtagtaacgttaacgtaacttgtaccttgttaacgtttcgggacgggtaacggtacgaaggtggaatagtaaccaaaggtacctggtacgngtacgactacgtatacgtcgttactcgttacc

SEQ ID NO: 127650 - DNA, 675 bp, Homo sapiens
  misc_feature: GYAE6OF02HL0U7.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatctatttcggccgggtacaagtcgagagtattagactaaacttaatttaaagttaggtatacagaccacggtaccccgggggaacgtaccccgttaagttacgtgtatacttatgactgacagacctaatttgacgtaaaggttccgggtaccctagtacgtaaggttcgtaggtggacgtaggtaggtacgtcgtagggactaagtaattccactctacacctatcagtctacgtcagtacctaaccgtagtaaacgttagttttaaggaaagtttactattacgtaacaaacgtaggttaacggttaaacgtaacgttagtaccttacgttacgtttaccgggacgggtaaacggaaccgggtaagggtaggaacgtaacgtaaacggtaaaaggtaccgttaggggttaaccgacgttaccggaaccttaacccgtaagtttaccggtacgtttaccttacgtacccg

SEQ ID NO: 127651 - DNA, 631 bp, Homo sapiens
  misc_feature: GYAE6OF02FXQKU.49.64.F09.1.454.CMB.1.raw
  modified_base (397)..(397): a, c, t, g, unknown or other
  misc_feature (397)..(397): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatcatttgccggcaagtcagagtattagcaactatttaaattggtatcagcaacgtaccccggggaagtacccctaagttactgatctatgctgcagcctaatttgactaaggtcgggtacccatacgtaaggttcaggtcgctaggtggatcgtgggactagaacttcactcctacaccactcacgctacgtcncgacctaactaggtaagtacgttttaggaaattacttatttacgactaacggtaacttaaggttaacggtaaacttcggtactttacgttaacggttttccgggaacggtaacggggtaaaccgtaggggtaagggacgtaacgtaacgtaaaaacggtaccggttaggtacgggtaccgttaccggacctacccgttaagttaccgtttacggttaccctttaccgttacccg

SEQ ID NO: 127652 - DNA, 610 bp, Homo sapiens
  misc_feature: GYAE6OF02G9CET.49.64.F09.1.454.CMB.1.raw
  modified_base (284)..(284): a, c, t, g, unknown or other
  misc_feature (284)..(284): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttcgccgggacaagtcagagtatagacaactatttaatggtatcagacacgtaccccggggaagacccctaagttacngactctatgctgcacgtcctaagttcgactaaaggtcgggtacccatacgtaagttcgaggtcggataggtaggatcgagggacaagtaacttcgactctacaaccgatacgacgtacacgtctacgtcaaaccgtaagaacgttaagtttaaggaaactttactaattacgtaacgaaactaacgtaaggttaaacgtaaacgttcgactttacgtagtttacggggacggtaacggtaaccgaagggttacgagtagtaaacgaaaggtaacgtggtacgtacgtacgaccacgtacttacgttacgttaccttattaaccccg

SEQ ID NO: 127653 - DNA, 766 bp, Homo sapiens
  misc_feature: GYAE6OF02G25TL.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtcaccatctatttgccgggacaagtcagtagtatagactaaacttaatttaaagttggtatcagcacgtaccccggggaagtaccctaagttactgactactagtcgctgacacgtaccttaattcgacgtaaggtcggtaccctatacgtaaggttcgaaggtggacgtaggtacgtacgtcggtacgggaactagtaacttaccgaccttacctaccaccgtactcaacggaccgttacggtactacgtaacccgtaaacgttagggttaaacgttaggttttaaacgggaaacgtttaccgtttaaagttacggtaaaaccttaacggtaaacggttaaacgggtttaaaccgtaacgtttccgttaaccgtttacgtttaaccggggttttcgggggaaaccggggtaaaccgggtaacgggttaaacgggggtacgggttaacgtaaccgttaaaacggtaaaaaccggggtacgtttacggggtaacccggtttacggaacccggttaccgtaaacccggttcgttttaaacccgtttggtttaccccttacccggttacccg

SEQ ID NO: 127654 - DNA, 554 bp, Homo sapiens
  misc_feature: GYAE6OF02GWR47.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtatagacaactatttaaattggtatcagcacgtaccccggggagcccctaagttactagatctatgctcgcacgcctaattgacaaaggtgggtacccatcgtaaggttcaggtgcgtaggtggtatcgtagggacaggtaacttcgactctcacctatcagcagtctgacaactgaagtagtttaggaatacttagttcgtacaactagacggtttaacgaaactttcgacttactagtttcgggacggacgggacctaagggaggacgtatacggaaaagtacgttaggagtaccgagtcccactacgttctacgttctacgtaccg

SEQ ID NO: 127655 - DNA, 734 bp, Homo sapiens
  misc_feature: GYAE6OF02HZ5UK.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccggaggtgccagatgtgacatccagatgacccagtctccatcccgccctgtctgcatctgtaggagacagagtcacatctatttcggccgggcaagtcagatattagctaataatttaaattggtatacagcacgtaaccccggggacgtacccctaagttactagtactactatgctgacacgtcctaatttcgaacgtaaggttcggggtacctagtacgtaaggttacgtaggtggacgtaggtcggtaacgttcggtagggtaactaaggtaacttaccgtacttacctacctaaccgtagtaccgtagtaccgtacgtccgtaggtaaccctaaaccgttaggtaaacggttttaacgtttaacgggtaaaaacttttaccgtttaagtttaccggttaacaaaccgtaaagggttaacgggtttaaaaccggttaaaccgtttcgtaacgtttaccttaaccggggtttttccgggggaaccgggttaaaggggtaacccggttaaggggttaacggaggttaacgttaaacggaaaacgttaacggttcggtacgggtacctggtaccctacggtacttacggtacttcttaccgttaccc

SEQ ID NO: 127656 - DNA, 574 bp, Homo sapiens
  misc_feature: GYAE6OF02FYAKR.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcagtaccccgggaagcccctaagttactgatctatgctgcagccaatttgactaaaggtgggtccatcaaggttcagtggcagtgatcgtgggactagaattcactctacaccatcagctagtctgaccaaccgtagaacgtagttttaggaaagttacttattgtaactaactaggtaacgttaacggtaaacgttcgtactacgttagttttacgggacggtaacgggtaccgtaagggtggagtacgtaacgtaaaaggtaacttaggtacggtacgtagaccgtaaccgtacgttacgttacggttaccttcgtaccg

SEQ ID NO: 127657 - DNA, 924 bp, Homo sapiens
  misc_feature: GYAE6OF02HEJMO.49.64.F09.1.454.CMB.1.raw
  modified_base (95)..(95): a, c, t, g, unknown or other
  misc_feature (95)..(95): n is a, c, g, or t
tcagagtcgagagacacgaccggtgctcgatttagcgcgtatacaagggggagtcagtctcagtcaggacacagcatggacatgagggtccccgntcagctcctggggctcctgctactctggctccgaggtgccagatgtagacatccagatcgaccctagtctccatccgcctgtctgcatctgtaggagacagagtcacctatctagtttcggcccggggtacaaacggttcgaaggtacgttaatttacggacctaaaacgtttaacgttttaaaaagtttcggggttaaactttaccgaacgggtaccctaaaaccgggttaaccccccccgggggggaaaacgggttaccccccccgttaaaagggtttaacccgttacgggtaacgtttaccttaaacggtttcgggtacccttaagggtcccgtaacggtaccccttaaaacggtttttacgaaccggttaaaaggggttccggggggttaccccctaaagttaccggtaaaacggggtttaccgaagggttacgggacccgtaagggttacgggtacgttacgggtacggggtaaactaacggtaaacttttacccgaaccttttacccgtacctaacccggtaactaccgaacgtaccgtaacgttccgtaacggtacctaaacccgtaggttaaaccgttacggttttaaggaaaacgtttacgtttaactttaaggtaccctaaacgtaaggttacggtttaaacggtaaactttcggaccgtttacttaacgggttttccgggaacgggtacccggtaacggtaacggggttaggaacggtaaccgttaacgggaaaaacggttaacgttacgggtacgggtaccgttaacgtacccgtaaccttacggttacccgtttggttaccccttaagttaccccg

SEQ ID NO: 127658 - DNA, 684 bp, Homo sapiens
  misc_feature: GYAE6OF02G1B26.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttcgccgggcaagtcagagtattagacaactatttaaattggtatcagcacgtaccccggggaagccccgtaagttactgactctatgctgcacgctagttgacgtaagtcgggtaccagtacgtaacggttcgagtcggactaggtcggagtcgtagggtaactaagttaacttcgtaccttcctacctaaccgtacgtacaacgtctagtacctacgacctaaccgtagtaaacgttacgttttaagggttaaacgttaacgttaacgttacgttaacctaaagtaacggttaacggtttaaccggtaaacgtttcgtaccgtttacgtttaacggttttccgggaaccggggtaacgggtaaccggtaacggggttacggaacggttaacgtaaacggtaaaacggtaacgttacgggtaacggtacggtacgtaccgtaccgtacttcgttaccgttaccttaccgttacccgg

SEQ ID NO: 127659 - DNA, 787 bp, Homo sapiens
  misc_feature: GYAE6OF02HMJ80.49.64.F09.1.454.CMB.1.raw
tcagagtcgagagacacgaccggtgctcgatttagcgcgtatacaaggggggagtcagtctcagtcagggacacagcatggacatgagggtccccgctcagctcctggggctcctgctactctggctccgaggtgccagatgtgacatccagatcgacccagtcctccatccgccctgtctgcatctggtaggagacagacgtcaccatctagttcggccggacaagtcagagtattagactaaacttaatttaaattggatcgagcaacgtaccccggggaagaccctaagtactagatctatgctcgcagtccaatttgacgaaaggtcgggtaccataccgtaagttcgaggtcgactaggtgaacgtcgaggactaagtaactacaccgttctaaccgtaacctataccgacgtacgtagtcgtaccgtaactaaaccgtaaggtaaaccgttaaagttttaagggtaaaacgtttaccgttaagtttaacgtaacgtaaaacgtaacgggttaaacggttaaaccggttaaacgttacggtacccgtttaacgttaacgggtttttaccggggaaccggggttaaacccgggtaaaccgggtaaacgggggttaacggaacgggtttaaaacgtaaaaccggtaaaaaaacggggttaccggttaaacgggttaaccgggttacccggttaaaccgggttaccccgtaaaacccggtttaacgttttaacccccggttttaagggttttaaccccggtttaaccggttttaaaccccccggg

SEQ ID NO: 127660 - DNA, 571 bp, Homo sapiens
  misc_feature: GYAE6OF02IMXQB.49.64.F09.1.454.CMB.1.raw
  modified_base (369)..(369): a, c, t, g, unknown or other
  misc_feature (369)..(369): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcacgtaccccgggagccctaagttactgatctatgctgcagcctaatttgacgaaaggtcgggtccatacgaagttcagtgcagtgatgtagggacagtaatcactctcacatcancagtctgacaactagtaacgtattttaggaaattacttagttacgtactaaacgaaggtaacgttaaccggaaagttttcgacttacgttaaggttttccggggacgggtaacgggtaacccgaagggttacggagtaacgtaacgaaaaggtaccgtaggtaggacctaggacctacgtactacggtcgttacctctaccg

SEQ ID NO: 127661 - DNA, 840 bp, Homo sapiens
  misc_feature: GYAE6OF02FVH97.49.64.F09.1.454.CMB.1.raw
  modified_base (139)..(139): a, c, t, g, unknown or other
  misc_feature (139)..(139): n is a, c, g, or t
  modified_base (262)..(262): a, c, t, g, unknown or other
  misc_feature (262)..(262): n is a, c, g, or t
tcagagtcgagagacacgaccggtgctcgatttagcgcgtatacaagggggaggtcagtctcagtcaggacacagcatggacatgagggtccccgctcagctcctggggctcctgctactctggctccgaggtgccagntgtgacatccagatgacccagtctccatccgccctgtctgcatcgtgtaggagacaggagtcaaccatcatttgccgggacaagtcaggtagtattagctaactatttaaattaggtatcganacgtacgtacccggggaacgtccccgtaagttacgtaggaacttctaagtcgactgtacgagtacctaattttagacgtaaaggttccgggggttacccaacgtactaaacgggttctaacggtcggtaccgaaggttagggtacttaccgggtagggaacgtaaggttaaacgttacccgtaacttccgtacctaacccgtaactaccgtaacggaaccgtgtaacccgttcggtaacctaaaccccgtaggttaaacgggtaagttttttaaccggggaaaagtttacccggtttaaattttaacgggaaccctttaaaaccggtaacgggtttaaaccggttaaaccgggtaaaccggtttacgtaaccgtttaaccggtttaacgggttttaacccgggttccggggtaaaaccggggttaacccggtaaacggggggttacgggtaacgttaaccgttaaaaccgggtaaaaagttaaacccgttacggggttaaccggtaccggtttaacggtacccgaaccggtttaaacccgttcggttaacccggttttccgtttaaccggttaacccg

SEQ ID NO: 127662 - DNA, 608 bp, Homo sapiens
  misc_feature: GYAE6OF02INI0Q.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcaagtaccccggggaagcccctaagttactgatctatgctgcagcctaatttgacgaaaggttcggggtacccaagtactaaggttcaggtggataggtggatcggtaggacagtaattacactctcaccatcagcagtctagccaaccgtagaaagttagttttaaggtaaaacgtttactaatttacgtacaaacgtaggtaacgttaacggtaaacttcgacttcgttaagttttccgggacgggtacggtaaccgtaagggtaggagtaagtacgaaaaaggtaccgttagggtacggtccgttaggaccctaccgtaacgttccgttacgtttacctttacgttaacccg

SEQ ID NO: 127663 - DNA, 677 bp, Homo sapiens
  misc_feature: GYAE6OF02JKWPY.49.64.F09.1.454.CMB.1.raw
tcagagtcgagagacacgaccggtgctcgatttagcgcgtatacaagggggagtcagtctcagtcaggacacagcatggacatgagggtccccgctcagctcctgggctcctgctactctggctccgaggtgccagatgtgacatccagatgacccagtctccatccgccctgtctgcatctgtaggagacagagtcaccatctatttcggccgggcaagtcagagtattagactaacttatttaaattggtatcagcaacgtacccgggaacgtcccctaagtactgatctatcgctgcacgctaattgacgtaaagtcgggtaccatacgaagttcaggtggacaggtgagtcgtagggacagtatcactctcgacctatcagtctacgtccgtagaccaaaccgttaggaaacgtttagtttaacggaaacgtttacgttaaggttcgttaacgaaacgtacgggttaaacgtttaaccggtaaacgtttcgtacgtttacgttaacgggttttacccgggaacgggttaaaccgggtaacccgtaaaggggtttcgggaacgttaaacgtaaccggtaaaaaacggtttaccggttaacggtacgggtaacccgttacggtaaccctacgtaaccggtttacccgtttaggtaccccttttaggttaaccccg

SEQ ID NO: 127664 - DNA, 721 bp, Homo sapiens
  misc_feature: GYAE6OF02JR1AE.49.64.F09.1.454.CMB.1.raw
tcagagtcgagagacacgaccggtgctcgatttagcgcgtatacaaggggaggtcgagtctcagtcaggacacagcatggacatgagggtcccgctcagctcctgggctcctgctactctggctccgaggtgccagatgtgacatccagatgacccagtctccatccgccctgtactgcatctgtaggagacagacgtcaccatcatttcggccggtcaagtcagagtattagcaacttatttaatgtaatcagacacgttaaccccgggacgtacccctaaggttacctagtactcctagtacgcttacggactacgtacctaagtttcgaacgtaaacggtcgggttaccccagtaccgtaaggttacgtacggtcggtacgtaggttaggacgttcggttagggaacgtaacgtaacgtttaccgtaccgtttacctaccgtaaccgtactttacccgaacgtacgtacggttacctacgtaccgtaacgttaagtaacgtttacgttaaggttaaaccgtttaacttagtttaccggtaaactaacgtaacggtaacgtttaaaccggtaacgtttacgacgttacgtttacggttttaccggaacggttaccgggaaacgtaggggtacgtaagtaactaacggtaaacgtacggttagtacggtacgtacgtaccgtaccttaacgttaccgtacggttaccttagttaaccccg

SEQ ID NO: 127665 - DNA, 661 bp, Homo sapiens
  misc_feature: GYAE6OF02GWXP3.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagactaacttatttaaattggtatcagcacgtaccccggggaagacccctaagttactgatctatgctgcacgacctaatttgacgtaaaggtcggggtacccagtacgaaggttcaggtggcgtaggtggtagtcgtagggaacagtaacttcaccttcctaccaacctatacagcctaggtacctcggacctaaccgtagtaaacgttacgttttaaggaaacgtttaacttagttacgtaacctaaacgtaggttaaacggtttaaaccggtaaaacttttcggacctttaacgttaaggttttacccgggaacggggtaaacgggtaacccggtaagggttacgggaagtaacgttaacgaaaacggtaaccgttgggtacgtacgtacgaccgtaccgtagttaccgttcggttaccttacgtacccg

SEQ ID NO: 127666 - DNA, 608 bp, Homo sapiens
  misc_feature: GYAE6OF02JXZY6.49.64.F09.1.454.CMB.1.raw
  modified_base (524)..(524): a, c, t, g, unknown or other
  misc_feature (524)..(524): n is a, c, g, or t
  modified_base (584)..(584): a, c, t, g, unknown or other
  misc_feature (584)..(584): n is a, c, g, or t
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtccaccatcatttgccgggcaagtcagagtatagcaacttatttaatgtatcagcagtaccccggagccctaagtactgatcatgctgcagtcctaatttcgacgtaaaggtcggccaactacgtaaggttcacggtgctaggtgtactcgtagggacagtaactctactctacaaccgtatacgagctaattcgtaggtacctaacgtggaaacgttaagtttaggaaacttcgttaagttcgtaacaaacgtaacggtaacgttaaacgggaaacttcgacgttaacgttagtttaacgggccgggtaaacggaacctaggggttanacgtacgtaaaccggtaaaagttaacgtcggtaacgttccgtagtaacgaccgtttaacnccggttaacgttcttccgtaaccg

SEQ ID NO: 127667 - DNA, 812 bp, Homo sapiens
  misc_feature: GYAE6OF02F8IEX.49.64.F09.1.454.CMB.1.raw
  modified_base (192)..(192): a, c, t, g, unknown or other
  misc_feature (192)..(192): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatcccgccctgtctgcatctgtagganacagagtcaccatctatttcggccgggactaagtcaagagttattagactaacttaatttaaagttggtactacgagaccgaccggtaaccccgggggaacgtacccccgttaaaggttacctagtattacctatcgtcgtgccaacgtaccttaatttacgaacgtaagggttccgggtaccctaagttaacgtaacggttcgtaggtacggtacgtaggtacggtacgttcgggtacggtaactaagttaaccgtttaccgaacccttaccctaacctaaccgtacgtacccgtacggtaccgtacggttacctaccggtaacccttaaacccggtaggttaaacggtttaacggtttttaagggtaaaacgtttacgtttaacgtttaccgtaaacgtaaaacgtaaggtttaaccgggtttaaaccgttaaaccgttcgttaccgtttacgtttaaccgggtttaccggggaccggttaaacgggtaaccggtaaggggttaacggtaacgtaacggtaaaaccgtaaaacgggtaacgtttcgggtaaccggttaccgtaccggtaccctaacggtttaccctacggttttaccgttacctttacccgtacccgg

SEQ ID NO: 127668 - DNA, 694 bp, Homo sapiens
  misc_feature: GYAE6OF02FV99S.49.64.F09.1.454.CMB.1.raw
  modified_base (281)..(281): a, c, t, g, unknown or other
  misc_feature (281)..(281): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtattagcaacttattaaattggtatcagcacgtaccccggggagacccctaagttacngtatctatcgctgcacgcctaatttgacgtaaaaggttcggggtacccctagtaacgaacggtttacgaggttagggacctaggtcgggtagttcggtacggggaactaaggtaaactttcccgtacttacgttacccaaccctaacgttaccaacgtccgtaacgtccgtacgtaaccgtaacccgtaagggtaaacgttaagtttttaacgggaaaacgtttaacgtttacgtttaacgtaccgtaaaccgtaaggtaacggtttaaaccggtaaacgtttcggtacctttacgttacggttttacgggaaccgggtaacgggtaccgtaagggtcgggagtaactaacggtaaaacgtacgtacgtacggtacctaggacccaccgtataccgttgttacctattacccg

SEQ ID NO: 127669 - DNA, 656 bp, Homo sapiens
  misc_feature: GYAE6OF02HO1IB.49.64.F09.1.454.CMB.1.raw
  modified_base (619)..(619): a, c, t, g, unknown or other
  misc_feature (619)..(619): n is a, c, g, or t
  modified_base (635)..(635): a, c, t, g, unknown or other
  misc_feature (635)..(635): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatcccgcctgtctgcatctgtaggagacagagtcacatctagttcggccggcaagtcagagtatagactaacttaatttaaattggtatacacgacgtaaccggtaccccgggggaacgtacccccgtaaagttacgtacgtatctatcgtctcgcacgaccttaagttgaacgtaagggtccgggtacccagttacgtaacgggttcgtaacggtcggacgtaggttacggtacgtacggtagggaactaagttaacttcccgaccttcctaacctaccgtataccgaagtctacgtccgtacgaacgtaaaccgtaggtaaagtttaagtttaacgaaacgttacttagttacgacaagtacggtaacgttacggtaacttcgacttacgttacggttcggacgggtaaacggacgtaagggtacgagtaacgtaaggtaaacgtcgtaggngtactacgactacgtnttacgtcgttactactacccg

SEQ ID NO: 127670 - DNA, 700 bp, Homo sapiens
  misc_feature: GYAE6OF02JZLGJ.49.64.F09.1.454.CMB.1.raw
  modified_base (159)..(159): a, c, t, g, unknown or other
  misc_feature (159)..(159): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccngtcctccactcccgccctgtcctgcctatctgtaggagacagagtcaccgatcagtttcgaccgggacaagtcagtagttatacgacgtaacttaattttaaagttggtaacttcgagaccaacgttaacccccgggggaacgtacccccgttaaaggttacctagacgtactatcgactgacagtacctaatttcgaagtaacggttccgggtaacctataaccgtaaggttcgtaggtacggggtacaacgggttcgtaggtaccgtaggggaacctaaggttaacctttcgactccgtacaacctntacacgtccttancgttacgaacctaaccgttaagaaggttaagtttaacggtaacttacgtacgttaccgaacgttaacgaacggttacgttaaaccgggttacttacgtaccttaccgttaggttttaccgggaacgggtaacgggtaaccgaggggttagacgtaacgtaacgaaaagttcggtaaggacgtcgagttccaacgtcgtactaccgttagtcccttaacg

SEQ ID NO: 127671 - DNA, 611 bp, Homo sapiens
  misc_feature: GYAE6OF02G765S.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggcaagtcagagtatagcaacttatttaaatggtatcagcacgtaccccgggaacggtcccctaagtactgactctatgctgcacgtcctaagtttgacgtaaaggtcgggtacccagtcgaaggttcaggtcggacaggtgatcgtaggacagtattcactctcacatcgagcacgtctcgacctaacgtagaagttagtttaaggaaagttacttagttagtaaccaaacgtagttaacggttaaccgtaaacgtttcgtactttcgttaacggttttccggggacgggtaacgggtaaccgtaagggtacggagtaacgttaacgaaaaggtacgttacgggtacggtacgtacgtaccgtaccgtacgttccgtttacgttaccttacgttacccg

SEQ ID NO: 127672 - DNA, 551 bp, Homo sapiens
  misc_feature: GYAE6OF02FKXC1.49.64.F09.1.454.CMB.1.raw
  modified_base (304)..(304): a, c, t, g, unknown or other
  misc_feature (304)..(304): n is a, c, g, or t
  modified_base (360)..(360): a, c, t, g, unknown or other
  misc_feature (360)..(360): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagactaactattaaattgtatcagcagtaccccgggaaggtcccctaagttactgatcatgctgcagctaattganaagtgggtcccatcaagttcagtgcagtggatcgtggaacagaacttcactctacncatcagctagctgccaacgtgaagtagtttaggaaatacttaagttagtcaaacgtagtacggttaaacggtaacttcgtacttctaaggtttttccggacgggtaacgggacgtaagggtggtacgagtaacggtaaaagaacgtttaggtacggtagtcgaccacgttagtcctacgttcctattaccg

SEQ ID NO: 127673 - DNA, 749 bp, Homo sapiens
  misc_feature: GYAE6OF02H0XZB.49.64.F09.1.454.CMB.1.raw
  modified_base (151)..(151): a, c, t, g, unknown or other
  misc_feature (151)..(151): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacactccanagtcgaccctagtcctccacgtccccgtccctcgtcctcgtcacttctaggtaggaacggaacaaggtacgtaccacctaacttctaggtttcggaccggggtacaacgtcgaagaagttagtacgaactaacgtttaaatttaaagttggtaatacgtcgaaccgtacggtaaccccgggaacggtccctaaacgttactagtactacttacgttgaccgtactacgacttaaccgtaatttaggtaccgtaaacgggttccgggtacctaagtacggttaacggtagtacggtagcgtagggtagtcgtacggtaggaaccgtagttaaccgtccgtacctacgtaccctaacctacgaccgactaccggttagtccagtaaccgtacgtaagttacgtttaacgtttaaggtaaacttacggttatacgttaaacaagttaacggttaacgttaaaccggttaacgtaccgtacgttacgttacgggtttacgggaacgggtacggtaagtaacgggtagtaacggtactaaacggtaacggtaacgtggtaccgcgttacgtacaaccgtgttaaccgtcgttacctcgtaccg

SEQ ID NO: 127674 - DNA, 736 bp, Homo sapiens
  misc_feature: GYAE6OF02J0FJH.49.64.F09.1.454.CMB.1.raw
  modified_base (525)..(525): a, c, t, g, unknown or other
  misc_feature (525)..(525): n is a, c, g, or t
tcagagtcgagagacacgaccggtgctcgatttagcgcgtatacaaggggagtcagtctcagtcaggacacagcatggacatgaggtcccgctcagctcctgggctcctgctactctgctccgaggtcgccagatgtgactatccagatcgacccagtcctccatcccgccctgtctgcactcgtaggtaggacgacgacgtagtaccaccgtattccgtaagtttcggacccgggtactaacgtaccgtaaggtaagtttaacgttaacgtaccgttaaaccgttttaaagttttaaaagttacgggttaataccggtaaggtaccgtaaaccggtaacccccggggtaagtacccccgtttaagttaccgtagtactacgtacgtgtcctacggtaccaacgtacctaattaccggacgtaaacgggttccggtacctaagttacgtacggttacgacggttacgaccgtaggtacgacgtcggtaacgtacgtaagtacgtactacgtaccgtactacgtanaccgtacgaactaccgtaccgtacgaccgtaaacgttggtaacgtttaagtaaccggttaaattccgttaagttacggaacctaaggtacgttaacggttaaagtacgttctacgtacggttacgtacgggacggtacggtaacgtaagtcgtagacgtaacgaagtacgtgccgttaagccgtaagtctaccgtgtcctacgaccgtccg

SEQ ID NO: 127675 - DNA, 710 bp, Homo sapiens
  misc_feature: GYAE6OF02F9E0K.49.64.F09.1.454.CMB.1.raw
  modified_base (262)..(262): a, c, t, g, unknown or other
  misc_feature (262)..(262): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttcggccggcaagtcgagtaggtattagactaacttatttaaagttggtatacganacgaacgtaaccccggggaagtcccctaagttacngtatctatgctncagcctaattagacgtaaggtcgggtaccatacgtaaggttcgaggtcggtactaggtggtactacggtagggtaactaaggttaacttacctaacttcccgtacaacccgtactacgtaacgacgtacggttccgaacgtaccgtaaacgttaggtaaacgttttaaggtttaaacggttaaacgtttactttaacgtttacgtaaactaaaccggttaaaggttacgggttaaaaccggtaacgttgttaaccgttacgtttaacgggtttcccgggaaagggtaaccgggtaaccgtaaggggttacgtaacggtaacttaaaccggaaaaggttaccgttgggtaaccgtcgtaaccacgttaccgtcgttaccgtggtttaccctacgttacccgg

SEQ ID NO: 127676 - DNA, 678 bp, Homo sapiens
  misc_feature: GYAE6OF02GKIQR.49.64.F09.1.454.CMB.1.raw
  modified_base (219)..(219): a, c, t, g, unknown or other
  misc_feature (219)..(219): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgcccttgtctgcatctgtaggagacagagtcaccatcatttcggccggganaagtcagagtattagcaactattaaattggtatcagcacgtaccccgggggagtaccccgtaagttactgatctatgctgcagcctaatttgacgtaaaggtcgggtacccagtacgtaaggttcaggtggacgaggtcgatcgtagggactagtaacttcactcctacacctatacacgctagtcgtacgactaaacctaggtaagttacgtttttaaggaaaacggttaacttaacggtttcgtaactaaactaacggttaacggtttaaacgggtaactttacgtaccgttacgtttaacggtttttccgggaacggggtaaccgggtaaaccgtaaggggttacggtaacggaagttaaaccggaaaacggttaacgttacgggttaacggtcccgttaacggacccgtaacccttaacggttacccgtttacggtttacctttaccggttaccc

SEQ ID NO: 127677 - DNA, 755 bp, Homo sapiens
  misc_feature: GYAE6OF02H6W1S.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccggaggtgccagatgtgacatccagatcgacccagtcctccactcccgcccttgtctgctattctaggtaggagacgagacgtaccaacctagttcgtagtttcggacccgggataaacgtcgaaggtagttattacgacctaaactttaagtttttaaagttcggttaattcgacgtaccgtaaccggtaaacccccgggggaaccgttacccccgttaaaggttaccgtagtaacttacgttagtcgtcgtacgacgtaccgtaccttaacgttcgaacgtaacgggttccgggtaccctaagtacgttaacggttcgacggtaggcgtaggtacggtacgtacggtagggtacaacgttaatccctacgtactaccgaactacgtacgacgtactgtacgtctaccgtaaacgtagtaaggtttacgtttaacggaaacgtttacttagttacgtaagaacgtaacggtttaacgttaaaccgtacttcgtacgttacgtttaacggttccggaacgggtagggtaaaccgtaaggtggtaacgtaacgttaacgaaacgggtagttacggccgtaacgtccggtaactacccgttatttccggtaccttaccttcttaccccggg

SEQ ID NO: 127678 - DNA, 725 bp, Homo sapiens
  misc_feature: GYAE6OF02F2YBZ.49.64.F09.1.454.CMB.1.raw
  modified_base (96)..(96): a, c, t, g, unknown or other
  misc_feature (96)..(96): n is a, c, g, or t
tcagagtcgagagacacgaccggtgctcgatttagcgcgtatacaaggggggagtcagtctcagtcaggacacagcatggacatgagggtccccgntcagctcctggggctcctgctactctggctccgaggtgccagatgtgacatccagatcgacccagtctccatcccgccctgtctgcatcgtgtaggagacagacgtccacatctatttcggccgggacaagtcagtagtaattaggactaaacttaagtttaaagttggtatcagacgtaaccggtaaccccgggggaacgtacccccgttaagttactacgtaatactatcggctggactacgaccttaagtttcgaacgtaaagggtcggtacctagtcgtaagttcgagtcggacgtaggtggtactacggtaggaaccgtagtaacttccgacttccgaaccgtaacctacttaccgaaggttcccgaagttccgtaaccgaaccgtaaccggtaagtaaacggtttaaggttttaacggaaaaagttcgttaaagttacctaaccggtaaacgtaaagggttaaacgttaaaccggtaaatttcggtaacctttacggttaacgggttttaccggggacggttaaacggggaacgtaaggggtaggtacgaacgtaaacggaaaaggttcgtacggtacggtctaacggacttacgtacgttacctcgtttacaccgtttaccc

SEQ ID NO: 127679 - DNA, 684 bp, Homo sapiens
  misc_feature: GYAE6OF02GDBS2.49.64.F09.1.454.CMB.1.raw
  modified_base (193)..(193): a, c, t, g, unknown or other
  misc_feature (193)..(193): n is a, c, g, or t
  modified_base (443)..(443): a, c, t, g, unknown or other
  misc_feature (443)..(443): n is a, c, g, or t
tcagagtcgagagacacgaccggtgctcgatttagcgcgtatacaagggggagtcagtctcagtcaggacacagcatggacatgagggtccccgctcagctcctgggctcctgctactctggctccgaggtcgccagatgtgacatccagatgacccagtctccatccgccctgtcctgctatcgtgtagganacagacgtcaaccatcagtttcggccgggactaagtcaagtacgtaattacgactaaacttaatttaaagttggtatcaagtcctaacggtacccccggggaaaggtcccccttaaaggttacctaggtaattcctaagtcgtctacgtcagtaccttaagtttcacgtaaaggttcgggtaccccaagttaccgtaaggttccaaaggtcggactaggtacggattcggtagggaacaggttacttacnccgttaccacaactctactacgtacgagttacgtacgtacgtaacctaggtaagttaagttttaacggaaagttaactttagttacgtacaaacgtaacgttaacggttaacgtaacgttcgtacttacgttagtttccgggtaacggacggtaacgtaagggtagtagaacgtaacgtaaaggtaacttaggcggttactacggactaacgttacgtacttcggttacttaccgttaccg

SEQ ID NO: 127680 - DNA, 599 bp, Homo sapiens
  misc_feature: GYAE6OF02FLPZW.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcacgtaccccggggaagcccctaagttactgatctatgctgcagcctaagtttgacgtaaaggtcgggtacccagtcgtaaggttcagtggcagtggatcgtggacagtaattcactctcacctatcagcagtctagacctaactagaagtagttttaaggaaagttacttattcgtaacaacgtaggtaacgttaacggtaacttgacttacgttagttttccgggaacggtaacgggtaaccgtaagggttacggacgtaacgtaacggaaaaagtacgttagggtacggtacgtacggtaccctaccgtacgttaccgttacggtttacccttaccgttaccg

SEQ ID NO: 127681 - DNA, 503 bp, Homo sapiens
  misc_feature: GYAE6OF02FFVNP.49.64.F09.1.454.CMB.1.raw
  modified_base (346)..(346): a, c, t, g, unknown or other
  misc_feature (346)..(346): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactattaaattggtatcagcataccccggggaaggccccctaagttactgatctatgctgcagccaattgcaaagtggggtccccatcaagttcagtggcagtgatctggganagaattcactctacaccatcagcagtctgcaacctgaagtattttggaaagttctattgtacaacagagttaacggaacttgactctagttttcgggacgagggaccgaacgggtggagatacgaaaagactaggtggctgcacatctgtcttctac

SEQ ID NO: 127682 - DNA, 662 bp, Homo sapiens
  misc_feature: GYAE6OF02H3DA6.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcacatctattcgcggacagtcagagtatagactaacttaatttaaattaggttaatctaagccgacgtaaccccgggggaacggtacccccttaaggttaacgtagtattctaagtgctagcacgacctaatttgacgtaaggttcggggtaccctagtacgtaacggttcgaggtggacgtaggtagggtacgttacggtacgggactaagtaacttacgtacctcctacctacctactacgacgtacgtaacgtcgtacgacctaaccgtagtaacgttaagtttaaggtaaacgttacttacgttacgtaacgaacgtaacggtaacgttaacgaacgttcgtacttacgtacggtttaccgggacgggtaacgggtaacgtaagggtacgagtaactaacgaaacggtacgtaggtaggtaccgtacgtacgaccgtagttccttacgttcctactaccg

SEQ ID NO: 127683 - DNA, 778 bp, Homo sapiens
  misc_feature: GYAE6OF02HMGJ6.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatggtgacatccagatgacccagtctccatccgcctgtctgcatctgtaggagacagagtcaccatctattcggccgggacagtcagtagtatacgacaacttaatttaaagttggtatacgtacgaccgtaaccggtaaccccggggtaacggtaccccttaaagttacgtcgtaacttcctaagtacgtcctagacctaggtacccttaagtttacgacggtaaaagggttccgggtaccctagtaccgtaaggggtactagggtcgtagacggtacgggtattacggagggttaacaagtaaccgttacacgttacctactaccgtaacgtcgaacgtaccttaccggtcttagaacccgtaacgttacgggttaaagtttacggttttaaacgggaaacgttttaacgttacgtttaacggaccttaaaggaacggttaaaccggggtttaacctaaacggtttcgtaccgtttaaccggtttaggttttaccgggggaaccgggtaaacgggtaaccggttaaggggtaccggtaataaccggttaacggtaaaaacgttccgggtaaggtccggaacccttccggtaaacgtaccggtactttaacgggttcctttacgtaccccgtttaaccg

SEQ ID NO: 127684 - DNA, 682 bp, Homo sapiens
  misc_feature: GYAE6OF02JXJ18.49.64.F09.1.454.CMB.1.raw
tcagagtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatcgtgtaggagacagacgtcaccgatcgatttcggccgggcaacgtcagacgtattacgctaacttattaacgtgtactacgacgtaccgtaacggtacccgggaacgtacccgtaagttacgtagtactacgtacgtcgcgtacgctacgtactagttacgacgtaacggtcggtacctagtacgtacggtacgtaggtacgacgtaggtacggtacgtacggtacggtaactacgtacgttccgtacgtccgtaccgtacctacgtacgacgtacgtacgtcgtacgtaccgtaacgtagtaacgttacgttaacggtaaacgttacgttaacgttacgtaactaacggtacgttaaacgtaaccggttacttacgtaccttacgttaccggttacgggtaacgggtaacgtaacggtaaggtacgtagtaacgtaacggaaacggttacgtacggtacggtacgtacgtaccgtacgtagttccgttacgtcttacgtcg

SEQ ID NO: 127685 - DNA, 632 bp, Homo sapiens
  misc_feature: GYAE6OF02I1SHX.49.64.F09.1.454.CMB.1.raw
  modified_base (196)..(196): a, c, t, g, unknown or other
  misc_feature (196)..(196): n is a, c, g, or t
  modified_base (624)..(624): a, c, t, g, unknown or other
  misc_feature (624)..(624): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagngtacaccatctatttggcccgggacaagtcagtagtatacgactaacttatttaaagttgtatcagcacgtaccccggggacgtaccctaagtactgtatctatgctgcgtagacctagttgacgtaaggtcggtccagtacgaaggttcgaggtggacgtaggtacggtatcggtaggaactaagtacttacctactaccctacacctactacgacgctacgtcgacgtaccgaacgttgtaagtttagtttaacggaaagttacttagttaagtacctaaacggtaggttaacgttaacggttaacttcgtactttacgttacgggttacgggacgggtaacggaaaccggtaggtaggataacgtaacggaaagttaaccgtgggtacgtaccgtagaccgtacgtaccttcgtacgttaccttntaaccccg

SEQ ID NO: 127686 - DNA, 689 bp, Homo sapiens
  misc_feature: GYAE6OF02JONL3.49.64.F09.1.454.CMB.1.raw
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
tcagagtcgagagacacgaccggtgctcgatttagcgcgtatacaagggggagtcagtctcagtcaggacacagcatggacatgagggtccccgctcagctcctgggctcctgctactctggctccgaggtcgccagatgtgactatccagatgacccagtcctccactcccgcctgtctgctatctgtaggacacagacgtcaacctatctatttcggccggacaagtcagaagttatagtacaacgttaattaatggtatccgancacgtacccgggacgtaccctaagtctacgatctatntctcgactacgaccgtagtttacgacgtaaacggtcgggtaccctaacgtctaacgggttacctagggtaccgtgaaggttcggtaacgttcggacgggtaacgaagttacgtaccgtccttaaccggttaccaccgtatacgtaccgacgttacgtactcgaaacctacgtaggtaaacgtttagttaacggaaactttagttacgttacgaacttaaggaaagttaccggttaaacgtaaacgttcgtacctttacgtacggttttacccgggggaaccggtaacgggtaaacgggtacggttaaggtaacctaaggtaaacaaacgggttacttagggtacgaccggtcaacgttccgtacttcgtacttacgtcccgttac

SEQ ID NO: 127687 - DNA, 815 bp, Homo sapiens
  misc_feature: GYAE6OF02IR9ML.49.64.F09.1.454.CMB.1.raw
tcagagtcgagagacacgaccggtgctcgatttagcgcgtatacaagggggagtcagtctcagtcaggacacagcatggacatgaggtccccgctcagctcctggggctcctgctactctggctccgaggtgccagatgtgacatccagatcgacccagttcctcctatcccgccctgtctgcattcgtgtaggagacagagtaccaccatacctagtttcggaccgggtacaagtaccgtaagtagttagttacgacctaaaccgtttaattttaaagttaggttaatacgaacgcctaaccggtaacccccggggaacggtacccccgttaagtaaccgtcgtaacccttagtcgtcgtacggaccacgtcttaagtttacgaacgtaaggtcggtaccctagtacgtaacggttcgtaggtcgtaacgtaggttagggtaccgttacggtaacggaacgtaaacgtaaccgtttacccgtaaacttccccgttaaccgtaccctacgttaaccgcgtaaccgttacggttaccgtaaccgggtacctaaaacggttacggtttaaacggtttacggttttaaagggtaaacgttaaccgttttagttaaccgtaaccgttaaaacgtacggtttaaacggttaaaccgggtttaaacctaaccggtttaccgttaaaccggtttacggggtttaacgggaacgggttaacggtaagggtaacggaagtaaccgtaaacgtacgtaacgtggtaccgtagtaccgtacgtaacctcgttcgttacgttaccgtttcgtaccgttccctacccg

SEQ ID NO: 127688 - DNA, 835 bp, Homo sapiens
  misc_feature: GYAE6OF02H7K8E.49.64.F09.1.454.CMB.1.raw
tcagagtcgagagacacgaccggtgctcgatttagcgcgtatacaaggggggagtcagtctcagtcaggacacagcatggacatgagggtccccgctcagctccgtggggctcctgctactctggctccgaggtgccagatgtgacatccagatcgacccagtcctccatcccgccctgtctgcatctgtaggagacagagtcaccatctagttcggccggtacaacgtacgagaagttattaagactaaacttaattttaaagttggtaactacgaacgaccgtaaccggtaacccccgggggtaaacggtacccccgttaaagttaccgtacgtacttacttagttcgtccgtacggaccgtaaccgtaccgttaaacgtttacggtaaacggtaaaccggggttccgggtacccctaacgttaacggtaacgggtttacgtaacgggtcggtacggtacggtaggtacgttccggagggtaacgtaagtaaacgttcctaaccgtacctaacccaaccgtatacccggacgtaccgtacgttaccgtacgtaaaccgaaccgttaaggtaaacgtttaaggttttaaacggtaaaacgttacgtttaaggttagaaaccgtaaaggttaacggttaacgggtttaaacccggtaaacgtttacgtaccgtttaccggttaaccgggtttcgggggaaccggggtaaacgggtaaaccggttaaggggtacggtaacgttaacgtaaaacggtaaaccggtaacggttagggtaccgtacgtacggaaacccttacgttaccgttacggttacctttacccgttactacccgg

SEQ ID NO: 127689 - DNA, 671 bp, Homo sapiens
  misc_feature: GYAE6OF02HVAY1.49.64.F09.1.454.CMB.1.raw
  modified_base (227)..(227): a, c, t, g, unknown or other
  misc_feature (227)..(227): n is a, c, g, or t
  modified_base (274)..(274): a, c, t, g, unknown or other
  misc_feature (274)..(274): n is a, c, g, or t
  modified_base (318)..(318): a, c, t, g, unknown or other
  misc_feature (318)..(318): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtcgccagatgtgacatccagatgacccagtcctccatcccgccctgtctgcatcgtgtacggacacgagagtaccacactctagtttcggccgganaacgttacagtacggttatagactaactttaatttaagttagttacncgagactaccggtaaccccggggaaccgtacccttaaggttacncgtatacgtagttagcgtacgactaacgaccgttaatttacggaactaacggggtaccgggtaccctacgtacgttaaggtttacgacggtcgacgtaggtacgaggtttcgcgggtaaataagtacttaccacgttcctaccgtactactacgacgtacgtcgtcgtactacgtactaaggtagttacgttaagttaacttagttagtactaagtacgtacgttaaacgttaagtacttctacgtttcgttaacggtcggacggtacgacggttaggagtacgaacgtaacgtaaagttcgtaacggtcgcgtacgtacgtacgtacgttcgttacttctacccgttacccg

SEQ ID NO: 127690 - DNA, 621 bp, Homo sapiens
  misc_feature: GYAE6OF02HAKWL.49.64.F09.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgccatctgtaggagacagngtcaccatcatttgccgggnaagtcagagtatagactaactatttaaattggtatcagcacgtaccccgggaacgcccctaagttactgatctatgctgcagcctaagtttgactaaaggtcgggtacccagttacgaaggttcaggtcggactagtggagtcgtgggaacaagtaattcactctcacctatcagtcacgtctagaccaaccgtagtaaggttattttaagggaaacgttacttacgttgtaactaacgacggttaacgttaaaccgggtaaacttcgtaccgttacgtttaacggttttccggggaagggtaaccgggtaaccgtaaaggggttacggaagtaataacggaaaacggtaacgtaggttacggacgttagaccctaacgtacttcgttacgttacttaccgtacc

SEQ ID NO: 127691 - DNA, 557 bp, Homo sapiens
  misc_feature: GYAE6OF02JAGJH.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcacgtaccccgggaaggcccctaagttactgatctatgctgcagcctaattgacgaaagttcggggtacccagtcgaacggttcaggtggctagtagggagtcgtgggacagtaattcgactcgtaccaccatcctagctacgttatcgaccaaaccgtagaagtagttttaggaaattacttattacgtacaacgaggtaactaggtaaacttgtactgtagttcggcggaagacgaggtaggtagataacgaaagtacgtagtggtcgacggacctacgtagttccagtttcctcttaaccg

SEQ ID NO: 127692 - DNA, 712 bp, Homo sapiens
  misc_feature: GYAE6OF02FWGJP.49.64.F09.1.454.CMB.1.raw
  modified_base (302)..(302): a, c, t, g, unknown or other
  misc_feature (302)..(302): n is a, c, g, or t
tcagagtcgagagacacgaccggtgctcgatttagcgcgtatacaagggggagtcagtctcagtcaggacacagcatggacatgagggtcccccgctcagctcctggggctcctgctactctggctccgaggtgccagatgtgacatccagatgacccagtctccatccgccctgtctgcatcgtggtaggagacagagtccaccatctagtttcggaccgggacaagtcgagtagtatacgacaacttattaaattggtatcagtacgacgtaaccccggggaacgtaccctaagttaccngtaatctagtcgcgtgcacgtacctaagttcgaacgtaaaggttcgggtaccctagtaacgtaacggttcgtaaggtccggaacgtggtagacgttacggtaggaacgtaacgttaactaccgtactacctaccgtactaacttacgacgtcctaaggttcgtaccgtacgtaaaccgttacggtaaagttaaccgttttaaggggaaactttaccgttaagtttagaacctaaaggttaacggttaaggttaaaaccgttaaccggttcctagttaccgtttaacggtttacccggggacgggtaaaccggtacgttaacggggtagtaacgtacgtaaacggaaagtaaccgtgggtagtacccgtaggtaccgttaccagtttacgtccgttaccttgttaaccccg

SEQ ID NO: 127693 - DNA, 571 bp, Homo sapiens
  misc_feature: GYAE6OF02HMX4Q.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcacatctatttgccggcaagtcagagtatagactaacttatttaaattggtatcagcagtaccccgggaagaccctaagttactgatctatgctgcagcctaattgacgaaggtcgggtaccagtctaaggttcgagtcgacgaggtggtagtcgtggaactagtaacttcgactctaccactactacagctacgtctacgaccaactagtaagttagtttacggtaaacgttacgttaatttagacaaatacggtaattaaccggtaaattcgacttagttacgtttacgggacgggaacggtaccgtaaggtgagtactaacggaaagtaacgtggtacgcgtacgactaccattacgtctacttactaccg

SEQ ID NO: 127694 - DNA, 781 bp, Homo sapiens
  misc_feature: GYAE6OF02FQ8LX.49.64.F09.1.454.CMB.1.raw
  modified_base (290)..(290): a, c, t, g, unknown or other
  misc_feature (290)..(290): n is a, c, g, or t
tcagagtcgagagacacgaccggtgctcgatttagcgcgtatacaaggggggagtcagtctcagtcaggacacagcatggacatgagggtccccgctcagctcctggggctcctgctactctgctccgaggtgccagatgtgacatccagatgacccagtctccactccgccctgtctgcactctgtaggagacagagtcacatctattggccggcaagtcagagtatagactaactatttaaattggtatcagacacgtaccccggggaacgaccctaacgttacgtanatcttactgtcgtcgacagtacctaatttcgacgtaaagggtcggggttacccacgtacgtaacggttcgtaggtcggacgtacggttggtacgtacggtagggaacctaagtaacgttacctaaccgttacctaccgtaacctagtccgtaacggacctaacgttcgtacggttaaccgtaaacccgttaagggtaaaacgtttaagtttttaaacgggtaaaacgtttaaaccgtttacgtttaccgtaaacgtaaaccggttaacgggttaaaccggttttaaaaccgggtaaaccgtttcggtaccctttaacggttttaaccggttttaccgggggaacggggttaaccggggtaaaccggtaacggggttaagggtaaccgtaacgttaaaccgggtaaaaagttaaccgggtacggttaaccggtaccggttaacgtacgtaaccgttaccgttacggtaccgttttccgttaccgttaacccg

SEQ ID NO: 127695 - DNA, 677 bp, Homo sapiens
  misc_feature: GYAE6OF02IUJOM.49.64.F09.1.454.CMB.1.raw
tcagagtcgagagacacgaccggtgctcgatttagcgcgtatacaagggggagtcagtctcagtcaggacacagcatggacatgagggtcccgctcagctccgtggggctcctgctactctggctccgaggtgccagatgtgacatccagatcgacccagtcctccatccgccctgtctgctatcgtgtaggagacgagacgtacacatactagttcggccgggactaagtacaggtagttaattacgactaacttaatttaaagttagtatacagtacaccggtaaccccggggtaacgaccccgttaagttacgtagtactctatggtctaggacacgtactagttagacgtaaggtcgggtacctatacgtagtcgaggtgcgtagtgtactcggtacggaactagtaactccgactaccgtactacacgtcagtactacgtcgtacgtaacaacgttaggtaaacgttagttaacggtaaacttacgtacgtacgtaactaacgaagttaacgttaacggtaaactttacgacgttacggttaacgtttccggggaacggtaacgggtaaccgtaagggttacgaacgttaactaaacggtaaacggtaagtacgggttacgacgtaccgtaccgtaacgtccggttacggtaccttacgttaccgtaccccg

SEQ ID NO: 127696 - DNA, 754 bp, Homo sapiens
  misc_feature: GYAE6OF02GD7IW.49.64.F09.1.454.CMB.1.raw
  modified_base (189)..(189): a, c, t, g, unknown or other
  misc_feature (189)..(189): n is a, c, g, or t
tcagagtcgagagacacgaccggtgctcgatttagcgcgtatacaagggggagtcagtctcagtcaggacacagcatggacatgagggtccccgctcagctcctggggctcctgttactctggctccgaggtgccagatgtgacatccagatgacccagtctcactccgcctgtctgcatctgtagganacagtagtccaccatactagttcgccgggacaagtccaagtagtaattacgacctaacttaatttaaagttaggttactcgagtactacggtaacccccggggaagtacccccttaaagttacctgacttctagtcgactgacacggacctaagtttcgacgtaaacgggttcggtacccctagtaccgtaaacggtttcaaacggttggaccgttagggtacggtaacgttcggtaacgggtaacgaacggttaacttacccgtaccttaccgttaaccgaaccgtaacgtaccaacggtacgtacgttaaccgtcgtaacccgtaaaccggtttaacggttaaacgttacggttttaacggaaaacggtttaccttaagtttacggtaacctaaacggtaagttaccgggttaaacgtaaccgttgtaccgtttacgttaggttttacccgggacgggtacggaaaccggtagggttacgtaagtaccgtaacggtaacgttacggtacggtcgtacgtctaaccgacgttacttcgtacggtttcttaccgtagtttacccg

SEQ ID NO: 127697 - DNA, 631 bp, Homo sapiens
  misc_feature: GYAE6OF02I0LXV.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttcgccgggactaagtcagagtattagactaaacttatttaaattggtatcagcaacgtaccccggggaagtccccttaagttacctgacttctatgctgcagcctaattcgagtaacggtgggtacccagtacgtaacggtcaggtggacgaggtggtatcgtgggaacagtaattcactctcacctatcagctagcctagactaaccgtagtaacgttagtttaaggaaaagttcttacttacgtaacaaacgaagggttaacgttaaacgggaaactttgaccgtttacgttacggttttaccgggagggtaaacggaaccgtaaaggggtgaacgtacgtaaacggaaaaccgttagttacgggtacgtaccgttacgaccgttaacgtcgtttaaccggttcgttacttacccggtaacc

SEQ ID NO: 127698 - DNA, 671 bp, Homo sapiens
  misc_feature: GYAE6OF02F32U3.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttcgccggacagtcagagtatagctaactatttaaattgtatcagcacgtacccgggacgtcccctaagttactgtatctatgctgcacgacctaatttcgacgtaaagggtcgggtaaccctagtacgtaacggttcgaggttgggactaggtacgggtacgtcgtacgggaactagtaacgttaccaccttcctaccaacctactacgacgctacgttactacgtacctaaaccgttaggtaaacgttaagttttaacggtaaacgttacttacgttacgtaactaaacgtaagttaacgttaacggtaaacttcgtacctttacggttacgttttaccgggacggtaacgggtaaccggtaagggtagggtaacgtaacgtaaccggtaaaaacggtcggttaacggtcggtaccgtacgtaccgtaaccgttacgttacgttacggttccttacttacccg

SEQ ID NO: 127699 - DNA, 683 bp, Homo sapiens
  misc_feature: GYAE6OF02FLWYX.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtccacatctatttcgccgggcaagtcagagtattagcaacttatttaattggtatcagcacgtaccccggggaaggcccctaagttactgtagtctatgctgtcagtcctaagtttgacgtaaaggtcggggtaccctaagtcgtaaaggttcaggttcggcgaggtggtactcggtagggactaagtaacttaccgaccttcctaccacctaacttacgaacgcgtagttaccgacgacctaaacccggttaagtaacggtaacgtttttaagggaaaacgtttaccgtttaacgttacgtaacctaaaccgttaaaggtaaccggtttaaaccggtaacgtttagtaccgttacgttacggtttaccgggacgggtaaagggtaacccgtaaggggtaaggacggttaagtaaaccgtaaaacgaaccgttagggtaacggtcgtacgtacgacctagttactttaccggttcttaccgttacc

SEQ ID NO: 127700 - DNA, 844 bp, Homo sapiens
  misc_feature: GYAE6OF02HJJL7.49.64.F09.1.454.CMB.1.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccgaggtgccagatgtgacatccagatcgacccagtctccagtccgccctgtctgcatctaggacgganacgagacgtacactacgttactagtttcggaccgggtacgaagtcagtacgtagttaacgactaacttatttaaagttcggttaanacgacgaccgtaaccggtaccccgggggaactaccccgttaaggtactacggtaatacctagtcgtacgtcgaccgtataccgttaagttcgaacggtaaacgggttcggtacctacgtaacgtaacgggttccgtagtacggagtacggttacggtaacttcggggaaggaacctaaacggttaaacctttaccaacccgttaccgtttaacaaacccgttacgtaaccgtaacgggtccttaacgttaacccgtaaccggtacggtaaaacccttaagggttaaaacgttttacgggtttaaaccgaaaaggttttaacctttccggtttaaacgggtaaacctaaacggtttaaccgggttaaaacgggtttaaaccggttaacgtttaccgtaccggtttaaccgtttaacggggtttaccggggaacgggtttaaaaccgaaacgggtttaccgggggttaagaaacttaacgggtaactaaaacgggacggtttacgtaccggtacgtacacccgggttactacgttaacgtttaccggtttaccacgtttaccccc

SEQ ID NO: 127701 - DNA, 718 bp, Homo sapiens
  misc_feature: GYAE6OF02GI7QE.49.64.F09.1.454.CMB.1.raw
  modified_base (216)..(216): a, c, t, g, unknown or other
  misc_feature (216)..(216): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccggganaagtcagagtattagactaacttaatttaaattggtatacagactaacgtaaccccggggaacggtacccccttaaggttacctgtaactcttatgctgacacgtacctaatttcgactaaagggtcgggtacccagtacgaaggttcagtggactaggtggtactcgagggaactaaggtaacttccgaaccttaccgtaccgaacctaacgtaccgtaacgccgtaacgttccgtcgtaacccaaaccgttaggtaaacggttaacggtttttaaacgggaaaacgtttaccgtttaatttaccgtaaacgtaaaccgtaacggtaaacgggtttaaaccggtaaaacttttcgtaccttaacgttacggtttttaccgggacggggtaaacggtaaccggtaagggtacggtaagtaacgtaaacggtaaaacggtacgtacggtacgggtacgtaccggacctaaccgtacgttcgtttacgttaccgttacgtaccg

SEQ ID NO: 127702 - DNA, 832 bp, Homo sapiens
  misc_feature: GYAE6OF02JT7UQ.49.64.F09.1.454.CMB.1.raw
  modified_base (603)..(603): a, c, t, g, unknown or other
  misc_feature (603)..(603): n is a, c, g, or t
tcagagtcgagagacacgaccggtgctcgatttagcgcgtatacaaggggagtacgagtctcagtcaggacacagcatggacatgagggtccccgctcagcctcctggggctcctgctactctggctccgaggtgccagatgtgacatccagatcgacccagtctccatcccgccctggtctcgcacttcgtagtaaggacaaccgtaggaccgttaccacccgtattaccgtagttttccgggccccggggaacctaaaggttccgaggttaacggtaatttacggacccgtaaacctttaagttttaaagttacggtaattaccgaacgtaccgtaccggtaaccccggggaaccgtaccccccgttaaaggttaccgtacgtaacgttacctagttcggtaccgtccggacctaccgtacccgttaagttaccggtactaaacgggtccgggttacccctaagttaccgtaaccggttacacgggttccggtactagggtacggtacgttaccggtaggtaacggtacgttaaacttaccctacgtaccctttaccaaccgtacgtacgacgtccgtaagtacctacgaccgtaaaccgnggttaacgttaacggttaagaaacgtttacgtacgtttacgaactacgtaaggttaacgttaccggtaagttaccgtacgttacttaccgggttaggtaacccggggtacggtaaccgtaagggttaccggggtataacggttaaccggaaacggttaccggttaggtaccggttacggtaaccggtaccctacggttaaaccttggttaccgttacccgtgttacccc

SEQ ID NO: 127703 - DNA, 569 bp, Homo sapiens
  misc_feature: GYAE6OF02FKZWE.49.64.F09.1.454.CMB.1.raw
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (555)..(555): a, c, t, g, unknown or other
  misc_feature (555)..(555): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtccaccatctatttcggccgggcaagtcaggtagtattagactaaacttaatttaaagttggtaatcagacacgtaccccggggaagcccctaagttactgtatctatgctgcagctaatttgacgtaaggtcgggtacccatacgaggttcagtggcagtgatcgagganaagtatcactctcactntcagtcagtctgactaccgtagtaagtagttttagaaacttattaactgtaacaactaggtaacgttaacgtaacgttcgtacttacttacggtttacggcgggtaacggtacgtaagggtagtagaacgtaacgtaaaagacgttaggtcgacgttgactacgtactntcgttatctacccg

SEQ ID NO: 127704 - DNA, 745 bp, Homo sapiens
  misc_feature: GYAE6OF02HH327.49.64.F09.1.454.CMB.1.raw
  modified_base (193)..(193): a, c, t, g, unknown or other
  misc_feature (193)..(193): n is a, c, g, or t
  modified_base (485)..(485): a, c, t, g, unknown or other
  misc_feature (485)..(485): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatcccgcctgtctgcatctaggtagganacgagacgtcaccatctacgtttcggccgggtacgaagtacgaggtaggttaattaacgtactaaacttaaagttttaaagttggtataccgtacgaccgtaaccgggtaacccccggggaaaccggtaccccccgttaaaggttacctagtaactcgttaatgtcctacgacgaacgtaccctaatttacggaacgtaaacgggttcgggtaccctaagttaacggtaacggttacgacggtcggtacgtaggtaggtacgtcggtaaggaactaagtaactcacttaccncgacctacgtcgaagtacctacgtcgtacacgtaaaccgtgttaaagtttcgttaaaggtaaactttacgttagttacaacgtaaactaggttaacgttaacggttaactcgtacgttaacgttggtttacgggaccggtaaacggtacggtaagggttacggtaacgtaacggttaaacgaaaacggttacggtacgggtaacgtaccgacgttacgtaacccttaggttccgtttacgtttaccgttaccgttacccg

SEQ ID NO: 127705 - DNA, 798 bp, Homo sapiens
  misc_feature: GYAE6OF02JODNF.49.64.F09.1.454.CMB.1.raw
  modified_base (96)..(96): a, c, t, g, unknown or other
  misc_feature (96)..(96): n is a, c, g, or t
  modified_base (179)..(179): a, c, t, g, unknown or other
  misc_feature (179)..(179): n is a, c, g, or t
tcagagtcgagagacacgaccggtgctcgatttagcgcgtatacaagggggaggtcagtctcagtcaggacacagcatggacatgagggtccccgntcagctccgtggggctcctgctactctggctccgaggtgccagatgtgacatccagatgacccagtcctccatccgcctgtcngacatctgtaggagtacagagtccaccatcgtattggccggacaaggtccaaggtacgttattagactaaacttattttaaattggtaatacgtacgaccgtaacgaacccccgggggtaaggtaccccccttaaaggttacccttaagaacgttactaagttcggcctacggactacgacccttaatttacggacggtaaacggttacggggtccaaacgtacgtaaacggtttccgaacggttcgggacgtaaggtacgggtacttaccgggttaagggaaccgtaaaggttaaactttacgtacccgtttactaccgaaaccctaagttaccgaaaccggtctaacgtacccggttataacccggtaaaccgttacggggttaaaacctttaaggttttaacgggaaaacgtttaaacgttaacggttacctaaccgtaaagtaccgttaaacggttacggttaaacgttcgttaaccttaccggtttagttaccgggtaacgggttaacgggaaccgttaacggggtagtaacggtactaaacgggaaacgttaacctggggttaaccgacgtcggttacgaaccttggtaccctaggttccttaccgttaccgg

SEQ ID NO: 127706 - DNA, 615 bp, Homo sapiens
  misc_feature: GYAE6OF02IF3L9.49.64.F09.1.454.CMB.1.raw
  modified_base (188)..(188): a, c, t, g, unknown or other
  misc_feature (188)..(188): n is a, c, g, or t
  modified_base (192)..(192): a, c, t, g, unknown or other
  misc_feature (192)..(192): n is a, c, g, or t
  modified_base (320)..(320): a, c, t, g, unknown or other
  misc_feature (320)..(320): n is a, c, g, or t
  modified_base (420)..(420): a, c, t, g, unknown or other
  misc_feature (420)..(420): n is a, c, g, or t
tcagagtcgagagacacgaccggtgctcgatttagcgcgtatacaagggggagtcagtctcagtcaggacacagcatggacatgaggtccccgctcagctcctggggctcctgctactctggctccgaggtgccagatgtgacatccagatcgaccagtctccatccgccctgtctgcatctgtaggngacngagtcaaccatctagtttcggccgggtacaagtcaggtagttaattagactaaacttaatttaaaagttggtaactcagtcaacggtaccccggggaagaccccttaaagttactgactactatcgtntcgacagaccttaagttcgaacgaacggttcgggaccctagtaacgtaaggtcaggtcgactaggtcgtatcgacggacaagtaattcacgtctacactnacgagtcagtctgaactacgtaagagttaacgttagaaacttctaaggttacacaacgtacgttaacgttaacgtaacgttgaccgttagttacgttacggggaaccggtaaggaacccgtagggtagacgtaagtaaagaaacgacgtagtacgtacctaggaccaactagttcctcggttacttcctacccgg

SEQ ID NO: 127707 - DNA, 598 bp, Homo sapiens
  misc_feature: GYAE6OF02FN80I.49.64.F09.1.454.CMB.1.raw
  modified_base (236)..(236): a, c, t, g, unknown or other
  misc_feature (236)..(236): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
  modified_base (391)..(391): a, c, t, g, unknown or other
  misc_feature (391)..(391): n is a, c, g, or t
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtcctgcatctgtaggagacagagtccaccatctattcggccgggcaagtcagtagtatagntaactatttaaagttgtatcagcacgtaccccggggagcccctaagttacngatctangntgcagctaatttgactaaggtcgggtaccatacgtaaggttcaggtggctaggtgatgnggatagtaattcgactcaccacactacagtcagtcncgtactaaccgtagtaagtagtttagaaacgttacttagttacgtacgtaaactaacgtaagttaacggaacttagtaccttagttacgttttacggacgggtaacggtaaccgaaggtacggagtacgtaacgtaaaagtaaccgtacgggtacgtaccgtaggtacccgtaaccgtagttccgttacgttccttacgttaacccg

SEQ ID NO: 127708 - DNA, 751 bp, Homo sapiens
  misc_feature: GYAE6OF02G4G0D.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccactcccgccctgtctgcatctgtaggagacagacgtcaccatcgatttcggccgggacagtacagtagtatacgactaacttaatttaaagttgtactcacgcgtaccggtaaccccggggaacgtacccttaagttactagtactctagtgctcgcacgtcctagtttcgaacgtaaggtccgggtacctagtacgtacggttacgaggtacggtacgtaggtaggtacgtacggtacgggactaacgtaacttacctacctaccgtacctaccgtactacgagtaccgtacgtacgtaccgtaacgtaaccgtagtaaacggtttaacgtttaaacgggaaaccgttttacgttaagttaccgtaaccgtaaaacggtacggttaaacgttaacgggttaaaccgttcgttaaccgttacgtttaacgggtttccggggaacgggtacccgggtaaacggtaaggggtacgaacgttaaacgtaacggtaaaaaccggttacggttacggtaccgggtaacgttacccggaaccttaccggttaccgttacggtttacctttacccgtaacgttaacccccgg

SEQ ID NO: 127709 - DNA, 730 bp, Homo sapiens
  misc_feature: GYAE6OF02GAAT3.49.64.F09.1.454.CMB.1.raw
  modified_base (229)..(229): a, c, t, g, unknown or other
  misc_feature (229)..(229): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccggaggtgccagatgtgacatccagatcgacccagtcctccatcccgccctgtctgcatctggtaggagacgagacgtccaccatctagtttcggcccggganaacggtcaggtaagttattacgactaaacttatttaaagttggtatcagactaccggtaaccccgggggaacgtccccgttaagttcgtagtataccgtatcgctgacacgtactaattcggaacgtaacgggtcggggtaccctaagtaccgtaagggtttacgaggttcggacgtagggtggtacgtcggtacgggaactaagtaacttacgactcctaccactacgtacacgactacgtcgtacgaccttaacgtacggttaaagttacgttttaagggaaacgttaccttaagttacgtaaccgtaaacgttagggtaacggtttaaacgtaacggttcgtaaccgtttacggttaccgggtttcgggaaccgggttaaacggtaaccggtaaggggtacggtaacgtaagttaacccggaaaaggttaccgtaacgggttacggaccgttacggtaacgtaccttagttaccgtttacgttccttacccgtaaccg

SEQ ID NO: 127710 - DNA, 664 bp, Homo sapiens
  misc_feature: GYAE6OF02GJ1E0.49.64.F09.1.454.CMB.1.raw
  modified_base (352)..(352): a, c, t, g, unknown or other
  misc_feature (352)..(352): n is a, c, g, or t
  modified_base (409)..(409): a, c, t, g, unknown or other
  misc_feature (409)..(409): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccactcccgccctgtctgcatctgtaggagacagagtcaccatctattgccggacagtcagagtatagacaacttaattaaattggtatcagcacgtaccccggggaacgcccttaagttactgatctatgctgcagtactaatttgacgtaaaggtcgggtacctagtacgaggttacgaggtggacgnggtaggtatcggtaggaactagtaacttcgacttccacaccatacgagcctaagtcncgactaaccgtaggtaagttagtttaggaaacttagttacgttagtaaccaacgtaagggttacgttaaacggtaactttgtaacctttagttaacggttttccgggaaccgggtaacgggtaaaccgtacggggttaagggtacgaaacgttaaaccgaaaaacggttacggttacggggaaccggtaaccgttaccggtaaccgtaacccgttacggttcccgtttaccgttaccgtttacccgtaaccccgg

SEQ ID NO: 127711 - DNA, 747 bp, Homo sapiens
  misc_feature: GYAE6OF02IAZMD.49.64.F09.1.454.CMB.1.raw
  modified_base (519)..(519): a, c, t, g, unknown or other
  misc_feature (519)..(519): n is a, c, g, or t
tcagagtcgagagacacgaccggtgctcgatttagcgcgtatacaagggggagtcagtctcagtcaggacacagcatggacatgagggtccccgctcagctccgtggggctcctgctactctggctccggaggtgccagtatgtgactatccagatcgacccagtcctcatcccgcctgtctgctatcgttggaggagacaggacgtacaccgatctagttcggccggactaagtcgagtattagtacgtactaactttaatttaaagtttggtaactcgacgtacgtaaccggtaaccccgggggaacgttaccccgttaaaggtttaccgtagtacgttacttaacgttcggtactcggacctaacggttaaccgttaaagttttaccggaacgttaaaacgggggttccgggtaacccctaacgttaacggtaacggtttacgaacgggttcgacgttaaggtggtaacgttacgaacgggtataacgtaacgttctaccgtaccgttaccactanacggtaccgcgttaacgtcgtaccgaacgtaaccgttaagttaccggtttaaagtttaacgtaacgtttacttacgttagtaaccgtaagtaacggttaaacggtaacgtaacgttcgtattccgttaagggttccggacggacgtaacggtagagtaacgagtaacgaaggtacgtaggtcgtaacgacgtcgtaacctggtacccttgtttaccccgattaccccg

SEQ ID NO: 127712 - DNA, 707 bp, Homo sapiens
  misc_feature: GYAE6OF02FY0CG.49.64.F09.1.454.CMB.1.raw
  modified_base (450)..(450): a, c, t, g, unknown or other
  misc_feature (450)..(450): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagagtccaccatctaatttcgccgggacaacggtcaggagttaattaggactaaacttaatttaaagttggtatacagaccgacgttaaccccggggaaggtacccccgttaagtactacgtatcttatgcgtagacgagacctaagtttcggacgtaaacggttcgggtacccctagttacgtaacggttcgaggttacggtacgtaggtcggagtcgtagggacgtaagtaattacctaccgttacccacgtacncgtacgaacgtagtaccgtgaccgtaaccgtaacgtaacggttaagttaacggttaaacgttaacgttaacgtttacttaacgtaacgtaaagaaggtttaaaccgggttaaacgttaccgtcgttacttaccgggttacgttaccgggggaacggttaaccggtaaaggtggtaacggtagtaacgtaaacggtaacgtaagtacgggtctacgtacgaaccgttacgacgttacttacggttacctacgtacccg

SEQ ID NO: 127713 - DNA, 638 bp, Homo sapiens
  misc_feature: GYAE6OF02INWQH.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatgacccagtctccatccgccctgtctgcatctgtaggagacagatcaccatctattcggccggacaagtcagagtatagacaacttatttaaattgtatcagcgaacgtaccccggggaacgaccccgttaagttactagtatactagtcgctgaccacgtactaatttgaacgtaaggtcgggtaccagtacaacggttcagtcggacaggtggagtcgtaggactaagtaattcactacctacaccatcacgtcagtcgtacgtacctaaacgtagtaacgttagttttaaggaaactttacgttaacgttacgtactaacgtaggtaacgttaacgtaacgttgtaaccgttacgttaggttttaccgggacggggtaaccggtaacgtaagggtacggtaagacgtaaaccgtaaaaggtaaccggttagggtacgtaacgtcggaactaccgttattccgttacgttaccttactaacccg

SEQ ID NO: 127714 - DNA, 722 bp, Homo sapiens
  misc_feature: GYAE6OF02F1E5J.49.64.F09.1.454.CMB.1.raw
  modified_base (196)..(196): a, c, t, g, unknown or other
  misc_feature (196)..(196): n is a, c, g, or t
  modified_base (325)..(325): a, c, t, g, unknown or other
  misc_feature (325)..(325): n is a, c, g, or t
tcagagtcgagagacacgaccggtgctcgatttagcgcgtatacaagggggagtcagtctcagtcaggacacagcatggacatgagggtccccgctcagctcctggggcctcctgctactctcggctccgaggtcgccagatgtgacactccagatcgacccagtcctcactccgcctgtctgcatctagtagganacagacgtacacctatctattcggccggataagtcagtacgtatacgactaacttagtttaatgtatacactactacggtaacccggggaacgtaccccttaaggttactacgtattactagtcgtacncggacacgtaccgttaatttacgaacgtaaaggggtccggtaccgtaagtacggtaaggttccgtaggtacgtacggtaggttaggacgtcggtaacggtactaagtacgttacctactcctaccactacgtcgaagtccgtacgtactcgaactaaccggtagttaaacgttcgtttaaacggaaacttcgttaagttaccggtaataaacggtaagttaaccggttaaacgtaactttccgacgtttacggttacggtttacggggaccgggttaaacgggtaacgttacggggtagtaacgtaaccggtaaacggtaaacggtcgttaacggggtacgtaccgttaacggaccttaaccggttacttcggtttaacgtcccttacttaacccgg

SEQ ID NO: 127715 - DNA, 774 bp, Homo sapiens
  misc_feature: GYAE6OF02GZOE7.49.64.F09.1.454.CMB.1.raw
  modified_base (754)..(754): a, c, t, g, unknown or other
  misc_feature (754)..(754): n is a, c, g, or t
tcagagtcgagagacacgaccggtgctcgatttagcgcgtatacaagggggagtcagtctcagtcaggacacagcactggacatgagggtccccgctcagctcctggggctcctgctactctggctccgaggtcgccagactgtgacatccagatacgaccagtcctccatccgacctgtctgcatctaggtaggagacaggacgtcacctacgtctaagtttcggaccgggacaagtcgaagtaagtagttacgactaaacttaatttaaaacgttggtactacgaacgtcctaaccggtaaccccggggaacgtacccgttaagttaccgtagactactgtacgtccgtagcgacgtacgttaattacggacgtaacgggtcgggtacccctaggtaccgtaaggttacctaggtacggtacgtacgggtaagtcgtacgggttacggaacgtaacgttaaacttacccgtacgttacccgtaacgtacccgtaacgttcccgaacggtacgttaaccgtaccgtaccgggtaaaccgttaaccggttaaaggtaaacggtttaccggttaaaggttaaacgtttaacgtacgtttacgtaacctaaacgggtaaacgttagggtaaacccgttaacgttcgtacttacggttaccggttcggaacgggtaacgtaacggtaggtacgtaggtaaccgtaaaggtaaacgtcgttacggtacgacttaaccgggaccttacgtaagttaccncggttttacacgttacccgg

SEQ ID NO: 127716 - DNA, 624 bp, Homo sapiens
  misc_feature: GYAE6OF02I2SCV.49.64.F09.1.454.CMB.1.raw
  modified_base (218)..(218): a, c, t, g, unknown or other
  misc_feature (218)..(218): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtcctccatcccgccctgtctgcatctgtaggagacagagtccaccatcatttgccgggnaagtcagagtattagcaactatttaaatgtatcagcacgtaccccgggagtacccctaagttactgatctatgtctgcagcctaatttcgactaaaggtcgggtacccagtacgaacggtcctaggtcggctaggtggactcggtaggacaagtattcactctacacctatccagccagtactcgactaaccgtaggtaagttagttttaacggaaagtttacttagttacgtaactaacgtaaggttaacgttaaaccggttaacttcgtacctttacgtacggttttaccgggacgggtaaggtaacccgtaagggttcggaagtacgtaaacgtaaaacgtaacggttggtacggtacgtaccggaaccgtaccgtaagttccttaggttacctcgttacccg

SEQ ID NO: 127717 - DNA, 665 bp, Homo sapiens
  misc_feature: GYAE6OF02GRU9D.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgcctgtctgcatctgtaggagacagagtcaccatcatttcgccgggcaagtcagagtattagactaacttattaaaattggtatcagctacgtaaccccggggaaggacccctaagttacctagtactactatggctgacgacgtacctaagtttagacgtaaaggtccgggggtacccaagttaccgaagggtttaccgaagggttccgggacgtaggtagggtagtacggttaggggaactaacggtaacttaccgacgttacctacgtaaccctagtaccgagcctaaggtcctagacccaaaccgttaggtaagttacgttttaagggaaaacttcgttaacgttcggtaactaaaggtaagttaacgttaacggtaaactttcgtacgttacgttagtttaccgggacgggtaaggtaacccgagggtacgacgtagtaacgaaaggtaacgtggtacgacgtacgacaccgtatacgtcttcgtactaccg

SEQ ID NO: 127718 - DNA, 675 bp, Homo sapiens
  misc_feature: GYAE6OF02FSFBT.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatcgacccagtctccatcccgccctgtctgcatctgtaggagacagagtccaccatcatttgccgggcaagtcagagtatagactaacttaatttaaattaggtatacagcacgtaaccccggggaacggaccccttaagttactagtactctatgctgcacgactaatttagacgtaaacggtcgggtaccctaagtacgtaaggttacgtaaggtcggtacgtaggttcggtacgttacggttacgggaactaagtaacttacctacgtccttaacccaccgtataccgacgtacctaacgtccacgacctaaaccgtagtaaacggttaagtttaaggtaaacgttaacttattacgtaactaacgtaacggtaacggttaacggtaaacttacgtacttacgttaacggtttccgggaacggtaacgggtaacggtaagggtaggtacgtaacgtaacggaaaaggtacgttaggtacggtacgtacgactacccgtagtccgttacgttcttacgtccg

SEQ ID NO: 127719 - DNA, 543 bp, Homo sapiens
  misc_feature: GYAE6OF02IOX9V.49.64.F09.1.454.CMB.1.raw
tcagagtcgagagacacgaccggtgctcgatttagcgcgtatacaaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaacttatttaaattggtatcagcacgtaccccggggaagcccctaagttactgatctatgctgcagcctaatttcgacgtaaagtcgggtcccagtcaaggttcaggtggcaggtgatcgtagggacagtaacttcactctacaccatccagcagtctgaccaactgaacgtattttaggaaattactatttagacaacaggtaagttaacggaaactttgacttctagttttccgggacggtaggaaccgtaagggtgagaataacgaaagtaccgtggtcgactagcacctagtctacgttctataccg

SEQ ID NO: 127720 - DNA, 729 bp, Homo sapiens
  misc_feature: GYAE6OF02GHF1V.49.64.F09.1.454.CMB.1.raw
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtagagacagacgcaccatcatttcgccgggcaagtcagtagtattagcaacttaatttaaattggtatcagacaacgttaccccgggaagtcccgttaaaggttactgtattcctagtcgtctgacgagacccttaagtttcgacgtaaaacgggttcgggtaccccaagttaccgtaaaggtttcgaaggttacggacgtaaggtggtactacgggtacgggtaacctaaggtaaactttcctactcctacccacctaacttaccagtacctacgttacgtacccgaaccgtaaacccgttaggtaaaggtttaagttttaagggtaaaacgttaacgtttagtttaacgtaacctaaacctaagggttaaacggtttaaaccggtaaccgtttgtaaccgtttacggtttacggttttacgggacgggttaaacgggtaaccgtaaggggtacgggacgtaaacgttaaccggaaaaaggtaccgttagggttacggtaccgtaggaccaccgttaagtttcgtaccgttctttacctaaccg

SEQ ID NO: 127721 - DNA, 631 bp, Homo sapiens
  misc_feature: GYAE6OF02FHZQH.49.64.F09.1.454.CMB.1.raw
  modified_base (250)..(250): a, c, t, g, unknown or other
  misc_feature (250)..(250): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctcatccgcctgtctgcatctgtaggagacagagtccacatctattgccgggcaagtcagtagtattagactaactattaaatggtactnagtacacgtacccggggaagtccctaagtactgatctatcgctgcagtactagttgacgtaaggtcgggtacccagttacgaaggttcaggtcggactaggtgtactacggtagggaactaagtattaccaccttactacaaccgtatacgtaagcctaagttcctacggaacctaacgtaggtaaacttacgtttaagggaaacttaccgttagttaacgtaccgtaaggtaacgttaaggtttaaccgtaattaccgtacttacgttacggtttaccgggacggtaacgggaaccgtaggggtacgtacgaactaacgtaaacgtacgtaggtaccgtacgtacgaccctagttacctcggtttctacgttactacccg

SEQ ID NO: 127722 - DNA, 728 bp, Homo sapiens
  misc_feature: GYAE6OF02I0TP0.49.64.F09.1.454.CMB.1.raw
  modified_base (688)..(688): a, c, t, g, unknown or other
  misc_feature (688)..(688): n is a, c, g, or t
tcagagtcgagagacacgaccggtgctcgatttagcgcgtatacaagggggagtcagtctcagtcaggacacagcatggacatgagggtcccccgctcagctcctggggctcctgctactctggctccgaggtgccagatgtgacatccagatgacccagtctccatccgccctgtctgcatctgtaggagacgagacgtcaccatctagtttcggccgggtacaagtcgaagtagtattacgactaacttaagttttaaatttggtatcgaagtcgaacggtaccccccggggaacggtacccccgttaaagttaccgtagtaactacttagtacgcgtacggccacgtacctaagtttacgaaccgttaaacgggtcgggtaccctacgttacgtaacggttacgtacggtgggacgtaggttcggtagttacggtagggaacgtaagtaacttaccgtactccctacgaacctagtaccgaagtcccgtatctacggaacctaaacggtagtaaaggtttagttttaacggaaaccgttttattgttaaccggaactaacggtaaggttaaccggttaacgtaacttcgtacctttacggtttacggttcgggggaaccggtacgggtaaacgtagggtaggtaacgtaacgtaacggaaaacgttcggttaggtacgttaccgngttaacccacgttagttaccgtacgtttcctaccttcccg

SEQ ID NO: 127723 - DNA, 618 bp, Homo sapiens
  misc_feature: GYAE6OF02F1ZUV.49.64.F09.1.454.CMB.1.raw
  modified_base (233)..(233): a, c, t, g, unknown or other
  misc_feature (233)..(233): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgcctgtctgcatctgtaggagacagagtcaccatcagtttgccgggcaagtcagagtattacganaactattaaattggtatcagcatacccggggaaggccctaagttactgatctatgctgcagcctaatttcgactaaaggtcggggtacccagtcctaaaggttcgtagtggcgaggtggatcgtgggaactagtaacttacacctctaccacctatacagtcaagtcctgactaacccgtgaacgtagtttaaggtaaacgttaacgttaacgttgttactaaacgtagtaacggttaaaccggtaaactttagccgtttactacgtttttacccgggaacggtacggggtaaccgaacgggttaggtagaagtaacgtaaaaacggtaacgtacggtaggtaccgtaggtcaacccgtagtacgttacgttacttagttaaccg

SEQ ID NO: 127724 - DNA, 764 bp, Homo sapiens
  misc_feature: GYAE6OF02H1AOY.49.64.F09.1.454.CMB.1.raw
  modified_base (748)..(748): a, c, t, g, unknown or other
  misc_feature (748)..(748): n is a, c, g, or t
tcagagtcgagagacacgaccggtgctcgatttagcgcgtatacaagggggagtcagtctcagtcaggacacagcatggacatgaggtccccgctcagctcctgggctcctgctactctggctccgaggtgccagatgtgacatccagatcgacccagtctccatcccgccctgtctgcatctggtagagacagacgtcaccagtctagtttcggccgggtacaagtcgagtagtattagacctaacttaatttaaagttggtactacgtagtacctaaccggtaccccgggggaacgtcccccgttaaaggtttacctacggtaacttccgttagttcgaccgtggtacccgtaacgtaccttaaagtttacggaaccggtaaacgggtttccggggtaacccctaaggtaccggttaacggttacgtacgggttacggacgtagggttaggtacgtacggtacgggacgtaagttacttccgaccgttctacctaaccatacgacgacgtcgtgtacgaccgtaaacgtaggtaacgtttagtttaaacggaaactttacgtaacgtttacgtaaccgtaaagtaacggttaacggtttaaaccggtaactttcggtaaccttacgttacggttttacgggaacgggtaaccggtaaaccggtaagggtacgggtaacggtacgtaaacggaaacggttaaccgttagggacggttataccggtaccaccgttacgttaccggttntacccttagttacccg

SEQ ID NO: 127725 - DNA, 921 bp, Homo sapiens
  misc_feature: GYAE6OF02I1TUF.49.64.F09.1.454.CMB.1.raw
tcagagtcgagagacacgaccggtgctcgatttagcgcgtatacaaggggggagtcagtctcagtcaggacacagcatggacatgagggtccccgctcagctccgtggggcctcctgctactctggctccgaggtgccagatgtgacatccagatcgaccctagtcctccatcccgccctgtctgcatcgtagtaggagacagacgtcaactatactagttcggaccgggactaaggtcaaggtagttaattacgactaaacttaagttttaaagttaggtatacgtagaccgtaaccggtaaccccggggtaaccggtacccgttaaacgttacctgtaacttcgtagtcgtacgtcgacacgtacctagtttcgacgtaaacggtccgggtacctacgtacgtaacggttacgtaacggtcgggacgtagggtacgttacggtacggagggtaactacgtaacgttaccaacgtttacccgtacgtacccgacgtaccgtacgtaacgttacggttacctaaccggtaccgtaaaccgttaaaggggttaaacgttaaggttttaaacgggttaaaacgtttacccggttttaaagttcccggttaaaaccgttaaccggttaaacgggttaaacccgggtttaaaaccgggtttttaaaaccgtttcccgggttttaaaccgttacccgggtttttaaaccggggtttaaccgggggttaaaccccgggggtaaacgggggttaaacccggggtttaaacgggggtaaccgggttaaacggtaaacggttaaaccggtaaaaaacggggttaaccggttaccggggttaaaggggtaacccgttaacccggggtacctttaaacccggggttaccgttaccggtttacggtttaccccgtttacccgtttaaccccgg

SEQ ID NO: 127726 - DNA, 697 bp, Homo sapiens
  misc_feature: GYAE6OF02F46XY.49.64.F09.1.454.CMB.1.raw
  modified_base (94)..(94): a, c, t, g, unknown or other
  misc_feature (94)..(94): n is a, c, g, or t
  modified_base (118)..(118): a, c, t, g, unknown or other
  misc_feature (118)..(118): n is a, c, g, or t
  modified_base (149)..(149): a, c, t, g, unknown or other
  misc_feature (149)..(149): n is a, c, g, or t
  modified_base (631)..(631): a, c, t, g, unknown or other
  misc_feature (631)..(631): n is a, c, g, or t
tcagagtcgagagacacgaccggtgctcgatttagcgcgtatacaagggggagtcgagtctcagtcagacacagcatggacatgaggtccccgntcagctcctgggctcctgctactntggctccgaggtgccagatgtgacatccagntgacccagtcctcatccgccctgtctgcatctgtaggagacagacgtcaccatcgtatttcggaccgggacaagtccaggattagttacgactaacttaatttaaacgtggtaacttcgaagtccgaaacggtacccccggggaagtaccccctaagtttaacgtacgattaccgtagtcggtctaggcaaccgtacgtaaatttggaacgtaaaacggttcgggtaaccctaacgtcgtaaacggtttacaaacgggtggtaacctacggttagggtacttacggtacgggtaaacctagtaaaacgtttccacgtttacccaacgtacctacgttaccgacgtaacgacggttactacggtactaaaccgttagaagttaacgtttaggtaaacgtaattacttaacgtacaacgtaaggtaacgttaacggtaattagtacgtaacgttacgtttacgacggtacggtaacgtaacggngaacgtacgtagaaaacgtacgtagtacgtacgaacgttcaacctagttactcgttatacgtaccg

SEQ ID NO: 127727 - DNA, 633 bp, Homo sapiens
  misc_feature: GYAE6OF02FVMLE.49.64.F09.1.454.CMB.1.raw
  modified_base (389)..(389): a, c, t, g, unknown or other
  misc_feature (389)..(389): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcccgccctgtctgcatctgtaggagacagtagtccaaccatctatttcggccgggcaagtcagagttattagactaaacttaatttaaattggtatcaagcctaacgtaacccccggggggaacgtcccccttaaagttactgtaattccgtatggtctcggcaacgtcctaaagtttgacgtaaagggtcgggtaccccaatcgtaaaggttcgaggtcggntaggttggacttcgtggggaactagtaacttccacttccgacctacactacaagtcagtctggactacgtagaagttatttaaggaattactattacgtaacaatagtaagtttaaccgaattgtaccttacgtcgtttacgggcggaagggtaccgtaagggtgtagaagtaccgtaaaaaggtccgttacgggtacggtactacggtaccaccttacgtacgttcgttaccttcgtaacccg

SEQ ID NO: 127728 - DNA, 710 bp, Homo sapiens
  misc_feature: GYAE6OF02GO2VP.49.64.F09.1.454.CMB.1.raw
tcagagtcgagagacacgaccggtgctcgatttagcgcgtatacaaggggggagtcagtctcagtcaggacacagcatggacatgagggtccccgctcagctcctggggctcctgctactctggctccgaggtgccagatgtgacatccagatcgacccagtctccatcccgccctgtctgcatctgtaggagacagatcaccatctatttcggccggacaagtcaggagttatagacctaattaattttaaacgttggtaatacagacaaccgtaacccccgggggaacgtaccccctaaggttactagtattactatcgactcgcacgtacctagttacgacgtaaagggtcgggtacctagtacgtaagttcgaggtggacgtaggtcggtatcggtaggaacagtaacttctacctacacctacgtatacgactacgacgtcgtacgaccgtaacgtaggttaaacgttagttttaaggtaaacgtttactttacgttactaacgtaaacgtaacgggtaacgttttaaacgggaaacctttcggtaccctttagttaaccggttttaccgggaacgggtaacggtaacgtaaggggttacggtaacgttaacggtaaaccgaaacggtaacggtagggttccggtaaccgtaccggtaccgtaaccttaaccgttacgttaccggtttaccttaaccgtaccccg

SEQ ID NO: 127729 - DNA, 820 bp, Homo sapiens
  misc_feature: GYAE6OF02J2R5M.49.64.F09.1.454.CMB.1.raw
tcagagtcgagagacacgaccggtgctcgatttagcgcgtatacaagggggagtcagtctcagtcaggacacagcatggacatgagggtccccgctcagctcctgggctcctgctactctggctccgaggtgccagatgtgacatccagatcgacccagtcctccatccgcctgtctgcatctgtaggagacagacgtcacctagtctagttcggccgggactaacgtcagagtattacgacctaaacttaagtttaaacgttaggtactacgacgtaccgtaaccggtaacccccgggggtaacggtacccccttaaacggttaaccttcggaacttcggttaactcggtacgtcgaccgtacgtaccgttaattttacgacggtaaaaccgggttcggggttacccctaacgttaccgttaacgggttaccgaagggttaccgggaacgttacggtcggtaacggttccggtaagggtaacctaaaggtaccttacgacctacgtaccctacgactacgacgttaacgtacgtaccgtactaaccgtaacccgtagtaaacggttttaacgttaaacgggttaaaccttacgtttaaacgttcgtaaaccgttaaaccgtaaggtttaaaccggttaaccggttaaaccgttgttaaccccgttaggttaaccggttttaccggggaacgggtaaacccggttaaaccgggtaagggttaacggtaaaccgttacgtaaaccggttaaaaacggtcgttaacgggtaccgttacgacgttacctaacggtcctttcgtaacgtttccgtaacttcccg

SEQ ID NO: 127730 - DNA, 686 bp, Homo sapiens
  misc_feature: GYAE6OF02IZ19A.49.64.F09.1.454.CMB.1.raw
  modified_base (216)..(216): a, c, t, g, unknown or other
  misc_feature (216)..(216): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtcctccatcccgcctgtctgcatctgtaggagacagagtcaccatctattgccggnaagtcagagtatagcaactattaatgtatcagcacgtaccggagaccctagtactcgatactatcgctgactagacctaagttcgacgtaaacggtcgggtacctaagtaccgtaaagttacgaacgttggactaggtaggtactacggtggaaccagttaaacgtaccaacgttaccgaactaccgaacttacgaccggtataacggtactacgtaaccgaaccgttaaggtaaacgtttaacgtttaaaggggtaaaacttacccgggttaaatttaccggtaaacgtaaaccgtaaaggttaaacgggttaaaacgttaaaaccgttcgttaccgtttaaacggttaaccggtttcgggtaaaccggtaacggtaaaccgtaagggtaccggagttaaacgtaacgtaaaacgtaagtcggtaacgtcgtaccgaactacgttactacgtagttacctacgttaccg

SEQ ID NO: 127731 - DNA, 722 bp, Homo sapiens
  misc_feature: GYAE6OF02GOCBT.49.64.F09.1.454.CMB.1.raw
  modified_base (195)..(195): a, c, t, g, unknown or other
  misc_feature (195)..(195): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
tcagagtcgagagacacgaccggtgctcgatttagcgcgtatacaagggggagtcagtctcagtcaggacacagcatggacatgaggtccccgctcagctcctggggcctcctgctactctcggctccggaggtcgccagatgtgacatccagatcgaccagtctccatcccgccctgtactgcatctgtagganacagacgtcaacctattcctagttcggccccggataacgtcaagtacgtagttagacctaacttaattttaaacgtggtatacgacgtcaacggtaccccgggaacgtaccctaaggttacngtaactcgttagncgtgacagtaccttaattcgaacgtaacggttccgggaccctagtacggtaagtttcgaacggttggacaggttacggtacttcggtacgggaaataactaaccgttacgaccttccggtaacctacgactccggatagtaccgttacacgaccgtaacgtagtaacggtttagtttacggaaactttactacgttcaagtaaacgtacggttacgttaaacggtaccttttcgggacctttaggttacgggtttaccggggaacgtaccgggttaaaggtacgggttcggaattaacccggtaaagtaaacgggttaccgttaacgggtacgggtacctcggttaaaccgtcgttaaccggtttcccttaggttacccttaccgttacccg

SEQ ID NO: 127732 - DNA, 755 bp, Homo sapiens
  misc_feature: GYAE6OF02HTD7V.49.64.F09.1.454.CMB.1.raw
  modified_base (470)..(470): a, c, t, g, unknown or other
  misc_feature (470)..(470): n is a, c, g, or t
tcagagtcgagagacacgaccggtgctcgatttagcgcgtatacaaggggggagtcagtctcagtcaggacacagcatggacatggagggtccccgctcagctccgtggggctcctgctactctggctccgaggtgccagatgtgacatccagatagacccagtctcctatcccgacccttgctcgtcgacttcgtaggtaggacgacgagtacgtacacactctacttcgggaccgggactaacgtcgaagtagttaacgttacgtaactaactttaaacgttttaaagttaggttacactagacgtaaccggtaaccccggggtaaacgtcccttaaggttacctgacgttactacgtcgcgtacgtactacgaaccgttagttacggaaccggtaaagggttcgggtaaccaacggttaacttaggttaccgagggtacgtaacggtagttacgggtactaacgggnggtaacgtaagtacttacctacgtctaaccgaaccgtactacgacgtcgtaccgtacgtacgtaacctacggtaacggtaagtttaacgttaacggttaaacgttaacttacgttactaacgttaaacgtacgtaacggttaacgtaacgttcgtaacgttcgttacggttacgggtacgggaaggtaccgggtaaggtacgtacgtaacgttaacgaaacggtaggttacgtacggtactaccgacgtaccgttattacccggttattacccgttacgtaaccg

SEQ ID NO: 127733 - DNA, 689 bp, Homo sapiens
  misc_feature: GYAE6OF02GVAFV.49.64.F09.1.454.CMB.1.raw
  modified_base (657)..(657): a, c, t, g, unknown or other
  misc_feature (657)..(657): n is a, c, g, or t
  modified_base (668)..(668): a, c, t, g, unknown or other
  misc_feature (668)..(668): n is a, c, g, or t
  modified_base (682)..(682): a, c, t, g, unknown or other
  misc_feature (682)..(682): n is a, c, g, or t
tcagagtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatcgacccagtctccatccgcctgtctgcatctgtaggagacagagtcaccatctagtttcgccgggacaagtcgagtaagttattaagactaaaccttaattttaaaagtttggttactacagtaccaacggtacccccgggggaaacggtaccccccttaaacggtttacctagtacttcgttatcgtcgtcgacagtaccctaagtttagacgtaacgggtccggggtacccattacgtaaggttcaggtcggcgtaggttagggacttacggtacgggaacgtacgtaacttaccaccgttacctacctaaccctattacccgagaccgtagtccgtacgaccctaacgttaggtaaccgttaaggtttaacggtaaacgttaccgttattacgtactaaacggtcgttaacggttaacgtaacgttctaccgttcttagttaccgggaggtacggaacggtaggaggtacgtaacgtacgaaacgtacggttagaccggtancggtactaccngttccgtacttctntaccccg

SEQ ID NO: 127734 - DNA, 961 bp, Homo sapiens
  misc_feature: GYAE6OF02GQ4YY.49.64.F09.1.454.CMB.1.raw
tcagagtcgagagacacgaccggtgctcgatttagcgcgtatacaaggggggaggtcagtctcagtcaggaccacagcatggacatgagggtccccgctcagctcctggggctcctgctactctgctccgaggtgccagatgtgacagtccaagatgacccagtcctccactcccgtccctgtctcgcatctaggtacggacacgtagagtacaccctatcctaagtttcggcccggggtaactaaggttaccaaggtaagttaagtttaacgacctaaaactttaaattttaaaagtttggttaacttacgaacgtacgtaaaccggtaaccccccgggggaaacgtacccccgttaaacgtttaccgtacggaacttaccgttagttaccggacttacggaccgaacggtaaccttaacggttttacggaaaccggttaaaagggttacccgggggtacccccttaaagttaacccgttaaacggggtttaccgtacgggttacggaaccgtaacggttagggtacgttacggggtaaaggaaccgttaaaacgggtaactttacccgtaaaccgtttacccctaaaccgtaaccctaaccgttacccgtaaacgggacctttacggtaaccgttacgaaacccgttaaacccggtttaaggtaaacgtttaacggttttaaacggggttaaaactttaccggtttaaagttcggttaaaccgtaaacggtaaacccgggtttaaaaggttaaccggttaaaccggttttaacgtacccgttttaacgtttaacgggttttaccccggggtaaacgggtaaacggggttaaacccgtaagggggtttaacgaaccgttaaaggaaacccggttaaaagggtaaccggtaagggtaccggacgttaaccgaccgttaaaccgtaccgtttacggtaaccggtttaccctagttacccccg

SEQ ID NO: 127735 - DNA, 741 bp, Homo sapiens
  misc_feature: GYAE6OF02FINTD.49.64.F09.1.454.CMB.1.raw
tcagagtcgagagacacgaccggtgctcgatttagcgcgtatacaagggggagtcagtctcagtcaggacacagcatggacatgagggtccccgctcagctcctgggctcctgctactctggctccgaggtgccagatgtgacatccagatgacccagtctccatccgccctgtctgcatctgtaggagacagagtccaccatcagtttggccggcaagtcagagttattagcaatattaaatgtatcagcacgtacccgggagcccctaagtactgactcgtatgctgactacgacctaagttcgactaaacggtcgggtacccctagtaccgtaaacgggtttcctaacggggttcggacgtaacgggttacgggtaacgttcccggttaggggaacctaaacggttaaacgtttacccgaaccgtttacccgtaccgaacccctaacgttaccgaacgtccgtaaacgttccgtaaccggacctaaacccgttaggtaaacgttagttttaacgggaaaacgtttaccgttaaggttaccgttaactaaacggtaacggtaaacggtttaaaccgggtaaacctttcggtaacctttacgttacgttttaccggggaacggtaaacgggtaccctaagggggtactaacggtaacttaacggtaaaaacgtacgtacgggtaacggtccgtaacggaccttaaccgtaacgtttcgacgtttaccgtcgttaaccccg

SEQ ID NO: 127736 - DNA, 130 bp, Homo sapiens
  misc_feature: GYAE6OF01CO3WZ.45.87.H10.1.454.CMB.1.raw
  modified_base (130)..(130): a, c, t, g, unknown or other
  misc_feature (130)..(130): n is a, c, g, or t
tcagacgcgatcgacacgaccggtgctcgatttagcagtactgcgttgggtttgggcacagaggccctgggctgcctggtcaaggactacttcctcgatcgcgtctgagcgggctggcaaggcgcatagn

SEQ ID NO: 127737 - DNA, 573 bp, Homo sapiens
  misc_feature: GYAE6OF01DXWAR.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttagacacagtctccagccacctgtctttgttccgagggaaagacgccaccctctcctgcgacgggccagtcgagggttagttaacagtctacttacgcctaggtaaccaaaacaaaaaccgtggaccaaggcctacccaggctcatcaatctatcgacgcatacgaacgacgggccacgtggccaactcccagcctaggttcaggtggcaggtcggtcgtagggacaggtacttcactctacacatcagcagcctgacctgagtatttcgacttattactactgtacacgctacgcgtcggccgacgagccgtctcgtacgttcggacggtacggacgaagggtgagacgacgaaacgtacgtggcggtctaggacacgtactcgtcgttccttacacttccctcccgcttacg

SEQ ID NO: 127738 - DNA, 538 bp, Homo sapiens
  misc_feature: GYAE6OF01B7KKG.45.87.H10.1.454.CMB.1.raw
  modified_base (496)..(496): a, c, t, g, unknown or other
  misc_feature (496)..(496): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagatttgacgacacggccatttatttctgtgcgagagtcggccgtgcgggctacttcgactacgtggggccagggaacccaggtcaccgtctcctcacgctcccaccgaacggcccactccggtccttccccctcgccaccctccctccaacgcgacacccgtcgtggggacnccgacgccggccccgtcgggcctggccctggtccgtaaacgg

SEQ ID NO: 127739 - DNA, 679 bp, Homo sapiens
  misc_feature: GYAE6OF01BA3YR.45.87.H10.1.454.CMB.1.raw
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccgtaccggtccgctccacnctctntnagtcgtcctcgagacggacggcctagtcgactacctccgagtcgtacgttacgagggtcgggtcggggtttgggttcgacctagtacgttaccttactaccgttctaccaactactacgacgacgaccgtacccctaaccctaacgtaagtaagttttacgttcgacttacgttacttaacgtttacgtacgtaacctaacgcgttaacgtaacgaagttacggttcccggacccttacttacccgtttaccgggttaccggggacggggtaacccggtaaaccggtaaggggtacgggaacgtaacgttaaaccggaaaacggttcggttgggtacgtaccgtacgaaccctaacgttacgtttccgttcgtttacccc

SEQ ID NO: 127740 - DNA, 687 bp, Homo sapiens
  misc_feature: GYAE6OF01C41GC.45.87.H10.1.454.CMB.1.raw
  modified_base (334)..(334): a, c, t, g, unknown or other
  misc_feature (334)..(334): n is a, c, g, or t
  modified_base (675)..(675): a, c, t, g, unknown or other
  misc_feature (675)..(675): n is a, c, g, or t
tcagacgcgatcgacacgaccggtgctcgatttagcagtactgcgttgggtttggggggaggaacgtgcgtcagtttacggacccagtaggggaacctactggaagccccagcctcaggcttctcgttcctcctggacactactggctcccacgataccgaccggtagaaattgtgttgacgtacctagttctcctagtaccgaccctgtctttgtttcccaagggggtaaagagccgacccttcgtccgtggccggagggccctaggtccagggtcgggttaaccagactacttagcctggtaccaacaaaacgtgccaggctccaggctccnatccatcgatgctatcccaacagggtccctgggccgtacccgagacgaggttccgtggtcgaggtgggtactcgggaaacctggacgttcgaaccgtctacctaacgttcaggtacgccgttggacgccgtgagttgtacttttcgaccttagtttacttcgtagtcagtcagtcgttccgacctacgcccgtcttccgtacgtttccgggacgggggtaacctaggggtacggacgtaagtacggaacggaaccgtacggtcggtacggccttcgtaccgacccgtacgtccgtacggttcctttaccgtacgttccgttaccccgtaccttatttccgngttacgtcccgg

SEQ ID NO: 127741 - DNA, 139 bp, Homo sapiens
  misc_feature: GYAE6OF01D7EUW.45.87.H10.1.454.CMB.1.raw
  modified_base (130)..(139): a, c, t, g, unknown or other
  misc_feature (130)..(139): n is a, c, g, or t
tcagacgcgatcgacacgaccggtgctcgatttagcagtactgcgttgggtttgggcacagcggccctgggctgcctggtcaaggactacttcctcgatcgcgtctgagcgggctggcaaggcgcatagnnnnnnnnnn

SEQ ID NO: 127742 - DNA, 560 bp, Homo sapiens
  misc_feature: GYAE6OF01D6UYP.45.87.H10.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtnttaacagctactagcctggtaaccaaacaaaaacctggccaggctcccaggctcatcatctatgacgcatcgaacagggccactggcatcccagccaggttcagtggcagtgggtctgggacagtacttcactctcacatcagcagcctgacctgagtatttcgactattactactgtcagcagtcgtcggcgacgacgcgctctacgtttcggcggtacgggaccgaagggtaggaagtacgtaaccgaaaacggtaacgtaggtcgggtctaggaccaaccagttaccttaggttccttacaccttcccgttccccgcctaacg

SEQ ID NO: 127743 - DNA, 173 bp, Homo sapiens
  misc_feature: GYAE6OF01C5O8Y.45.87.H10.1.454.CMB.1.raw
  modified_base (173)..(173): a, c, t, g, unknown or other
  misc_feature (173)..(173): n is a, c, g, or t
tcagacgcgatcgacacgaccggtgctcgatttagcagtactgcgttgggtttgggggaagaggaagactgacggtcccccaggagttcaggtgctgggcacagcggccctgggctgcctggtcaaggactacttcctcgatcgcgtctgagcgggctggcaaggcgcatagn

SEQ ID NO: 127744 - DNA, 546 bp, Homo sapiens
  misc_feature: GYAE6OF01BED7W.45.87.H10.1.454.CMB.1.raw
  modified_base (200)..(200): a, c, t, g, unknown or other
  misc_feature (200)..(200): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
tcagacgcgatcgacacgaccggtgctcgatttagcagtactgcgttgggtttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacagggtccctggccgtcccagacaggttccgnggcagtgggtctgggacagngttcactctcaccgtcagcagcctgggacnccgtgactgtattttgctagtttacttctgtctagtctacgtcgttccgccacgccgctctacggttcgggcggggggtaccgtaggggtcggaggagtggacggtacgtacgtggtcggtcgtgcaccagtctacgtcttcatccttcccgctacg

SEQ ID NO: 127745 - DNA, 526 bp, Homo sapiens
  misc_feature: GYAE6OF01BHF1S.45.87.H10.1.454.CMB.1.raw
  modified_base (435)..(435): a, c, t, g, unknown or other
  misc_feature (435)..(435): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcagtgggtctggggacagacttcactctcaccatcagcagcctggaccctgagtattttgacctatttactactgtcagcagcgtggcgaccgngcgctcgactttcgggcggtacgggaccgaagggtggagacgtcgaaacgactaggtaggctgcaccatctgtcttcatccttcccgctac

SEQ ID NO: 127746 - DNA, 552 bp, Homo sapiens
  misc_feature: GYAE6OF01BASPQ.45.87.H10.1.454.CMB.1.raw
  modified_base (502)..(502): a, c, t, g, unknown or other
  misc_feature (502)..(502): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagatttgacgacacggccatttatttctgtgcgagagtcggccgtgcgggctacttcgactactgggccagggacccaggtcaccgtctcctcacgcctccaccaacgggcccagtccggtccttccccctcggcccacccctccctcccaacgtacgccacccgttcgtcgggggccnccgacggcccgggccccgtcggggcctcggcccttgggtcctaaaccggg

SEQ ID NO: 127747 - DNA, 501 bp, Homo sapiens
  misc_feature: GYAE6OF01E1GJX.45.87.H10.1.454.CMB.1.raw
  modified_base (200)..(200): a, c, t, g, unknown or other
  misc_feature (200)..(200): n is a, c, g, or t
  modified_base (495)..(495): a, c, t, g, unknown or other
  misc_feature (495)..(495): n is a, c, g, or t
tcagacgcgatcgacacgaccggtgctcgatttagcagtactgcgttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccggctcctcatctatgatgcttccagcagggccactggcatcccagccaggttcagtggcggtgggtttggcacagacttcactctcacaatcagcagcctcccaaccctgaagtattttgctagtccttattactgtcaacagcgtacagattggccgctcactttcggcggagggacctaagttggagatacaaacgactgtggctgacaccntctgtc

SEQ ID NO: 127748 - DNA, 629 bp, Homo sapiens
  misc_feature: GYAE6OF01D1CMD.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccgaggggaaagagcccaccctctcctgcgagggccagtcgagggttagttaacagtctacttacgcctaggtaaccaaaacaaaaaccgtggaccaggcctcccgaggctcatcatctatgacgcagtacgaacgacgggccacgtcggccactcccagccgaggttcaggtcggcgtaggtcgggtcgtaggggacaggtaccttcactctacaccatcgagcacgccgtacggaccgtggtaggtactttcgaccttaactttactacgtgtacagcgtagcgtcggaccgaccggagccgtcgtcgtaccgtttccgggacgggtacgggaaccggtaagggtacggagtaacgtacgaaacgtacgtaggtacggtcgtacgacctaccgtacgttcgttacgttcttactacttcccgttcccgtccgtacg

SEQ ID NO: 127749 - DNA, 222 bp, Homo sapiens
  misc_feature: GYAE6OF01CZ86F.45.87.H10.1.454.CMB.1.raw
  modified_base (179)..(222): a, c, t, g, unknown or other
  misc_feature (179)..(222): n is a, c, g, or t
tcagacgcgatcgacacgaccggtgctcgatttagcagtactgcgttgggtttgggggaagaggaagactgacgggtccccccaggagttcaggtgctgggcacagcggccctgggctgcctggtcaaggtactacttcctcggatcgcgtctcgagcgggctggcaaggcgcgatagnnnnnnnnnnnnnnnnnnnnnnnnnnnnnnnnnnnnnnnnnnnn

SEQ ID NO: 127750 - DNA, 532 bp, Homo sapiens
  misc_feature: GYAE6OF01CYFDM.45.87.H10.1.454.CMB.1.raw
  modified_base (435)..(435): a, c, t, g, unknown or other
  misc_feature (435)..(435): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaaccaacaaaacctggaccaggcctccaggctcatcatctatgacgcatcgaacagggccatggcatcccagccaggttcaggtggcaggtgggtctgggacagacttcacgtctcacatcagcagcctggaccctgagtatttcgcctatttactactgtacagcaggcgtggcgacgngccgctcacgtttcggcgggacggaccgagggtcggaggacgtacgaaacggaactggtacggtcgtgcacatctcgtcttcacttcctccgctacg

SEQ ID NO: 127751 - DNA, 479 bp, Homo sapiens
  misc_feature: GYAE6OF01D2EK9.45.87.H10.1.454.CMB.1.raw
  modified_base (455)..(455): a, c, t, g, unknown or other
  misc_feature (455)..(455): n is a, c, g, or t
  modified_base (466)..(466): a, c, t, g, unknown or other
  misc_feature (466)..(466): n is a, c, g, or t
  modified_base (471)..(479): a, c, t, g, unknown or other
  misc_feature (471)..(479): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgacactctggctcccagtcagggtgttaacagctacttagcctggtaaccaacaaaaacctggccaggctcccaggctcatcatctatgacgcatcgaacagggccactggcatcccagccaggttcagtggcagtgggtctgggacagagttcactctcaccgtcagcagcctgggagcctgatgtattttgctagtttactctgtcagcagcgttccgccacgccgctctacgtttcgggcggggggaccaggggtcggagagtgagacgaactggtgctgcacatctgtcttcactctcccgcctatctgatcgatcgcgtctgagcggntggcgaggcgnagtgnnnnnnnnn

SEQ ID NO: 127752 - DNA, 550 bp, Homo sapiens
  misc_feature: GYAE6OF01AENDF.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagatttgacgacacggcctatttatttctgtgcgagagtcggcgtgcggctacttcgactacgtgggccagggacccgaggtccaccgtctcctcacgcctccgaccaacgggcccacgtccggtccttcccccgtcgccctacccctccctcccaacgacgccacccgtccgtcggggccaccgacggccggccccgtcgggcctcggcccgttggtcgtaaccgg

SEQ ID NO: 127753 - DNA, 527 bp, Homo sapiens
  misc_feature: GYAE6OF01D47XU.45.87.H10.1.454.CMB.1.raw
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (518)..(518): a, c, t, g, unknown or other
  misc_feature (518)..(518): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacagggccacgtggcatcccagccaggttcagtggcagtgggtctgggacagagttcactctcaccatcagcagcctgcagtctgaagtattttgctagtttatttctgtcagtctagtatctaataactggcttagtactaggttttcggaccgtaggggaccaaggcgtaggaaactacgaaacgtactggtcggntgcaccntctgtcttnctctcccgc

SEQ ID NO: 127754 - DNA, 525 bp, Homo sapiens
  misc_feature: GYAE6OF01DZJIN.45.87.H10.1.454.CMB.1.raw
  modified_base (201)..(201): a, c, t, g, unknown or other
  misc_feature (201)..(201): n is a, c, g, or t
  modified_base (498)..(498): a, c, t, g, unknown or other
  misc_feature (498)..(498): n is a, c, g, or t
  modified_base (523)..(523): a, c, t, g, unknown or other
  misc_feature (523)..(523): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaaccaacaaaaacctggccaggctcccaggctcatcatctatgacgcatcgaacagggccactggcatcccagccaggttcagtggcagtgggtctgggacagacttcactctacacctatcagcagcctggaccctgagtatttgctatttactactgtacagcagtcgtggcgaccgagcgctcacgtttcggacggagggaccgaagggtcgagactacgaaacgactgtggcgtgacacntctgtcttctacttccttccgcctntc

SEQ ID NO: 127755 - DNA, 663 bp, Homo sapiens
  misc_feature: GYAE6OF01ACSWJ.45.87.H10.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
tcagacgcgatcgacacgaccggtgctcgatttagcagtactgcgttgggtttgggggaggaactgctcagtttaggacccagagggaaccatggaagccccagctcagcttctcttcctcctggcactctggctcccagataccaccggagaaattgtgttgacacagtctccaggcaccctgtctctgtctccaggggganaccagcccaccctctccgtgcagggccagtaggagtgtcagtaagtcttaggcttggacaacagaaacctggccaggcctacccgaggctccgtnactccatcgatgcataccaacgtcgggtccctggccgtccccagacgtacggttccgnggcctaggtcgggtctggggacaggtacgtttcacgtctccgacgtcaaggcaggccgtggacgtccgtagtatgtacgttttgacttagtttacttcgtgtcaagtcgacgtaccgttcccgaccgaccgtcccgtcgttccgtacggtttccggggaccgggggtaccgtaggggtacggacggtacgttacgggaacggtaaccggtaaaccgttgggtccgggtaccgttacggccgttaaccgtacgtttccggttacgtttacccgttaccgtaaccgtttccccgttaccccggtacccg

SEQ ID NO: 127756 - DNA, 524 bp, Homo sapiens
  misc_feature: GYAE6OF01BTKFR.45.87.H10.1.454.CMB.1.raw
  modified_base (497)..(497): a, c, t, g, unknown or other
  misc_feature (497)..(497): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggaccctgaggtatttgcctatttactactgtcagcagcgtggcgacgcgcgctctaccgtttcggcggacgggaccgaaggtggagagtacgaaacgactggtcggctgaccncactctgtcttcactccttcccgctac

SEQ ID NO: 127757 - DNA, 543 bp, Homo sapiens
  misc_feature: GYAE6OF01D8ZQB.45.87.H10.1.454.CMB.1.raw
  modified_base (309)..(309): a, c, t, g, unknown or other
  misc_feature (309)..(309): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacngggccacgtggcatcccagccaggttcagtggcaggtgggtctgggacagacttcactctcaccatcagcacgcctcggaccctgacgtattttcgcctaatttactacttgtcagcagcgtcggcgacgagcgctcgtacgttcggcgggacgggaccgagggtcggagagtacgaaacggtactggtacggctgcacacttctcgttccttctacttcccttcccgtctacg

SEQ ID NO: 127758 - DNA, 490 bp, Homo sapiens
  misc_feature: GYAE6OF01D1EQ2.45.87.H10.1.454.CMB.1.raw
  modified_base (479)..(490): a, c, t, g, unknown or other
  misc_feature (479)..(490): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggaccctgaggattttgcctatttactactgtcagcagcgtggcgacgagcgctcacgttcggcggagggaccaaggtggaagatacaaacgaacgtgtaggctgcaccatctgttctcacttccttcccgctatctgactcgactcgcgtctggagcgggcgtggcgaaggccgacagtacgnnnnnnnnnnnn

SEQ ID NO: 127759 - DNA, 894 bp, Homo sapiens
  misc_feature: GYAE6OF01DZBFB.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggagagtcatgaccaagacttgatacagcagactacgctacagaaacttccgaggaccgagtcaacctattagtgcggacacatccacgaccacgacgcctacagtggagctagaacgaacgtcctagaagtactttacggaacgaccgaccgggtacctaagtttttacttttccgtaggttcggacggtaacgggtaacggttcccggggcccggttcgggtcccgggggtacctttaaccggtttacccggtaaccgtttaacccgggttaccgggggggaacccgtaaaccgggggggtaaaaccccccggtacggggttaccccgtaacccccggtttccccgttaccccgttacccgtaacccgtacccccgttacccccgaaaccccggtaaacccggggtacccccctaacgggtttcccccgggtttaccccccgttttaccccccccggttccgggtacccccctttaacccccccgtaccccgttaacccccggtaaaacggtacccggtaaccccgttaaacccccggttcccggggttaccggggggggaacccctaaaccccggggtaaccgggggtccccccgggggtcccccccgggtttacggggggtcccccgttaccccgggttaccccgggtttaccggggggtaccccgttaaaaacccggggg

SEQ ID NO: 127760 - DNA, 130 bp, Homo sapiens
  misc_feature: GYAE6OF01BL9PI.45.87.H10.1.454.CMB.1.raw
  modified_base (130)..(130): a, c, t, g, unknown or other
  misc_feature (130)..(130): n is a, c, g, or t
tcagacgcgatcgacacgaccggtgctcgatttagcagtactgcgttgggtttgggcacagcggccctgggctgcctggtcaaggactacttactcgatcgcgtctgagcgggctggcaaggcgcatagn

SEQ ID NO: 127761 - DNA, 510 bp, Homo sapiens
  misc_feature: GYAE6OF01ELTGO.45.87.H10.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcagggccactggcatcccagccaggttcagtggcggtgggtttgcacagacttcactctcacaatcagcagcctaccaacctgaagtattttgctagttcttattactgtacaacagcgtacagattggccgtcttcacgtttcggcggagggaccgaaggtggagagtacaaacgactagtggctcgacaccatctgttacc

SEQ ID NO: 127762 - DNA, 541 bp, Homo sapiens
  misc_feature: GYAE6OF01AIN8U.45.87.H10.1.454.CMB.1.raw
  modified_base (338)..(338): a, c, t, g, unknown or other
  misc_feature (338)..(338): n is a, c, g, or t
  modified_base (388)..(388): a, c, t, g, unknown or other
  misc_feature (388)..(388): n is a, c, g, or t
  modified_base (535)..(535): a, c, t, g, unknown or other
  misc_feature (535)..(535): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatccatgatgcatccaacagggtccctggcgtcccagacaggttccgnggcagtgggtctggggacagagttcactctcaccgtcagcagcctggacncctgatgtattttcgactaactttcttctgacctaagacttgttagttttagtggtacgttcggacgaagggtacgaaggtagaaatacgaaacgtactggtgctagcactactctgtcttcactccttcccgctactctagatcgntcgtcg

SEQ ID NO: 127763 - DNA, 534 bp, Homo sapiens
  misc_feature: GYAE6OF01CJ5WP.45.87.H10.1.454.CMB.1.raw
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (468)..(468): a, c, t, g, unknown or other
  misc_feature (468)..(468): n is a, c, g, or t
  modified_base (482)..(482): a, c, t, g, unknown or other
  misc_feature (482)..(482): n is a, c, g, or t
  modified_base (498)..(498): a, c, t, g, unknown or other
  misc_feature (498)..(498): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaaacttttcctatcagctgggtgcgacaggcccctggacaagggcctgagtggatgggaagagtcatgccaagacttgatacagcagactacgctcaagaaacttccaggaccgagtcaccattatgcggacacatccacgaccacagcctanatgganctgagaagcctgagatttgacgacacggcctatttactttctgtgcgagacggtcggccggtgcgggtctacgttcgactacgtgggccgacggacccgcggtacaccgtctcctcacgcctccacgacggccacgtccgtcctcccctcgccnccctcctccacgcncctaccgtcgtgggcncgacgccgccgtcgggctgcccgtggtcgtaaccgg

SEQ ID NO: 127764 - DNA, 537 bp, Homo sapiens
  misc_feature: GYAE6OF01D6ISD.45.87.H10.1.454.CMB.1.raw
  modified_base (311)..(311): a, c, t, g, unknown or other
  misc_feature (311)..(311): n is a, c, g, or t
  modified_base (480)..(480): a, c, t, g, unknown or other
  misc_feature (480)..(480): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaacttttcctatcagctgggtgcgacaggccctggacaagggcctgagtggatgggaagagtcatgccaagacttgatacagcagactacgctcagaaattccaggaccgagtcaccattattgcggacacatccacgaccacagcctacatgganctgagaagcctgagatttgacgacacggctatttattctgtgcgagagtcggcgtgcggctacttcgactacgtgggccagggaacccaggtccaccgtcctcctcacgcctacccaccgaacggcccagtccggtccttcccccgtgcccacccctcctccaacgacnccacccgtcgtggggcacgacgccggcccgtcgggcctcgcccgtggtcgtaaccgg

SEQ ID NO: 127765 - DNA, 530 bp, Homo sapiens
  misc_feature: GYAE6OF01DLWSO.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctccaggctcatcatctatgacgcatcgaacagggccactggcactcccagccaggttcagtcggcaggtcgggtctggggacagacttcactctcaccatcagcagcctgaccctgagtatttgactatttactactgtcagcagcgtggcgacgacgcgtctcgtacgtttcggcgggaggaccgaagggtggagagtacaaacgtacgtggtgctagccacctatctgttcttacacttcctcccgctacg

SEQ ID NO: 127766 - DNA, 535 bp, Homo sapiens
  misc_feature: GYAE6OF01B1T87.45.87.H10.1.454.CMB.1.raw
  modified_base (507)..(507): a, c, t, g, unknown or other
  misc_feature (507)..(507): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctaggtaccaacaaaacctggccaggctcccaggctcatcatccatgatgcatccaacacgggtccctggccgtccagacaggttccgtggcaggtgggtctggggacagacgttcactctcaccgtcagcagcctgcaggctagaagatgtgctagtttatgctgtcagactaagttattattattacttcctcgtactttcggaccctagggaacctaaaggttgatagtacaaacgtactgtagctgccactntctgttccttcacttcctcccnctntcg

SEQ ID NO: 127767 - DNA, 554 bp, Homo sapiens
  misc_feature: GYAE6OF01AW9YQ.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggcctcccaggctcatcatctatgacgcatcgaacagggccactggcatcccagccaggttcaggtggcgaggtgggtctggggacaggactttcgactctcaccatcagcagccctggccctgaggtatttcgctactttactacttgtcagcgagcgtggccgaccggagccgcttccgtaccgtttcgggacgggtacggggaccgaagggtggacgagtacgaaacgacgtggtcggctgccaccatcgttcgtcttacacttcctccccgctacg

SEQ ID NO: 127768 - DNA, 535 bp, Homo sapiens
  misc_feature: GYAE6OF01A3XCI.45.87.H10.1.454.CMB.1.raw
  modified_base (420)..(420): a, c, t, g, unknown or other
  misc_feature (420)..(420): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagatttgacgacacgccatttatttctgtgcgagagtcggccgtgcgggctacttcgactactgggccagggacccaggtcaccgtctcctcagccnccaccaacggcccactcggtccttccccgtcgccaccctcctccaacgacgcacccgtcgtcgggggccaccgagcccggcccgtcggggcctcggcccgtggtccgtaaacggg

SEQ ID NO: 127769 - DNA, 675 bp, Homo sapiens
  misc_feature: GYAE6OF01DP4DI.45.87.H10.1.454.CMB.1.raw
  modified_base (203)..(203): a, c, t, g, unknown or other
  misc_feature (203)..(203): n is a, c, g, or t
  modified_base (417)..(417): a, c, t, g, unknown or other
  misc_feature (417)..(417): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaagngccaccctctcctgcagggccagtcagggtgttaacagctacttagcctaggtaccaaacaaaacctggaccaggctcccaggctcctcatctatggtgcatcctccgacgggcctcgtggtcgtcccccgcgtagggttcaggtggcgtaggtcggggtctgggacaggtagttccactctccacctatcagcacgcctgcagtctagaagtntttgacgttattttattagttgtctgacttaatttaataagtagtccgttcgggcccgttagggtaccgtttccgggaccccggtaaggggtacccgtaggggtttaacgaaaacttaacgtaaaccggtaacgttggttacgggacccttaggacccctaacccgttaagtttcccgttttacgggtttaccctttccgtaacccttttcccccgtttaccccccggacccttaacttcccgttaccggttaaccgg

SEQ ID NO: 127770 - DNA, 483 bp, Homo sapiens
  misc_feature: GYAE6OF01DZXZT.45.87.H10.1.454.CMB.1.raw
  modified_base (473)..(483): a, c, t, g, unknown or other
  misc_feature (473)..(483): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggaccctgaggtattttgcctatttactactgtcagcagcgtggcgacgagcgctcactttcggcggagggaccaaggtggagatcaaacgaactgtggctgcaccatctgtcttctatccttcccgcactctgatcgatcgcgttcgtgacggcgggctggcgaaggcgacagtagnnnnnnnnnnn

SEQ ID NO: 127771 - DNA, 533 bp, Homo sapiens
  misc_feature: GYAE6OF01DLG6I.45.87.H10.1.454.CMB.1.raw
  modified_base (529)..(529): a, c, t, g, unknown or other
  misc_feature (529)..(529): n is a, c, g, or t
tcagacgcgatcgacacgaccggtgctcgatttagcagtactgcgttgggtttgggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggaccctgaggtatttgcctatttactactgtcagcagcgtggcgaccgagcgctcacgtttcgggcggagggaccgaagggtggaagatacgaaacgacgtggtggcgtcgcactatcgttgttcttctacttcccttcccgcctntccg

SEQ ID NO: 127772 - DNA, 546 bp, Homo sapiens
  misc_feature: GYAE6OF01BAV45.45.87.H10.1.454.CMB.1.raw
  modified_base (201)..(201): a, c, t, g, unknown or other
  misc_feature (201)..(201): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatccatgatgcatccaacgacgggtcccctgggccgtcccagacaggttccgtggcaggtcgggtctaggggacaggtagtttcacttcgtccgaccgttcagcagccgtggacgcctgatgtatttgctacgtttacttctgtcagcagtccgttccgccacgccgctcgtacgtttcggggcgggggtaccgaggggtcggagtagtggacggtacgaagtggtcggctgacctaccatctcgttcttctaccg

SEQ ID NO: 127773 - DNA, 604 bp, Homo sapiens
  misc_feature: GYAE6OF01DLNRR.45.87.H10.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtcttgacacagtctccagccattctgtctctctctccgagggganacagcccaccctctcatgcagggccagtcagagtatagaacatacttggcctggtatacaatacaagcctggccacgggtccccgntcctcatctatgatgcttccngcgacgggccactggcactcccagcctaggttcaggtgggcggttgggtttcgacacgtacgtactttcacttctacaactatacacgcctacgtccctaccaaccgtagaaacgttacttttacgacttagttaccttaatttacgtacgttacaactacgtacgttaacgtacgtaacgttcggtccgtacttaccgtacgtttccgggacgggtaacggggtaccgtaagggtggaacgtaacgtacgaaacggtaacgtggtacggacgtacgactacctactcgttgtcc

SEQ ID NO: 127774 - DNA, 548 bp, Homo sapiens
  misc_feature: GYAE6OF01DQN6E.45.87.H10.1.454.CMB.1.raw
  modified_base (355)..(355): a, c, t, g, unknown or other
  misc_feature (355)..(355): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (545)..(545): a, c, t, g, unknown or other
  misc_feature (545)..(545): n is a, c, g, or t
tcagacgcgatcgacacgaccggtgctcgatttagcagtactgcgttgggtttgggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatacgaacacgggccactggcactcccagccaggttcaggtggcaggtggtcgnggacagacttcactctacaccatcagcacgcctcggacccgtgtagtactttgtaccttatttactactcgtacagcagcgtcggcgacgngcnctctacgttcggcggacgggaccgaaggtgagagtacgaaacgtacgtgtacggcgtcgacactactcttgttaccttcacttccttcccgtcctntcg

SEQ ID NO: 127775 - DNA, 659 bp, Homo sapiens
  misc_feature: GYAE6OF01BZ0LL.45.87.H10.1.454.CMB.1.raw
  modified_base (361)..(361): a, c, t, g, unknown or other
  misc_feature (361)..(361): n is a, c, g, or t
  modified_base (553)..(553): a, c, t, g, unknown or other
  misc_feature (553)..(553): n is a, c, g, or t
  modified_base (632)..(632): a, c, t, g, unknown or other
  misc_feature (632)..(632): n is a, c, g, or t
  modified_base (653)..(653): a, c, t, g, unknown or other
  misc_feature (653)..(653): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgctactctggctccagataccaccggaaaaattgtgttgacacagtctccaggcaccctgtctctgtctccgaggggagacacgccaccctctcctgcagggccagtaggagtgtcagtaagtacttaggctaggtaccaacgagaaacctggaccaggcctccgacggcctcctcactccatgatgcactaccgaacgacggtccctaggccgtacccgagaccgtacgggtttccgnggtaccgtagggttgggtccgtacggggacgtaggtacgtttcgaccgttccgtaccgaccgtcaacggtccgacggccgtaggaccgtcctggacttcggttatttcggcttaagtttctcgtagtcgagtcaccgttcgttacccgcgtacgtccgtctaccggtaccgggttcggggccgggggtaacnggggttacgaagtaggtaggacggtaacggtagttgggtacgtcgtcgaccgtaccgttagttccgttcgttacccttntaacccgttcccgtacccgtntaccgg

SEQ ID NO: 127776 - DNA, 726 bp, Homo sapiens
  misc_feature: GYAE6OF01CJZZP.45.87.H10.1.454.CMB.1.raw
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggccctggacaagggcctgagtggatgggaagagtcatgccaagacttgatacagcagactacgctacagtaaattccgaaggacccgagtacaacctatttattgacggacacactccacgaccacagcctanatggacgntagagaacgcctaggacgtagtttcgaacgacgaccggtaccttaattttagttttctggtggtacggtagtacggttcgggaccgtcggccggggtaccttaccgttcggtaaccgttacggtacgggggaccgaaacggggaaccccgacgggtaccgacccgttcctcccgtaccgacgtccctacccgaaccgtaaccgggcccctaacgttcccgggttaccctttacccccgtccgggtacccctaccccgttccccgtacccaaacggtaccgtaccgtaaccccgttccggttacccggggggacctaacccggtacccggggtccccgggtcccccgggttacggggtcccgttaccggtccccgggttcggggttaacccgtaaaacccgggg

SEQ ID NO: 127777 - DNA, 544 bp, Homo sapiens
  misc_feature: GYAE6OF01EQLUC.45.87.H10.1.454.CMB.1.raw
  modified_base (199)..(199): a, c, t, g, unknown or other
  misc_feature (199)..(199): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtcttgacacagtctccagccattctgtctctctctccagggganacagccaccctctcatgcagggccagtcagagtatagaacatactggctggtatcaatacaagcctggccacgggtccccgntccnatctatgatgccttcagcaggccagtggcactcccgagcctaggttcaggtcgggcgggttggttcgctacgagtacttcgacttctacgaactatctacgctacgcctacctaactagtaagtactttgactagtcttattacgtacgtacaactagacgtaacagtagtcggccgtcttacgtacgttcggacggtacggaaccgtaggtacgagacgtacgtaaacgacgtcggtagctacgcacatctgtcttac

SEQ ID NO: 127778 - DNA, 576 bp, Homo sapiens
  misc_feature: GYAE6OF01DG8TA.45.87.H10.1.454.CMB.1.raw
  modified_base (214)..(214): a, c, t, g, unknown or other
  misc_feature (214)..(214): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaanagtcatgccaagacttgatacagcagactacgctcagaattcaggaccgagtcaccatattgcggacacatccacgaccacagcctacatggagctgagaagctgagatttgacgacacggacatttatttctgtgcgagagtcggcgtgcggctacttcgactacgtgggccaagggacccgagtcacccgtctcctcacgcctacctaccgaacgggcccaacgtcccggtccttcccccgtcggtcccacccctcccttacccaacgaccgcccgtacccgttccggttccggggggaccaccggacggcccgggaccccgttcggggacctcgggtcccgtcgggtcgtaaacccggg

SEQ ID NO: 127779 - DNA, 608 bp, Homo sapiens
  misc_feature: GYAE6OF01BATMO.45.87.H10.1.454.CMB.1.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggccctggacaagggcctgagtggatgggaagngtcatgccaagacttgatacagcagactacgctcagaaattccaggaccgagtcacctattattgcggacacatcccacgaccacagcctacagtggancgtgaagaagcctagagtagtttagacgacacggtcctattttacgtttctgtcgcgaggacggttcggccggtcggcgggtaccttaccgttacggacgttaccggtcggggacccgaacggggaccctacgggtaccgtacccggtcctcccgtcgacgccctacccgaccgacggcccacgtcccgttaccctccccgtcggccctaccccgtccctaccgaacgcgcccacccgtcggtcggggcaccgacgcccggcccgtcgggcctcggccgttcggtacgtaaccgg

SEQ ID NO: 127780 - DNA, 518 bp, Homo sapiens
  misc_feature: GYAE6OF01BD3TH.45.87.H10.1.454.CMB.1.raw
  modified_base (356)..(356): a, c, t, g, unknown or other
  misc_feature (356)..(356): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
  modified_base (499)..(500): a, c, t, g, unknown or other
  misc_feature (499)..(500): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (510)..(511): a, c, t, g, unknown or other
  misc_feature (510)..(511): n is a, c, g, or t
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
tcagacgcgatcgacacgaccggtgctcgatttagcagtactgcgttggggtttgggggaggaactgctcaggttaggacccgagagggaaccatggaagccccagctcagcttctcttcctcctggcactctggctcccagtcagggtgttaacagctacttagcctggtaccaacaaaacctggccaggctccaggctcagtcatctatgacgcatcgaacagggccactggcatcccagccaggttcagtggctaggtgggtctgggacagacttacactctcaccatcagcagcctggaccctggaggtcttttcgcctatttacgtacgtgtcagctagcgtggccgacgngcgctcgtacgttcggcggacggaccaaggtgagatacgaacgtacgtgnggctgacacgntcgtgtcttctacttcctccgctatctgtctcgattcgcgtcgtggcgcgggtcgtacggacgtacggcgtacgagtacggnngngatncgcnncnngncg

SEQ ID NO: 127781 - DNA, 572 bp, Homo sapiens
  misc_feature: GYAE6OF01ANATM.45.87.H10.1.454.CMB.1.raw
  modified_base (214)..(214): a, c, t, g, unknown or other
  misc_feature (214)..(214): n is a, c, g, or t
  modified_base (312)..(312): a, c, t, g, unknown or other
  misc_feature (312)..(312): n is a, c, g, or t
  modified_base (525)..(525): a, c, t, g, unknown or other
  misc_feature (525)..(525): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggccctggacaagggcctgagtggatgggaagngtcatgccaagacttgatacagcagactacgctacagaaattccaggaccgagtcacctattattgcggacacatccacgaccacagcctacatgganctagagaacgcctagacgtagtttacgacgaccacggcctatttactttcgtgtgcgagaggtcggcgtgcgggtctacgttcgactacgtcggggccaacgggacccagggtacctaccgtctccgtcacgcctccacgacggccctacgtccggtccttccccgcgccaccccgtcctaccgaacgccgtccacccgttcgtcggggaccnccgacggccggaccccgtgggacctcgccgtgggtccgtaacccggg

SEQ ID NO: 127782 - DNA, 727 bp, Homo sapiens
  misc_feature: GYAE6OF01DABQM.45.87.H10.1.454.CMB.1.raw
  modified_base (711)..(711): a, c, t, g, unknown or other
  misc_feature (711)..(711): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccactggagaaatagtggtgacgcagtctccaggcaccctgtctgtgtctccgaggggagagagtcaccctctcctgcacggccagtcaaagtgtcgcaccggattactagcctggtaaccaacgacgaaacctgggaccaggccctacccgaggtcctacctcactccatgactcgcactacccaacgacgggtccctggccgtacccgaagtaccgtacgggttccgtggcctaggttcggggtctacggggacaggtacgtttcaacgttcctacgaccgtcacgtcgacggtccgtagggaccgtcccgttagtacgttcggttaacgttttttcggaccgtttaacgggtttttacctttccgttacggttacgtacggtccgttaacgggttccccggtttccccgacccgtacccggtacccggtccgttacccgttaccggggtttcccgggggaccggggggttaaccgagggggttacggaacggtacggtacgggaacggtacggtaacgtcgggtacggtcgttcggacctaccgtagttcccgttacgttcctttacncgtttccccgtccccg

SEQ ID NO: 127783 - DNA, 542 bp, Homo sapiens
  misc_feature: GYAE6OF01B6NV6.45.87.H10.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtnttaacagctactagcctggtaccaaacaaaaacctggccaggctcccaggctcatcatctatgacgcatcgaacagggccaactggcatcccagcccaggttcagtggcaggtgggtctgggacagacttcactctacaccatcagcagacctggaccctgagtatttcgccttattactactgtcgagcagcgtggccgaccggagcgtctccgaccgtttcgggacgggtacgggaccgaaggtcggagaagtacgaaacgaactgtaggctgcaccactcttcgtcttcatccttcccgcctac

SEQ ID NO: 127784 - DNA, 551 bp, Homo sapiens
  misc_feature: GYAE6OF01BBI76.45.87.H10.1.454.CMB.1.raw
  modified_base (306)..(306): a, c, t, g, unknown or other
  misc_feature (306)..(306): n is a, c, g, or t
  modified_base (416)..(416): a, c, t, g, unknown or other
  misc_feature (416)..(416): n is a, c, g, or t
  modified_base (469)..(469): a, c, t, g, unknown or other
  misc_feature (469)..(469): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctggagtggatgggaagagtcatgccaagacttgatacagcagactacgctcagaaattccaggaccgagtcaccattattgcggacacatccacgaccacagcctanatggagctagagacgcctgagtatttgacgacacggctattttattctgtgtcgagacgtcggccgtggcggtctacgttcgactcgtgggccaacgggacccaggtccnccgtctccgtcacgccctaccaccgacggccctacgtccggtcccttccccgnggcccacccgtccaccgaacgcgacctaccgtcggagggccacgaccgccggcccgtgggcctggcccttgggcgtaaccgg

SEQ ID NO: 127785 - DNA, 653 bp, Homo sapiens
  misc_feature: GYAE6OF01DD15L.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgttccagggaaagagccaccctctcctgcagggccagtcagggtgttaacagctacttagcctggtaccaacaaaactggccaggctccaggctcatcatctatgacgcataccgaacagggccaactggccatcccagccaggttcagtggcaggtggtctgggactagcttcaactctcacatcagccagtcccgtaggtaccctaggtacggttacgttttcggaccctttaactttaaccttacgttgttaccaacggtccgaacggtccgggtacggtacccggaaccggacggtccgtccgttaccgttaccggtttaccggggaccgggtacggggaacccgtaagggttcgggaacgtaacgtaacgaaaacggtacgtacggtacgggtacgtacggacctaccgtacgttcgttacgttaccttcgttaaccgtttcccttccccgtaccttaccg

SEQ ID NO: 127786 - DNA, 693 bp, Homo sapiens
  misc_feature: GYAE6OF01CCUO7.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctccagataccaccggagaaattgtgttgacacagtctccagccaccctgttcttttgtttccgaggggaaagacgcccaccctctcctgcagggccagtcagggtgttaacagcttacttagcctaggtaaccaaacaaaacctggaccacggcctcccaggctcatcatctatgacgcatacgaacgagggaccacgtcggctactcccagtcccgaggtttccgaggtcggacgtaggttcggggtcgtaggggactaggtaccttctacgttcctccaacctatccgagccacgtcctgctagtctaggtaagttattttgacgttaattttattagtttgtacttagtacttaagtttaataaagttacggtccgttacgggtccccgttaggggtaccccggtttcccgggacccgtaacggggtaccgtaaggggtttaacaaacgttaacccgaaaacggtacgttgggtacgggtacttcggaccctaacccgttagttacccgtttcgtttaccttacccgttacctttccccgttccccgtaccttaacgg

SEQ ID NO: 127787 - DNA, 548 bp, Homo sapiens
  misc_feature: GYAE6OF01EZFVD.45.87.H10.1.454.CMB.1.raw
  modified_base (411)..(411): a, c, t, g, unknown or other
  misc_feature (411)..(411): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaacttttcctatcagctgggtgcgacaggcccctggacaagggcctgagtggatgggaagagtcatgccaagacttgatacagcagactacgctcagaaattccaggaccgagtcaccattatgcgacacatccacgaccacagcctacatggagctagagaagcctgagtatttggaacgtacacggcctattttattcgtgtgcgagagtcggccgtgcggtctacgtcgactacgtcgggccacgggaacccnggtaccaccggtctccgccacgccctccgaccgaacgggcccacgtccggtccttccccgngcccaccctccnccaacgcgcctaccgtcggtcgggccacgcggcggcccgtcgggctcgccgttcggctaacggg

SEQ ID NO: 127788 - DNA, 532 bp, Homo sapiens
  misc_feature: GYAE6OF01EOSVW.45.87.H10.1.454.CMB.1.raw
  modified_base (364)..(364): a, c, t, g, unknown or other
  misc_feature (364)..(364): n is a, c, g, or t
  modified_base (497)..(497): a, c, t, g, unknown or other
  misc_feature (497)..(497): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgacccacagcctacatggagctgaagaagcctagagtatttgacgacacggcctattttattctgtgcgagngtcggcgtgcggctactcgactacgtgggccagggaacccaggtcaccgtctcctcacgccctccaccgaacgggcccagtccggtccttcccccgtgcccaccctcctccacgcgccaccgtcgtcggggcncgacgccggcccgtgggcctggcctggcgtaacgg

SEQ ID NO: 127789 - DNA, 550 bp, Homo sapiens
  misc_feature: GYAE6OF01CDB8O.45.87.H10.1.454.CMB.1.raw
  modified_base (298)..(298): a, c, t, g, unknown or other
  misc_feature (298)..(298): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctactagcctggtaaccaacaaaacctggccaggctcccaggctcatcatctatgacncatcgaacagggccactgcatcccagccaggttcagtggcaggtgggtctgggacagtacttcactctcaccatcagcacgccgtacggaccctgaggtatttcgactatttactacgtcgtctagcagtcgtggccgacgacgcgctcgtacgtttcgggacggacgggaccgagggtcgacgtacgtaacgaaacgtacgtcggtggcgtcgacacgtctctcgttcttcacttccttcccgctacgtcg

SEQ ID NO: 127790 - DNA, 593 bp, Homo sapiens
  misc_feature: GYAE6OF01EYF2L.45.87.H10.1.454.CMB.1.raw
tcagacgcgatcgacacgaccggtgctcgatttagcagtactgcgttgggtttggggggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggctctcatccatgatgcatccaacgacgggtccctgggccgtcccagacacggttccgtggccaggtcgggtctgggactagagttcactctcacgtcagcagccgtggacgtccgtgactgtagtttgcttagtttacttcgtgtcagcgtacgtccgttcccgccgtaccgcccgtcgtcgtaccggtttccggggccgggggtaccgtacggggtggaggtacgtaggagacggtaacgttggtcggtcgtcgaccgacgtacgtccgttgttccttcacttccttccgtttccgttccgttccccg

SEQ ID NO: 127791 - DNA, 819 bp, Homo sapiens
  misc_feature: GYAE6OF01CIHUD.45.87.H10.1.454.CMB.1.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccaggcacctgtctctgtctccgagggganacagccaccctctcctgcacgggccagtaggagtgtacagtaagtacgttaggctggtaaccaanagaaacctggaccaggcctccgaggcctcctacatccatgatcgcactaccaaacgtcgggtccctgggccgtacccaaggaccgtacggggtttcccgagggccgtaagggttcggggtacgtagggggaaccaaggtacgtttccgaaccgttccgttcccgacccgggttcacgggaccctacgggtaccccgttggggaaccggtcccgttggtaacgtttaggttaacgttttttcggaaccgtttaacggttttttaaccttccgtttacgggtttacccgtaacgggtccgttacgggtccccgggttttacccgacccccgtaaccgggtccccggtaccctttacccgggttacccgggtttttcccgggggggacccggggggggtaacccggtacggggggttacgggaacggtaaggttaacgggaacgggtaaaccgggtaacggtcgggttacgggtaccgttacgggacccgtaaccgtacgtttacccggtttacggttaccctttaccgtaccctttccccgttaccccggtacccg

SEQ ID NO: 127792 - DNA, 592 bp, Homo sapiens
  misc_feature: GYAE6OF01DOJVQ.45.87.H10.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagngccaccctctcctgcagggccagtcagggtnttaacagctacttagcctaggtaaccaacaaaacctggccaggcctccaggcncatcatctatcgacgcatcgaacgagggccacgtggcactcccgagccaggttcaggtggcgaggtgggtcgtggacagtacttcactctcacctatcagcacgccgtacggaccctggtacgttactttcgaccttaactttactacgtgtacagcgtaggtcgtaggccgaccgagccgtcgtcgtacgttcgggacggacgggaccgaagggacgaagacgtaacgaaacgtacgtgtacggcgtacgacctacctacgttccgttcgtaccgttactacttcccgttccccgcttactaccg

SEQ ID NO: 127793 - DNA, 600 bp, Homo sapiens
  misc_feature: GYAE6OF01BD5OF.45.87.H10.1.454.CMB.1.raw
  modified_base (568)..(568): a, c, t, g, unknown or other
  misc_feature (568)..(568): n is a, c, g, or t
  modified_base (576)..(576): a, c, t, g, unknown or other
  misc_feature (576)..(576): n is a, c, g, or t
  modified_base (581)..(581): a, c, t, g, unknown or other
  misc_feature (581)..(581): n is a, c, g, or t
  modified_base (585)..(585): a, c, t, g, unknown or other
  misc_feature (585)..(585): n is a, c, g, or t
  modified_base (588)..(589): a, c, t, g, unknown or other
  misc_feature (588)..(589): n is a, c, g, or t
  modified_base (593)..(593): a, c, t, g, unknown or other
  misc_feature (593)..(593): n is a, c, g, or t
  modified_base (596)..(598): a, c, t, g, unknown or other
  misc_feature (596)..(598): n is a, c, g, or t
  modified_base (600)..(600): a, c, t, g, unknown or other
  misc_feature (600)..(600): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaaccaaacaaaaacctggccaggctcccaggctcatcatctatgacgcatcgaacagggtccctggccgtcccagactaggttccgtggcaggtgggtcgtagggacaggtacgttcactctcaccgtcagcacgcctggacgcctagacttgtattttgactagttgttacttactgtacaactagttacgtcgtacctctaccgtttcgtcgtttccggacccgtagggaacctaaggtcggaactagtaaccaaacgtactggtacggctacgactacctagttcctagttccttacgtaaccttccttcccgacctagttccgtacgtactcgtacgtccgtacgtcgtacggacggtcgggtccgtagggccgtaacggccgaacgtacgttagngtactcgngtacngtcncgnngtcncannngn

SEQ ID NO: 127794 - DNA, 560 bp, Homo sapiens
  misc_feature: GYAE6OF01B244Y.45.87.H10.1.454.CMB.1.raw
  modified_base (213)..(213): a, c, t, g, unknown or other
  misc_feature (213)..(213): n is a, c, g, or t
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (520)..(520): a, c, t, g, unknown or other
  misc_feature (520)..(520): n is a, c, g, or t
  modified_base (545)..(545): a, c, t, g, unknown or other
  misc_feature (545)..(545): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggccctggacaagggcctgagtggatgggaanagtcatgaccaagacttgatacagcagactacgctcagaaatccaggaccgagtcaccattatgcgacacactccacgaccacagacctacatgganctaggagaacgctagagtattagacgacacggtctatttnttcgtgtgcgagtgtcggcgtggcggctacgttcgacgtacgtcggggaccacgggtacccagggtcccaccgtcctccnccgtacnccctacccacgaccgggaccctacgtcccggttcccttccccgtcgtccctaccctccgacctacgacctccgacccgtcggngggaccacgcgccggcccgtggccngccggtggcgtaacg

SEQ ID NO: 127795 - DNA, 753 bp, Homo sapiens
  misc_feature: GYAE6OF01CXED8.45.87.H10.1.454.CMB.1.raw
  modified_base (143)..(143): a, c, t, g, unknown or other
  misc_feature (143)..(143): n is a, c, g, or t
tcagacgcgatcgacacgaccggtgctcgatttagcagtactgcgttgggtttggggaggaactgctcagttaggacccagacggaaccatggaagccccagcgcagcttctcttcctcctgctactctggctccagaaaccnttggagaaatactgatgacgctagttccagccaccctgtctgtcgtctccgaaggggaaacacgcccaccctctcctgcgtgggccagtcaagtacgttagttacgaccaaaccgtacttacggaccgtaggtacccaagacaaacggaaaacccttcgggacccgaacgggtcccttacccccgaaagtacccttacccttacgttaacgtttttaacgttcggttttacctttaccgttaacccggaacggggtcccgtacgttacgggttaacctaccccgacgtacccgtaagggtttcaacggttcgaccgtaggtcgggtacgtaggggactaggacgtttcaacttccgactaaccgatacgaacgcaacgcctcgactacgtcgtagtaattacgtttagtactttagtttactttcgtacgtactagtactaacgttaattactaacgttaacgttggtacttacggttaacgttaacggttttcggaacggtaacgggaaccgtaacgtacgtaaggtaaaacgtaaccgaaacgtaacgtacggtacggtactacgacctacgtacttacgtacgttactacttcgttcccgttacccg

SEQ ID NO: 127796 - DNA, 753 bp, Homo sapiens
  misc_feature: GYAE6OF01CLL0L.45.87.H10.1.454.CMB.1.raw
  modified_base (178)..(178): a, c, t, g, unknown or other
  misc_feature (178)..(178): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttcgtggaggcagcttcagctaactttccatcagcgtgggtncgacgacggcccctggacgaagggcctggagtggagtgggaagagtcatcgaccaagtacttgatacagcagactacgctacaagaaacttccgaaggaaccgacgtcacctattattgacggacacactccgacgaccacacgcctacagtcggaacgcgtagaagaacgcctaggagtacgtttacgaaccggaacgtaccggaccttaattttatttaccggttgtggtacggaaggttacgggtccgggtccggtgggacccgggttccgttaaccggtttcgtaaccgttaccgggtaccgggggacccggtaaccggggtaacccggtacgggttaccccgaccgttcccgtccctaccgacccggtccctaccccggaacccggaacccgggcccctaccggttccccggtttccccttcccccggtccggtaccccctaccccgtccctaaccgaaccgtaccggtccctacccgttccgggtaccggggccctaaccggacccgggtaccccggtcccgggtccgggtaccgtcccggtaccgggtcgggtaaccgttaacccggg

SEQ ID NO: 127797 - DNA, 623 bp, Homo sapiens
  misc_feature: GYAE6OF01BTUZF.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacacggcccctggacaagggcctgagtggatgggaagagtcatgccaagacttgatacagcagactacgctacagaattccaggaccgagtcacattatgcggacacatccacaccacagcctacactggagctaggagaagccctggaagtatttagacgtacacggtcctaatttagtttctgttcggacgtagtacggtccggccggtcggcgggtcgttaccttcgtaccgtacgtcggggaccgaacggggtaacccgacggtccgtacccgtcctcctacgaccgcctacccgaccgaacggccccacgtccggttccccttccccgtcggtaccctaccccgtacccctaccctaacgaccgtaccgacccgtccgtcggggtaccacccgacggtcccggcccgtacgggccgtaccggccgttggccgtaaaccgg

SEQ ID NO: 127798 - DNA, 928 bp, Homo sapiens
  misc_feature: GYAE6OF01DBRX7.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctctggcactctggcctccagataccaccggagtaaattggtgttgacacagtctccacgcctaccctgttctttcgttaccgaagggaaagacgcccaccctctccgtgcgacggccaggtaggagttgtacgaagttaacgtacgttagggacttacggtaaccaaacgtaacggaaaacccgttcgggacccgtaacgggtccctacccggaacgggtccccttacccgttaccaacctttcccgaaagttccggaacgttacgaccgtaaaccgttaccccgtaaaaccggtccggggttacccctacgggtcccgtaccgtaacggaccgttacgggttacccggtggacggtacgggtcgggttacgacggggaactaggtaacgttcaccgttcgtaccgacccgttagacgaccacggtacccgtagggacctcccggtagtacgttacggtttaacttttcggtctttaacgttttaccttcgttacggttacgaccggttacgtaccgggttcccggttaccccgtaccccgtaccggttccccgggtacgtttaccccggttaaccggggtttcccggggggaacccgggggtaacccggtagggggttacgggaacggttaggtaccgggtaaacgggtaaccgggttaaccgggttcgggtacccgggtaacccgttaccggtaaccccgtaacggttttaacccgttccggtttacccgggtttaacctttaccccggttcccgtttttaaccccccgaccccggtttaccttaaccggtttcggtttaacccccggg

SEQ ID NO: 127799 - DNA, 611 bp, Homo sapiens
  misc_feature: GYAE6OF01C2Z9U.45.87.H10.1.454.CMB.1.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagacgcgatcgacacgaccggtgctcgatttagcagtactgcgttgggtttgggggaactgctcagttaggacccagagggaaccatggaagccccagctcagcttctcttcctcctgctactctggctcccagagacctccggagaaattgtcttgacacagtctccagccattctgtctctctctccgagggganacagcccacctctcatgcagggccagtcagagtattagaactatacgttggcctggtatcaatcaagcctggccacgggtcccgntcctcatctangatgcttcagctaggccatggcactccagcaggttcaggtggtccgggtggttcggcacgagtacgttcactctacgaactagtacacgtacacgtacctaccgaactagtaacgtacgtttcgtacgagtttacgttaattaaccgtagttaccgtaacgtaggtaccgtaacgtacgtaagttccggtacccgttacgtaccgtaccgtttccgggaccggtacgggaaccgtaacgggtacggtaacgacgtaccggtaaacgtaacgtggtaccggtacgtacggaccctacgtacttcgtgtccgtttacc

SEQ ID NO: 127800 - DNA, 619 bp, Homo sapiens
  misc_feature: GYAE6OF01BIA0P.45.87.H10.1.454.CMB.1.raw
tcagacgcgatcgacacgaccggtgctcgatttagcagtactgcgttgggtttggggggaactgctcagttaggacccagagggaaccatggaagccccagctcagcttctcttcctcctgctactctggctcccagagacctccggagaaattgtcttgacacagtctccagccattctgtctctctctccgaggggagacagcccaccctctcatgcaggccagtcagagtatagaacatactggcctggtatcaatacaagcctggccgacggtccccgctcctcatctatgatcgcttccgagcgagggccacgtcggacacgtccaggcctaggtcaggtgggcggttgggttgctacgacgtaccgttcacgtcctacaacgtacgtcacgactaccgtccctacccgtaacctacgtaacgttacgtttacgtacgtacgttactaacttacgtcgtacaacgtacgacgtacgacgtagttcggccgtacgtaccgtacgttcggacgggtacgaccgggggggtaagtacgggtacgtaacgtaccgtaaacgtaacggttcggtacgggtacgtacggtaccaccgttagtaccgttccgtcgtttacc

SEQ ID NO: 127801 - DNA, 705 bp, Homo sapiens
  misc_feature: GYAE6OF01CQRIC.45.87.H10.1.454.CMB.1.raw
  modified_base (214)..(214): a, c, t, g, unknown or other
  misc_feature (214)..(214): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaanagtcatcgccaagacttgatacagcagactacgctacaagtaaacttccaaggaccagtccaccattatgcggacacatccacgaccacacgcctaacatggagtctgacgaagcctagagatttcgaccgacacggtcctatttactttcgtggttcgacggtagacggtccgggtccgtcggccgggtacttaccgttccgacgttacccggtcggggacccgaacggggtaacccgtagggtaccctaccggttcctcccgtaccgaccgtccctacccgtaaccgaacccgggtacccctaccgttcccgggttacccctttcccccggtccgggtaccccctaccccgttacccgttacccggtaacgacccggtaccgtaaccccggtccggtaccggggggtaccctaaccggtacccgggacccgggtacccccggtacggggtcccgttacggtccccggttcgggtacccgtaaacccggg

SEQ ID NO: 127802 - DNA, 684 bp, Homo sapiens
  misc_feature: GYAE6OF01C2QVC.45.87.H10.1.454.CMB.1.raw
  modified_base (510)..(510): a, c, t, g, unknown or other
  misc_feature (510)..(510): n is a, c, g, or t
tcagacgcgatcgacacgaccggtgctcgatttagcagtactgcgttgggtttggggaggaactgctcagttaggacccagagggaaccatggaagccccagctcagcttctcttcctcctggccactctggctcccagataccacggagaaattgtgttgacacagtctccagtcccacccttgtcttttcgtttccgaaggggaaagacgccacccttctcctgcgacgggccagtcgtagggtcgttaacagtctacttagcctacggtaaccaaacaaaaccgtggaccaggcctaccaggtcctacatactatactagtacgacgctagtacgaacgacgggccactcggactactccgacgccgttacggttcacggtcggcgtaggtcgggtctagggacctagtactcactcgtacacctatacgacgtcgaaccgtccgtacggtaccctaggtacggttacttttacccggacttaacttttaacgtaacgttcgttacncggtacgacggtcggtacggccgtaccggaggtccgacttcgtaccggttcgggaccgggtacgggaccgtaagggtaggacgtacgaacgtaaaccgtacgttcggacggtccgactaccgacgttacttacccgtgtttccctacgtaccttcccgttcccgtcctaaccgg

SEQ ID NO: 127803 - DNA, 581 bp, Homo sapiens
  misc_feature: GYAE6OF01CH5I0.45.87.H10.1.454.CMB.1.raw
  modified_base (214)..(214): a, c, t, g, unknown or other
  misc_feature (214)..(214): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaanagtcatgccaagacttgatacagcagactacgctacagaaattccaaggaccgagtcaccattattgcggacacatccacgaccacagcctacatcggagctgagaacgcctagacgtatttgacgacacggtcctatttattctgtgcgagacgtcggcgtgcggtctacgttcgacgtacgtgggccacgggaccaggtccaccgtcctcctcgacgtccctaccaccgaacgggccctacgttccggtcccttcccccgcggtccctacccctcctacccgaacgaccgacctacccgtccggtcgggggaccaccgacgcccgggacccgtcgggtccgtcggcccgtggtccgtaaaccggg

SEQ ID NO: 127804 - DNA, 742 bp, Homo sapiens
  misc_feature: GYAE6OF01BFS0M.45.87.H10.1.454.CMB.1.raw
  modified_base (213)..(213): a, c, t, g, unknown or other
  misc_feature (213)..(213): n is a, c, g, or t
  modified_base (713)..(713): a, c, t, g, unknown or other
  misc_feature (713)..(713): n is a, c, g, or t
  modified_base (719)..(719): a, c, t, g, unknown or other
  misc_feature (719)..(719): n is a, c, g, or t
  modified_base (735)..(735): a, c, t, g, unknown or other
  misc_feature (735)..(735): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaaacctggccaggctcccaggctcatcatctatgacncatcgaacagggccactggcactcccagccaggttcagtggcaggtggtctgggacagacttcactctcaccatcagcacgcctcggaccctggacgtactttttcgacccttaattttaccgtacttcggtacacggtacgtacggtccggttcgggaccgaacccggtaggccgccgttaccgtaccgtttcgggaccggggtacggggtaacccgaaaggggttcgggaacgtacgttaaccgaaaaccggtaacgttcggtacgggtaccgttacgggtaccctaaccgtacgtttaccgtttacggtttcccgtttaccgttaaccgtttcccctttacccccgaccctttaagttacccggtttacggtaaccgtttaccggttaacgttcccgggtacccggttaccggttcggacggggttacccgggtaccggttaccggggtaccggtaaacgggtcccggtaacggtaaacgttacggacgttaccggngtacgngtacgtgacgtgtcgntcgtacg

SEQ ID NO: 127805 - DNA, 835 bp, Homo sapiens
  misc_feature: GYAE6OF01A7N5D.45.87.H10.1.454.CMB.1.raw
tcagacgcgatcgacacgaccggtgctcgatttagcagtactgcgttgggtttggggggaactgctcagttaggacccagagggaaccatggaagccccagctcagcttctcttcctcctgcactctggctcccagactaccgaccggagaattgtgttgacacagtcctaccacgccctacctgttcttttcgtttaccgaaggggaaacgacgacccaccctctcctgcgacggccagtcgagggttacgttaacgagtacctaacttacgccgttacggtaacccaaaaccgtaaaaaccgtcggacccaacggcccttacccgacggtacctaccaacttaccaacttacctaagtacggaacccgtactaacgtaacccgggaaaccgaaccggggtccctaacggtcggaccctaaccgtaccccgacgtcccggtaaggtttaccgacgggtcggacgttagggtacgggttcgtacgggtactaacggtccttaaccgtaccttccgtaccaaccgtacgtaccgacggaccgttaccgtccccggttacgggtaacccgtagggtaacggtttacgttttaccgtacctttaacttttaccttaaccgttcgtacgtacgtacggtacggtccggtacggacccgtaccgacgggtcctaccgttcgttaccggtttaccgggaccggggtaaccgggtaaaccggtaggggtacgggtaacgtaacgtaacggtaaacggtaacgtacggtacggtcgacggtacctacgtacgttccgttcggttaccttacccgtacgttacccttacccgtccttcgtaccg

SEQ ID NO: 127806 - DNA, 991 bp, Homo sapiens
  misc_feature: GYAE6OF01B4X4N.45.87.H10.1.454.CMB.1.raw
tcagacgcgatcgacacgaccggtgctcgatttagcagtactgcgttggggtttggggggaggaactgctcagttaggacccagagggaaccatggaacgccccagctcagcttctcttcctcctgctactctcggcctccagactaccgaccggagtaaattggtgttacgacactacgtcctccgacgccctacccgttgtttccgttttcggttaccggaaggggaaacgccgtacccctaccctcctccgtggaccggacgggtacctaggtacggtaagggttacgtaacgtacggtaccttaacgttaccggtacccgtaaccggtaaaacccaaaaaccgtaaaaccggtccgggacccgaccggtacccctacccggaagtcccttacgacttacctaacttcgtaacgtccggaaccgtaccgtaaccggtaaccggaaccggtaccgggtacccgtaccggtaccggtaccctacccgtacccggtaccggtacccgggttaaggtaccgggtagggtaccgggtaccgggttacggggttaccggggtaccggtaacgggaaccgttaacccggttaccttaacccgtacccttaccgtaacccttaacgtaccgtacccggtacggtaccccgtacccggggtacccgggttaccgggtaaccggttaggggtttacgtttaccgtttaccgttaacctttaacgttaccgttaccgtaccggtacgtaccgggtacggtaccgggtcccggtacgggacccggtaaccggttccggaccgttacccggtaacggggttaccggggtaccggggaaccggggttaaccgggtaacgggttaacgggacggttaacccggaaacgtaaccgggtaaccggtcgggtccggtaccgaacggtttcccaaccgtttccgtaccgttttccgttacccgttacccgttcgttaaccccggttacccgaccgtttcctaccggg

SEQ ID NO: 127807 - DNA, 755 bp, Homo sapiens
  misc_feature: GYAE6OF01A8CRX.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagagcctgggtcctcggtgaaggtctcctgcaaggcttctggaggcagcttcagcaactttcctatcagcgtgggtgcgacacggcccctggacaacgggcctggagtggagtggggaagtagtcagtcgaccaaggtacttgaataccgaagaccaagtaccgtacgcgtacgaaggtaaaactttccgaaggaccgtacgttaccacctaatttagtcggacggacctaactacgtacccgaacgaacccaccacggttacccacgtaacgtacggacgacgttaggaaagaacgaccgtaggtaacgttacgtttacggaaccggtaacggtaaccgggtacctttaattttaacgtttcgttagggtaccgtacggtaaaacggttccgggccgggttacggaccgggttaccttaccgtacggtaccgtacggggtccgggaccgtaacgggaacccgtaacggtccgaccgtccttcccgcgtacccgccgtaccaccgaacggccctaccgttcccggtacccttcccccggcgtaccctaccccgtccgtaccgacgtacgaccctacggtcgggtaccgggcacccggtaccgggcccgggtcgttcgggtccgtaccggtcggtccggtacgtaacggttaccccg

SEQ ID NO: 127808 - DNA, 747 bp, Homo sapiens
  misc_feature: GYAE6OF01AWFW1.45.87.H10.1.454.CMB.1.raw
  modified_base (730)..(730): a, c, t, g, unknown or other
  misc_feature (730)..(730): n is a, c, g, or t
tcagacgcgatcgacacgaccggtgctcgatttagcagtactgcgttgggtttggggaggaactgctcagttaggacccagagggaaccatggaagccccagctcagcttctcttcctcctgctactctggctcccagagacctccggagaaattgtcttgacacagtcctccagcctattctgtctctctctacgagggacacacgccaccctctacatcgcgacggccagtcgagtagtattaagaactatacgtggctaggtatacaataacgacgtccgtcggaccgtacggggtccccgtcctccgtactacgtactatcgtacgtcgtccttaccgacggaccgacgggtcctacgtcgggacctaaccgtcccgaacgtccgtaacggttcgaacgggttcggggtacgggtttcgggttacggacgtaacgtacggttaccttaccgtaaccttacgtaacctaaccgtaactcccgaacgtacccgtaaccgttaccccgtaacccgtaaacgttaaggttaaacgtttacgtttaccggacgttaacggtttaccttaaacgtttacgtacgttaactaacgtaaccggtacttaaccgtaggttaccgttccggccgttaccttcggtaccgggttacgggacgggtaacggtaccgtagggtacgaacgtacgtaaaccgtaacggacgttcggaacgtccggtaacgcctaaccgtnttccccgttgtaacccg

SEQ ID NO: 127809 - DNA, 684 bp, Homo sapiens
  misc_feature: GYAE6OF01BYNOR.45.87.H10.1.454.CMB.1.raw
  modified_base (200)..(200): a, c, t, g, unknown or other
  misc_feature (200)..(200): n is a, c, g, or t
  modified_base (368)..(368): a, c, t, g, unknown or other
  misc_feature (368)..(368): n is a, c, g, or t
  modified_base (423)..(423): a, c, t, g, unknown or other
  misc_feature (423)..(423): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccaggcaccctgtctctgtctccgagggganacagcccaccctctcctgcgagggccaggtaggagtgtcaagtaagtacgttaggctaggtaccaacacgaaacctggccaggcctcccgaggtcctcctacactccagtgatgacactaccaacgtacggggtccctcggccgtacccagaccgtacgggtttccgnggcgtaggtcggggtacgtcggggaacaggtacgttcacttccgtaccacccgtnacgcgacgccctagggacgtccgtagtagttagttacgttttcgacgttaagttttaccttcgttacggttccgaacgtccgtaccggtcccgttaccccgacccgtacccgtcccgtaccgttccgttaaccgggtttcccgggggaccggggggtaccgtaggggtcggaaggtacgtacggacggtacgtacggtggtcggcgtcggactacctacgttcgttacgttccttacgtaccttccccttccgcccttacg

SEQ ID NO: 127810 - DNA, 585 bp, Homo sapiens
  misc_feature: GYAE6OF01BKIRN.45.87.H10.1.454.CMB.1.raw
  modified_base (215)..(215): a, c, t, g, unknown or other
  misc_feature (215)..(215): n is a, c, g, or t
  modified_base (333)..(333): a, c, t, g, unknown or other
  misc_feature (333)..(333): n is a, c, g, or t
  modified_base (476)..(476): a, c, t, g, unknown or other
  misc_feature (476)..(476): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (553)..(553): a, c, t, g, unknown or other
  misc_feature (553)..(553): n is a, c, g, or t
  modified_base (573)..(573): a, c, t, g, unknown or other
  misc_feature (573)..(573): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaggcttctggaggcagcttcagtcaactttcctatcagctgggtgcgacaggcccctggacaagggcctgaggtggatgggaanagtcatgccaagtacttgatacagcagactacgctacaagtaaattccgaaggaccgagtccaacgtattacttaggcgaccacacgtacccaccgaaccacacgacctacagtgganactaggaacgagcctagagtacttcgacggaacgacggtccttaagttttactttcgtagtgcggaggtcggtcggacggtcggcggtccttacgtcgtacgtacggcgggtacgacgggaccgtgtaccgtaccgtctcccncacgccctaccgacgacgcctcgtccggtccctcccgtcnccnccctacnccgacnccncgtaccgtcggtggaccncggacgccggcccgtggtcngcgtgtcgaccg

SEQ ID NO: 127811 - DNA, 677 bp, Homo sapiens
  misc_feature: GYAE6OF01BRF7Y.45.87.H10.1.454.CMB.1.raw
  modified_base (222)..(222): a, c, t, g, unknown or other
  misc_feature (222)..(222): n is a, c, g, or t
  modified_base (656)..(657): a, c, t, g, unknown or other
  misc_feature (656)..(657): n is a, c, g, or t
  modified_base (662)..(662): a, c, t, g, unknown or other
  misc_feature (662)..(662): n is a, c, g, or t
  modified_base (669)..(674): a, c, t, g, unknown or other
  misc_feature (669)..(674): n is a, c, g, or t
  modified_base (676)..(676): a, c, t, g, unknown or other
  misc_feature (676)..(676): n is a, c, g, or t
tcagacgcgatcgacacgaccggtgctcgatttagcagtactgcgttgggtttgggggaggaactgctcagttaggacccagagggaaccatggaacgccccagctcagcttctcttcctcctggcactctggctcccagtcagggtgttaacagctacttagcctggtaccaacaaaacctggccaggctcccaggctcatcatctatgacgcatcgaacngggccactggcatcccagccaggttcagtggcaggtggtctgggacagacttcactctcaccatcagcagcctggaccctggacggtattttcgacctattttaccacttcgtcacgtctaggccggtggaccggaccgagccgtactccgtaaccggtttcggggaccgggaacggggacccgtaaagggtcgggaacgtacgtaaccgtaaacgggtacgttacgggtacggtcgtaccgtacctaaccgtacgttacgtttcggttaccttttaccgttaccgtttaccccgtttcccccgtacccttacgtttacccgtacggttacgttaacccggtacggttcccggtaccggttccggttaccggggtacggtcccggggggtaccttagggggaaccgtaaccggggccgtacgtacggttacggnngtcgngtcacgnnnnnngng

SEQ ID NO: 127812 - DNA, 608 bp, Homo sapiens
  misc_feature: GYAE6OF01EFYGV.45.87.H10.1.454.CMB.1.raw
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagacgcgatcgacacgaccggtgctcgatttagcagtactgcggttggggtttggggggaggaactgctcagttaggacccagagggaaccatggaagccccagctcagcttctcttcctcctggcactctggctcccagataccacggagaattgtgttgacacagtctccagccacctgtcttgtttccaggggaaagagccaccctctctgcacggccagtcagggtgttaacagctacttacgcctaggtaccaaacaaaaacctggaccaggcctcccgaggtctcatcatctagtcgacgcctagtacgaacgagggaccactggacacgtcccagccaaggttcagtggcagtgggtctgggacagtcgttcatctcacatcaagacncgccnggacctgtaccgtatttcgacctatttactactgtaccagctacggtccgtacggcgtaaccgcgcgtccaccgtacgtttcgggacggggtaaggtaacccggaaggtcgggacgtaacgtacgaaaaccggttacgaggtacggtcgtacgtccgaaccacgttaccgacgtttccccagtacccttccgttccccgctaaccg

SEQ ID NO: 127813 - DNA, 784 bp, Homo sapiens
  misc_feature: GYAE6OF01DKKLP.45.87.H10.1.454.CMB.1.raw
  modified_base (147)..(147): a, c, t, g, unknown or other
  misc_feature (147)..(147): n is a, c, g, or t
  modified_base (162)..(162): a, c, t, g, unknown or other
  misc_feature (162)..(162): n is a, c, g, or t
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagacgcgatcgacacgaccggtgctcgatttagcagtactgcgttgggtttggggaggaactgctcagttaggacccagagggaaccatggaagccccagctcagcttctcttcctcctgcactctgctccagataccaccgganaaattgtgttgacanagtctccagccaccctgttctttgttaccgaaggggaaanagccctacccgtctcctgcagggccagtcgagggttgttaacngtctacgttacgcctggtaaccaaacgaaaacctggaccacggcctccaggctcatcatctatgacgtcatcgaacacggccacgtggccagtcccacgtccgtaacgttcgaacggtggacgtaggtcggggtacgtggggtaaactacgtaacccgttcgaacccttcccgtaacgtaacctactaacgtaacgtcccaaccggtcccgttaccgggtaacccttacgggtacggttaccgttttcggaaccctttaacgttttaacccttaacgttcggtacctaacggtaccgaagggtccgggtaccggtacccggtaacccggacgtcccgtaccgttaacgtaccgggttttacccggggacgggtaacgggaacccgggtaagggtaacgggtaacgtaaacggttaacccggtaaacggtaaccggttacggttacggacccgttacggaacccgttacccgtactttccggtacccgttttaccggttaccgttaccgttttccccgtacccccgttccgttaacccgg

SEQ ID NO: 127814 - DNA, 717 bp, Homo sapiens
  misc_feature: GYAE6OF01BQUYW.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttcgtggaggcagcttcagcaactttcctatcagctgggtgcgacacggccctggacgaggcctggagtggagtgggaagagtcatgaccaagacttagactacagcagacgtaccgctacgaagtaaacttaccgaacggaccgacggtaccaactaactttagttcggacggtaccaacctactacccaaccgaccaccgacgaccctacagtaggacgtactacggaacgaacgtacgtaggtagtagtttacggacgtaacgaccgggtactttaacgtttacgtttcgtggtggtacggtaggtacggtccggtccgggtcgggtccggtacttacgttaccggtcgttacggtaccgggaccggaacgggacccgtacggtcctacccggttcctaccgtccgtaccgaccctaccgaccggaaccggtacccgtacgttccccggttcccttcccccggtaccgtcccgtacccccgtacctaccgaacgccgtacccgtccgtacgggtccgggaccgaccgtaccgggcccgtccggtccggacgtccggtcggtccgtaccgtaaacccgg

SEQ ID NO: 127815 - DNA, 782 bp, Homo sapiens
  misc_feature: GYAE6OF01EDCJE.45.87.H10.1.454.CMB.1.raw
  modified_base (415)..(415): a, c, t, g, unknown or other
  misc_feature (415)..(415): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagatacccaccggagaattgtgttgacacagtctccagccaccctgtctttgttccaggggaaatacgccctaccctctcccgtgacgacggtccagtccgaggggtcttaaacacggtacttaccgttagcctaggtaacccaaaacgtaaaaaccgtggaccacggcctacccggaggtcctacaactcgtaacttctagtcggaacgtcgaactcggaaaccgtcgggacctaacgtcggactaccgtcccaaggtcccgaagggttcaggtcggngtacggtggtcgtaggactagtacttacgcgtcctacctaactatccaacggtcacgtccgtacggaccgtaggtacggtacgtttactacgttaatttaaccgttacgtcgtacgtacgcgtagtccggtcggaccgtaaccgtacggcgtaccgttacgtaaccgggtttccggacggggtaaccgggtaaccggttaaacgggtacgggtaacggtaaccgtaaaccgggtaaaaccggtaccgggtacgggttaacccgggttaccgtaccggtaaacctaaccccggtacgtttacccgggttacgtttacccgtttaacccggtaccttttccccggttaacccggtaaccttaacccggg

SEQ ID NO: 127816 - DNA, 698 bp, Homo sapiens
  misc_feature: GYAE6OF01CNOR0.45.87.H10.1.454.CMB.1.raw
  modified_base (178)..(178): a, c, t, g, unknown or other
  misc_feature (178)..(178): n is a, c, g, or t
  modified_base (213)..(213): a, c, t, g, unknown or other
  misc_feature (213)..(213): n is a, c, g, or t
  modified_base (326)..(326): a, c, t, g, unknown or other
  misc_feature (326)..(326): n is a, c, g, or t
  modified_base (621)..(621): a, c, t, g, unknown or other
  misc_feature (621)..(621): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagctaacttttccatcagcgtgggtncgacacggccctggacaaggcctgagtggatgganagtcatgcaagactgatacagcagactacgctacaagtaaacgttccgaaggtaccgagtccaacctatttatcgcggacacactaccacgaccacacgcctaacagtcgganacgtagaagaacgaccgtagaacgtacgtttagaacccgactaccgggtaccttagttttactttcgtgtacgcggtaagtaggtccgggcgtgggtccgggtaccttacgttaccggtacgttacggtacggggaccggtaaaccgggaaccccgtacggtacccgtacccgttccgtacccgtaccgtaccgtcccttaaccccgaaaccggtacccggtaaccctccggttacccgggttccccttcccccggtaacgtccccgtaaccccttccccgaccgaacggtaccnccgtaccccggttcgggcggacgtacccgaccggtcccggacccgtcgggtcttccggacccgttggcccgtaacgg

SEQ ID NO: 127817 - DNA, 618 bp, Homo sapiens
  misc_feature: GYAE6OF01CMIEW.45.87.H10.1.454.CMB.1.raw
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (610)..(614): a, c, t, g, unknown or other
  misc_feature (610)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaaccaaacaaaaacctggccaggctccaggctcatcatctatcgacgcagtcgaaacgcgggccacgtcggacactcccagccgtaggttccaggtcggcgaggttgggtcgtaggggacacgtacttcactctcacctactcacgacacgtccgtacgggaccctggtaagttacttttcgaccgttaacttttaccgtactggtccgaggcaggtcggtcggaccgacggagccgtctcgtacgttcgggacggacggagacggtgaagactacgaacgtaacgtgtacggctagtaccctacagttcctgttccttactaccgttcctacccgacctatccgtagtcgtaccgtacgtccgtacgttggcggggacggtccgggtcggttaaccggggacggtaaacgggccgagtaacgggtcggatcggacngngcnnnnngngn

SEQ ID NO: 127818 - DNA, 692 bp, Homo sapiens
  misc_feature: GYAE6OF01APY0W.45.87.H10.1.454.CMB.1.raw
  modified_base (198)..(198): a, c, t, g, unknown or other
  misc_feature (198)..(198): n is a, c, g, or t
tcagacgcgatcgacacgaccggtgctcgatttagcagtactgcgttgggtttgggggaactgctcagttaggacccagagggaaccatggaagccccagctcagcttctcttcctcctggcactctggctcccagataccaccggagaaattgtgttgacacagtctccagccaccctgtctttgttccaggggaangccaccctctcctgcgaggccagtcagggtgttaacagcttactagccgtagtaaccaaacaaaacctggaccgaggcctacccgaggcctacatcactactatgaccgcaacgtaccgaacgtcgggaccaacgtcggaccactacccgacgccgtaggttcgaggtcggcgtaggtcggggtacgtacgggactacgtacgttcactccgtaccaccgtactaccgacggtctaccggtacccgtacggtacccgtaggtacgttacgtttacgtaccgtttaacttttactaccgttacgtacgtaacgtccgacgggtccggtcggtaccgaccggtcgccgtaccgttccgtacgggtttacccgggacgggtaacgggtaccgtaggggtacgaacgacgtaacgaaacgtacgtacggtacgtacgtcgtaccgacgtcgttaccgtcgttacctactaccgttacccgtacccgtccgtaacgtcg

SEQ ID NO: 127819 - DNA, 690 bp, Homo sapiens
  misc_feature: GYAE6OF01CYK5R.45.87.H10.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
  modified_base (629)..(629): a, c, t, g, unknown or other
  misc_feature (629)..(629): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccaggcaccctgtctctgtctccgagggganacagcccaccctctcctgcagggccaggtaggagtgtcagttaagtactaggctggtaccaanacgaaacctggaccaggcctcccgaggtcctcctacactccgattcgatcgactactacccaacgtaccgggtccctgggccctacccgagtaccgtacggtttcccggnggcgaggttcgggtctaggggacagtacgttcaacctcgtaccaccgtnacgacctacggtcccgtaggaccgtcctaggtactttaggtacttttcgacgtttacgttttcctcgttgtcgtacgccgtacgtcccgttcccgacccgtaccgtcccgtccgttacgttaccggggtttcccggggggaccgggggttacccgtagggggtagtacggtacgtacgggacgttaaccggacgttcgggtacgngtaccggaccctacgtaccgttccgttgttacccttaccttacttccccgttcccgtaacg

SEQ ID NO: 127820 - DNA, 785 bp, Homo sapiens
  misc_feature: GYAE6OF01CJVDX.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagccgtgggtcctcggtgaaggtctcctgcgaaggtcttcgtggaggcagtcttcagctaaccttttcctatcgagtcgtgggtcgacgacgacggccccgtaggacgaagggccgtggagtggagtagggaagagtcatcgacaagtactgatacgacgacagtacctacgtctaacgaagtaaactccgaacggaccgtactacctactagttacgtcgacgtacacactaccgacgacctaacgacgtactacgagtaggtacactaggaacgacgtacgtagttacgtacgttaacggaaccgacggtaaccgtacttttaacgtttttacgttccgttagtacggcggttaacggtccgggttcccgggtccggttcgggtacccggttacgttaaccggttaccggtaccgggttacccggtaccggggaaccgaaacccggtacccggtacggttccccgtaccgttacccgtcccgtaccgacccgtacccgtaaccccgtacggaaccccgtaccgttcccgtacccccgggtttccccgtcccccgtaacccggtccccttacccgtaccgtacccgacggtccctaccggtccgttccgggggcgtaccgacccggcccggtcccggcccgggtacgttccggtccggtaccgttacggtccgttaacccgg

SEQ ID NO: 127821 - DNA, 875 bp, Homo sapiens
  misc_feature: GYAE6OF01ECKHM.45.87.H10.1.454.CMB.1.raw
  modified_base (866)..(866): a, c, t, g, unknown or other
  misc_feature (866)..(866): n is a, c, g, or t
tcagacgcgatcgacacgaccggtgctcgatttagcagtactgcgttggggtttgggggggaactgctcagttaggacccagagggaaccatggaagccccagctcagcttctcttcctcctggcactctggcctcccagactaccaccggagtaaattgtgttgacacagtcctccacgccctacccttgtttccttttcggtttacccgaagggggtaaacgcgaccctacccttcctccgtcgcgacgggccagtcgtagggttagttaacagtacttacttacgccgtacggtaaccaaaaccgaaaaccgtcggaccacggtccctacccgacggtcctacgtacttacctaattcctaacgtcggaaccgtacctaacggtacccgaaaccggaccggggtaccctacggttaccgggaccttaacccgtacccggtaccggtacccgttaagggtttaccgtacgggttcgggacggttacggggttccggggtacggttacggggaacctacggttacccgttacctaccgttccgtaaccacccgtacttccggacgtaccgtacccggttcccgtaccgggtaaccgtgggttaacgtttaccgttttcgtaacctttacgttttacccgttcgttaacgtacgtacgggtcgttaccgggtcgggttacccgggaccgtacccgggacgtcccgttaccgttaaccggttacccgggttaccggggaccgggtaaccgggtaacgacggggttacgaacggtaacctaacggaaccgtacggttacggacggtccgtacgtaacccacttacgttccgtaccttaccgtttacctaccttaccccgttcccttanccgttacgg

SEQ ID NO: 127822 - DNA, 846 bp, Homo sapiens
  misc_feature: GYAE6OF01CV6DW.45.87.H10.1.454.CMB.1.raw
  modified_base (204)..(204): a, c, t, g, unknown or other
  misc_feature (204)..(204): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggcctccagataccaccggaagtaaattgtgttgacacagtctccagccacctgttctttgttccgaggggaaancgcccaccctctcctcgcgacgggcctaggtcgtaagggtcttaaacagtccttaacgttacgccgtaacggtaacccaaaaacgtaaaaccgtgggaccaaggtccctaccgaggccttaacactacaacttctataccggacgtactaacgttaccggaaaccgacggggaccctaacggttcgggacctaaccgtccccggtaagtaccccgttaagggttaccaaggggttccgggaacgttggggttaccgggggtacgtacggggaaccgtaacgtacccgtttaccgaaaccctttccgtaacccgtaaacccctagttacccgaaacggtccgtaacccgggtacccgtcgggtaaaccccgtacgggtacgtttaccgttttaccgtaccgtttaacttttaaccgtcgttacggtaccttaaggaccgtacgggtccggtacggacccggaacccggtcgtaccggtaccgttaccgttaccgggtttccggggaaccgggtacgggaaaccggttagggacggtaacgtaacgttaaaccggaaacgtacggtacggtacggtaccgtacgaccctaacgtccgttcgttacgttacccttactacctttaccccgttcccgtaccttacg

SEQ ID NO: 127823 - DNA, 855 bp, Homo sapiens
  misc_feature: GYAE6OF01D1M2I.45.87.H10.1.454.CMB.1.raw
  modified_base (204)..(204): a, c, t, g, unknown or other
  misc_feature (204)..(204): n is a, c, g, or t
  modified_base (842)..(842): a, c, t, g, unknown or other
  misc_feature (842)..(842): n is a, c, g, or t
tcagacgcgatcgacacgaccggtgctcgatttagcagtactgcggttgggtttgggggaggaactgctcagttaggacccagagggaaccatggaagccccagctcagcttctcttcctcctgctactctggctccagactaaccgaaccggaaaaattgtgttgacacagtctccgagcacctgtctctgtctcgagggganacgacgcccacctctccgtgcgacgggccaggtaggagtgtcgaagttaagtacgtaggtcgtaggtaaccgtaacgaacggaaaccgtcgggaccgacgggtccctaccccgacgggtcccttaccctaccgtaaccttaccgtacgttacggtaacgttaccggaacctaaccggttaaaccccgtaaacccggggtaacccgggggtttccccccgtaacgggggttccccggttacccccggtaaaccgggtaacccggggttaaccggggtttaccccgggtaccggggtaccggttacggggttcgggggtttaccggaccggggtaacggtaacggttacggtttacccgtaaccgttccgttacccgtacccggtacgaacgtccgtaccggtccggtaggtaccgttcgtaagtacgttagtttacgtttcgtactttacgttttcctgtaccgtgacgtcgtaccggtcccgtccgaccgtacgtcccggtctccgggttcgggttcccggggggacgggggtacggtaggggacggtagtacgggtcggaaaacgtcggtaacgtgggtcgggtaacctcggaacccttacgtcgttacgttcgttaccttacttacccggttcccncccggttctaacg

SEQ ID NO: 127824 - DNA, 852 bp, Homo sapiens
  misc_feature: GYAE6OF01A79ZS.45.87.H10.1.454.CMB.1.raw
  modified_base (204)..(204): a, c, t, g, unknown or other
  misc_feature (204)..(204): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggataaattgtgttagacacagtctccagccacctgtctttgttccgaaggggtaaancgcctacccgtctcctgacgacgggtccagtacgagggttcttaaacgacgtacttaacgtacgccgtaacggtaaccaaaacgaaaaccgtcggacctaggtaccctaccgaggcctataactctactctacgtcgaccgactacgacgaaacgacgggcccaacgtcggaccacgtcccgacgtccgtaaggtctaggtcggacgtaggtcgggtacgtacggggaaacacggttaaccttctacgttccctaacgaacctacgaccgtacggacctaccggtacccgttaccggtacccgttaaggtaccgggtttaactttttacccggtaacccttttaaaccgttttaacccgggttaaaccttttccgggtaaccgtaacccgggtacgggttacccggggttaaccgggtttcccggggtaacccggaacccgggtaacgtcccggttaccccgttacgggttaaccccgggttttacgggacccggggggtaaaccggttaaccggaacggggttcggaaaccggtaacgttaaaccgggtaaaacgtccggggttacgtcgggtaacctcggtaacctaaccgtaccgttcctacggttaccctttactacccggtttaccttcccggacccgttacg

SEQ ID NO: 127825 - DNA, 736 bp, Homo sapiens
  misc_feature: GYAE6OF01E3FEL.45.87.H10.1.454.CMB.1.raw
  modified_base (712)..(712): a, c, t, g, unknown or other
  misc_feature (712)..(712): n is a, c, g, or t
  modified_base (715)..(715): a, c, t, g, unknown or other
  misc_feature (715)..(715): n is a, c, g, or t
  modified_base (719)..(721): a, c, t, g, unknown or other
  misc_feature (719)..(721): n is a, c, g, or t
  modified_base (725)..(725): a, c, t, g, unknown or other
  misc_feature (725)..(725): n is a, c, g, or t
  modified_base (728)..(728): a, c, t, g, unknown or other
  misc_feature (728)..(728): n is a, c, g, or t
  modified_base (730)..(732): a, c, t, g, unknown or other
  misc_feature (730)..(732): n is a, c, g, or t
  modified_base (734)..(736): a, c, t, g, unknown or other
  misc_feature (734)..(736): n is a, c, g, or t
tcagacgcgatcgacacgaccggtgctcgatttagcagtactgcgttggggtttgggggaggaactgctcagttaggacccagagggaaccatggaacgccccagctcagcttctcttcctcctgcactctggctcccagtcagggtgttaacagcttacttacgcctcggtaaccaaacaaaaacctggccaggcctcccaggcctcatcatctatcgacgctactaccgaaccggtacggggttccccgtagggcccttacccgaggtaaccgtacggggtttcccggtgggaccgtaggggttcggggtcgtaggggaaccagggtacgttccactccgtcacccgtcagccacgccgttagggacctccgtagtacgttagttacttttcgacgttaaggttatttaacgtttttactaccgttaactaaacgttaaggttaacgttacccggttaccctttcccgttacccgtttttaccggtcccggttttacccggacccggtttaaccggggtaaaccttaaaggtaccggaacttaaaccgtaaaccggaaaaaccgtcgggtttacgacgggtcctacgtacccgaccttacttcgtttaccttcgttaccttccgttaccctcccctacgtactcgtacgtaccttcgtacgttccgtaccgtgtcggcggtccgggcgtacggacgtacggcgtacgtangtngtgnnngctncgngnnncnnn

SEQ ID NO: 127826 - DNA, 981 bp, Homo sapiens
  misc_feature: GYAE6OF01CG7XX.45.87.H10.1.454.CMB.1.raw
  modified_base (141)..(141): a, c, t, g, unknown or other
  misc_feature (141)..(141): n is a, c, g, or t
  modified_base (223)..(223): a, c, t, g, unknown or other
  misc_feature (223)..(223): n is a, c, g, or t
tcagacgcgatcgacacgaccggtgctcgatttagcagtactgcgtgggtttgggtgcccaagctgctggagggcacggtcaccacgctgctgaggtgaagagcctgggtcctcggtgaaggtctcctgcaaggtcttcgnggaggcagtcttcagtcctaactttccatcagcgtgggtcgccgacacggccctaggacgacggctggagtggatgggaagngtcagtcgaccaagtcttagatacgagcaagtactacgtctacaagtaacgtccgaaggtacctacgtacctaactagttactcggacggtaacaactactacccgaacacccacgaccgtacctaacgtaggtacgacggacgtaggaaaggacgtcgttagggaacgtttacgttacgggaaaacccgtcggtaaccggtttaaccgtttaacttttttacggtttaaccgttacggggtaacgtcccgggttaaagggtaccggggttcccgggtaaccggggtttccgggtacccggggttacccggtttaacccggtttaccgggtaaaccggttacccggggttacgggggaaacccggtaacgggtaaccccggtacggttaccccggtacccggttacccgttaccccgttaccaacccgggttccccgtaaacccccggaaacccgggtaaccccgggttaccccgtaacccgggttttccccccggttacccccggttttaaccccccccggtacgggttaaccccccccctacccccggtttaaccccgttaaaccccgggaaaaccggttccccgggtaaacccccgttacccgggtttaaccggggggtaaccccgggggtaacccccgaaccggggaacccccggggtttccccccggggttaccccgggttacgggggttacccccggttacccgggtaacccccgggtttaccgggggttaaacccggttaaacccccgggg

SEQ ID NO: 127827 - DNA, 1010 bp, Homo sapiens
  misc_feature: GYAE6OF01EUXUP.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggccctggacaggcctgagtggagtgggaagtgtcagtgaccgaagtcttagataccgagcaacgactacgctacaagaaacttccgaaggaacccgtagtccaaccctagtttacgttagaccggtaacaaccacgttaccccaaaccggaaccccaaccaaccggaccccttaaacgagtttacggggaacgtccgttaaggaaacggtaacggtacccttaggtaaacggtttaacgttttacggaaaacccggtaacccggaaccgggtttaccccttttaaagtttttacgttttacccggttagggtttacggaaccgggttacgggttaacggggttcccggggttcccggtttcggggccccgggtttaccgtttaacccgtttacccggtaaccggtttaccccggggttaccgggggaaccccggtaaaccgggggtaaaccccccgtacggggttaccccctaccccggtttaccccgttcccccgttacccgaacccggttcccccgtaaccccgaacccgggtaaccccggggtacccccgttacccggtttaccccggtttccccccgtttaacccccccggttccggtacccccgtttaccccccccgttacccgttaaccccggtaaacccggtacccgggtaaacccccgttaccccggttacccgggggtttacccggggggaaccccccgtaaccgggaccccgggttacccccccgggggcccccgggggtttccggggtacccccgggttttaccccggggtcccccgggtttaacccgggggttaaccccgttaaaaaccccggggg

SEQ ID NO: 127828 - DNA, 649 bp, Homo sapiens
  misc_feature: GYAE6OF01ESEXF.45.87.H10.1.454.CMB.1.raw
  modified_base (289)..(289): a, c, t, g, unknown or other
  misc_feature (289)..(289): n is a, c, g, or t
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
tcagacgcgatcgacacgaccggtgctcgatttagcagtactgcgttgggtttggggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaaacaaaaacctggccaggctcccaggcncatcatctatgacgtcatcgaacagggccaactggcatcccagccaggttnagtggacaggtgggtctgggacagactcactctcaccatcancagcctggaccctgaggttatttcggtacctactttaactactagttacgagtcaaggtcggtacggccgtaaccggacgccgtcctaccgtaccgtttccgggaccggggtaacggggaacccgtaaaggggtcggaacggtaacgtaaccgtaaaaccggaaaccggttcggttacggggtccgttaggaccgtaacccgtaagttcccgttaccggttacctttaccgtaaccgtttaccctttccccccgaccgttaacccgg

SEQ ID NO: 127829 - DNA, 872 bp, Homo sapiens
  misc_feature: GYAE6OF01DTRHV.45.87.H10.1.454.CMB.1.raw
tcagacgcgatcgacacgaccggtgctcgatttagcagtactgcgttggggtttggggaggaactgctcagttaggacccagagggaaccatggaacgccccagctcagcttctccttcctctgcactctggctccagactaccacggataattgtgttagacacacgtcctaccacgccctacccttgttcctttcggttaccgaaggggaaacgtacgccctacccttccttccgaggacgtacgggacctaggtcggtagggttacgtaacagtaccttaacgtacgtaccgttaccggtaaaccaaaaccgaaaaccggttcggaaccgtaccggtacccgtaccgacggtctacgtactcgtacctattacgacgtacactaacgtacggaaccggtaccgccgtacgcgtaccctaccgacccgacggtaccgttacggttagacggttacgggaggttacggttacggggtaccgggtaacgggtaaccttacggtaccttacctaacccgtttccaactaacccgtagtaacccgactaccgggtccgtaacccggttaccgggttaccggttacggttaacggtttacctttaacccggtaccttttaaatttaccggtacgtttacgacggtaacgtacgggttaccgggtacgggtacccggccggtaaccggacgttacccgtaaccggtttaccgggtacggttacccggggaacggggtaaacccgggtttaacgggaagggttacccgaaaggttaaaccgagggttaaacccgtggttacgggaccgtacctacggacctaccttacggttccctctttacccggttactacccgtacccttacccgtcggttacc

SEQ ID NO: 127830 - DNA, 722 bp, Homo sapiens
  misc_feature: GYAE6OF01EY7O1.45.87.H10.1.454.CMB.1.raw
  modified_base (204)..(204): a, c, t, g, unknown or other
  misc_feature (204)..(204): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (713)..(713): a, c, t, g, unknown or other
  misc_feature (713)..(713): n is a, c, g, or t
tcagacgcgatcgacacgaccggtgctcgatttagcagtactgcgttgggtttggggaggaactgctcagttaggacccagagggaaccatggaagccccagctcagcttctcttcctcctgcactctggctccagataccaccggagtaattgtgttgacacagtctccagccacctgttcttttcgttaccgaaggggaaancgcctaccctcctccgtgccgtacgggccagtcgtagggttagttaacacgtacttactacgcctacggtaaccaaaacgtaaaaccgtcggaccgacggaccctaccgacggtcctacactactactctagtcgaacgtcaacgtaccggaacgacgggacccacgtcggcctaccgtacccacggacccgtaggttcgaacggtcggcgtagggtcggtcgtacgggactacgtacttcacgtccncaacnctcagcccagtcccgtacggaccgtggtacgttcgtttacgacctttatttaacgtcgttgactacgtcgtaccggtcgtcggaccggacgacgccgtacgtccgttaaccggtacgggaaccgggtaaccgggtaacgaagggtacggtaacgtaacgtaaacccggtaacggtacgttcggggacgtaccgtagtaacccgtacgttacttaccgtttcttaacccgttctacccccgtttcccgttaccccgngtttacccg

SEQ ID NO: 127831 - DNA, 696 bp, Homo sapiens
  misc_feature: GYAE6OF01CVL9O.45.87.H10.1.454.CMB.1.raw
  modified_base (162)..(162): a, c, t, g, unknown or other
  misc_feature (162)..(162): n is a, c, g, or t
  modified_base (263)..(263): a, c, t, g, unknown or other
  misc_feature (263)..(263): n is a, c, g, or t
  modified_base (470)..(470): a, c, t, g, unknown or other
  misc_feature (470)..(470): n is a, c, g, or t
tcagacgcgatcgacacgaccggtgctcgatttagcagtactgcgttgggtttggggcatcacataacaaccagattcctcctctaaagaagcccctgggagcacagctcatcaccatggactggacctggaggttcctctttgtggtggcagcagctacgnggtctccagtcccaggtccagctggtgacaagtcgtggggctggaggtagaagacgtcgtgggtccgtggtagacgtcctccgtgacgtaaggtcttacgnggagtcacgtctacgacgtactaactttcatacgacgtcggtggagtaccgaccggtaccgcccgtagaaccgaacggtccgtaggacgtaggagtacgggaagtgtacgacgtacgaaccgtaagtacgtagactaacgacgacacggtactaacggtctaacgaaacgtactaccgacggtaccgtacgactacgtagtttacgngacgactacgtaccaaccgacctaacgccgaacgtactaccgaggacgaaccgtgtaacgaacgacgtaccgtaggtaacgttagttaccggaaccggtaccgtaaccgttaacgtttacttttacgtaccggttagtaaaccggtcggtaaacgggttccgggtccggtacccgggttggacccccgggtttataacccgggttccggtaaccggtacccggggg

SEQ ID NO: 127832 - DNA, 777 bp, Homo sapiens
  misc_feature: GYAE6OF01A9GMX.45.87.H10.1.454.CMB.1.raw
  modified_base (265)..(265): a, c, t, g, unknown or other
  misc_feature (265)..(265): n is a, c, g, or t
tcagacgcgatcgacacgaccggtgctcgatttagcagtactgcgttgggtttgggggcatcacataaacaaccagattcctcctctaaagaagccccctgggagcacagctcatcaccatggactggacctggaggttcctctttgtggtggcagcagctacgaggtgtccagtcccaggtcccagctggtgcaagtctggggctggaggtagaagagccgtgggtcctcgggtgaacggtcctccgtgacgaacggtcttcgngggagcagtcttcagcctaactttcctatacagtcgtgggtcgcgtaccgaccgggtccctaggaaccggaacgggtcccgtaggtagggtacgggtaagggtacggggtaaaggacgttacgagtaccgaccgaaacggtacgttagaactaacgagtccgaaagtaaccgtcgtacctaacgtaaacgtaaacgtttacccggaaacgggtacccgtacgttaacctaacccgtttagttacgttacgggaacccggaacaaccgaaccgttacccgaacccgaacccacgtaaccgtaccctaagtaacgtcggaaccgttcgtaacggaaccggtaccgtacccgggtagttaaacggttacgtttaaaccgggaacccgggtaaccggtacccgttaaccttttaagttttaccgtttacgttcggtacgtacggggtaacggttccgggtccggtccgggtacgggtaccggttacccttacggttccggtaaccgggttacgggg

SEQ ID NO: 127833 - DNA, 695 bp, Homo sapiens
  misc_feature: GYAE6OF01ETU1T.45.87.H10.1.454.CMB.1.raw
  modified_base (660)..(660): a, c, t, g, unknown or other
  misc_feature (660)..(660): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (685)..(687): a, c, t, g, unknown or other
  misc_feature (685)..(687): n is a, c, g, or t
  modified_base (691)..(695): a, c, t, g, unknown or other
  misc_feature (691)..(695): n is a, c, g, or t
tcagacgcgatcgacacgaccggtgctcgatttagcagtactgcgttgggtttgggggaggaactgctcagttaggacccagagggaaccatggaacgccccagctcagcttctcttcctcctgcactctggcctcccagtcgagggttattaacagtctacttacgccgtaggtaacccaaaactaaaaaaccgtggacccaaggtcctacccgaggtcctcaatccatctagtcgaccgctataccggaacgacgggccacgtgcctactcccagccgtaggtcgaggtgacgtaggtcggtacgtagggactacgtacttcaactcgtaaccacgtatacgagacctcgtccgtacgggtaaccgtggtaaggttttacttttacgaacctttaattttacctacgttcgtaacgacgttccgacggtccggttaccgggaaccgtaacccggaaggtcccgttaccgtaccggttaccgggtttacggggaccgggaaacgggtaaccgaaggggttacgaaagtaaccgaaacggtaacgtacgtagtacggctacggacctacctagtcttacgtccttacctccgttccctaccgcctaatcgtcgcgttaacgacctccggacttccggtagaccggtcggtacggaacggnggtaaccgctagaacgtntgntcgnnntcannnnn

SEQ ID NO: 127834 - DNA, 791 bp, Homo sapiens
  misc_feature: GYAE6OF01DBAN1.45.87.H10.1.454.CMB.1.raw
  modified_base (141)..(141): a, c, t, g, unknown or other
  misc_feature (141)..(141): n is a, c, g, or t
  modified_base (451)..(451): a, c, t, g, unknown or other
  misc_feature (451)..(451): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttcgnggagcagcttcagcctaactttccatcagtcgtgggtgcgacgacggcccctggaaccgaagggcctggaggtgggagtaggggaacagtcagtcgaccaagtacttgactaacgagacacgtacctacggctacgaacgtaaacttccgaacggaccgtagtaccaacctaagttacgtcggaccgaactactactacccgaaccgacctaaccgacgcccgtaagacgttacggacgtacgtagaacggaacgtccgtagtagttacgttacggaacgaccgtaacggtctttaagttttcgtttcgnggttcgacggtaggtacggtcgggccggtggtacccggtctttaaccgtcggaaccgttacgggtaccgggtaccggaaaccgggtacccgtacgggtccccgtaacccggttccctcccgtaccgaccgaccccgtacccgtaaccggacccgggtacccctacggtttccccgggtaccccgttacccccggtccgtaacccccgttacccctccgtaaccccgaaggtaccccgtaccgtaacccggttccgggaaccggggtaccaccgggtaaccgggccccgggtacccggtacggggtcccttaccgggtacccggtgtaccggtaaacccgg

SEQ ID NO: 127835 - DNA, 972 bp, Homo sapiens
  misc_feature: GYAE6OF01DFV8F.45.87.H10.1.454.CMB.1.raw
  modified_base (140)..(140): a, c, t, g, unknown or other
  misc_feature (140)..(140): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttcnggaggcagcttcagctaactttcctatcagcgtgggtgccgacgacggcccctagggaaccgaacgggtcctaggaggttagggaagtaggggaaagtaggtcaagtcgaaccgaaagtactttaggaaacttacgaacgacgtaaaggaccttaaaccggccttaacgaaacggtaaaaccgtttcccgaaacggggtaacccgtaacggttaccctaaacccgttaagtttaaacgttcggaaccggaaccaactaacgtaccccaacggaaacccaacaccgtaacctaactaggtacgggaacgtccgtaaaggaacggaacgtacccggttaagggaacgttttaacggttacgggaaaacccgtaaccgtaccccggggtttaacctttaagttttttaaccgtttcggttaaaggtcggtaaaccgggtaacggttacgggttcccggggttacgggttcgggtacccgggtttaaccgtttaacccggttaccggtaaccggtttacccgggtaaccgggggtaacccggtaaacccggggtaaaccccggtaccgggttaccccgtaccccggttacccgttacccgttaaccggtccccgtacccgtaaccccggaaccccggtaaaccgggtaccccttaccggttccccgggtttacccccttacccccggtaccgggtacccccctaccccgttaccctacccggaaccgtaccgtcccgtaacccggtcgggtacccggggacctaccgggacccggtcccggaccccgggttacggccggttaccgtacccgggttacggtaaccggtaaacccggg

SEQ ID NO: 127836 - DNA, 752 bp, Homo sapiens
  misc_feature: GYAE6OF01ACIXG.45.87.H10.1.454.CMB.1.raw
  modified_base (207)..(207): a, c, t, g, unknown or other
  misc_feature (207)..(207): n is a, c, g, or t
  modified_base (251)..(251): a, c, t, g, unknown or other
  misc_feature (251)..(251): n is a, c, g, or t
tcagacgcgatcgacacgaccggtgctcgatttagcagtactgcgttgggtttgggggaactgctcagttaggacccagagggaaccatggaacgccccagctcagcttctcttcctctggcactctggctcccagactaccaccggagaatttgtgttgacacagtctccagcctaccctgttctttcgtttccgaaggggtaacncgcccaccctctccgtgcgacggtccaggtcgagggtgttaacngtcttacgttacgccgtaggtaaccaaaacgtaaaccgtggaccacggcctcccgagtcctacatacagtctacgtgaccgctactacgaacgcgggccacgtcggtaccaccgtcccgaacgtccgtacgggtttacgtacgggtcggtaccgtacggggttcggggtacgtacggggtaccaccgggttaactttcccgaccgtttacctacccgtaactacgtcccagggtccaacggtcccgttacgggaaccgtggtacgttacgttcgtacgtttactttacgtcgtacgtacgtacgtccgtacggtcggtacggtccggaccgccggtccgtaccgttacgtaccgggtttaccgggcggggtaacgggaccgtaaggggttcgtaacggtacgtaaccggtaacgtaacgttcggtacggtcgtccgaccgtacgttcgttacgttacccggttcttacctacccgttacccgttacccgtcgttcgttacg

SEQ ID NO: 127837 - DNA, 704 bp, Homo sapiens
  misc_feature: GYAE6OF01AETXD.45.87.H10.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
  modified_base (551)..(551): a, c, t, g, unknown or other
  misc_feature (551)..(551): n is a, c, g, or t
  modified_base (682)..(682): a, c, t, g, unknown or other
  misc_feature (682)..(682): n is a, c, g, or t
tcagacgcgatcgacacgaccggtgctcgatttagcagtactgcgttgggtttgggaggaactgctcagttaggacccagagggaaccatggaagccccagctcagcttcctcttcctcctggcactctggctcccagataccaccgganaaattgtgttgacacagtctccaggccaccctgtctctgtcctccgagggganaccacgcccaccctctcctgcagggccagtaggngtgtcagtaagtctaggctaggtaaccaacaaaacgtcggcacggcctacccaggctcagtcagttctaancgacgactaacgtaccgaaacgcgggccacgtacggcaccgtcccgacgtaccgacggtttaccagggttcggaccgtagggttcggggtacgtacgggggtacaaccgttaccttaccgtacctcccttacgacccaagtccgagtaccgacgtcccgaccgtaccgtgtaacgtcgttttacacctttaatttacctaccgttgacgtaacgacctagggtccggacgggacctacggtanacccgtcttaccggttaccgggttcgggacccgggtaacggacgtaacgggtacggacgtaaaccgtacgggtaaaccttaccgggtggaacggtccctaacgaccgtaaccccgtattacccccggtttnttacccgttccgttccctcccg

SEQ ID NO: 127838 - DNA, 740 bp, Homo sapiens
  misc_feature: GYAE6OF01BQ92K.45.87.H10.1.454.CMB.1.raw
  modified_base (367)..(367): a, c, t, g, unknown or other
  misc_feature (367)..(367): n is a, c, g, or t
tcagacgcgatcgacacgaccggtgctcgatttagcagtactgcgttgggtttggggaggaactgctcagttaggacccagagggaaccatggaagccccagctcagcttctcttcctcctgctactctgctcccagataccaccggaaaattgtgttgacacagtctccaggcaccctgtctctgtctccgagggagacagccaccctctcctgcagggccaggtaggagtgtcagtaagtacttaggcttaggtaccaaacgacgaaaccctggaccacggcctacccgaggcctcctcactccatcgatcgactactccaacgtacgggtccctaggccgtacccagacgtacgggtttccggnggtcgagggttcggggtacgtggggaactagggtacgttaccaccttccgtaccgtacccgtgaacggtccgaacggtcccggtagggaccgtaccgtagtagttaggttacttttacggtacgtttaacggttttacctttcgtacgttacgtacggtactaccggtcccgttcccgaccgtacccgtcccggtcctccggttaccgggtttccgggggaccggggggtaaccgtacgggggtacggtaacgggacgtacggaacggtaaccgggttacgtacgggtacggtaccgttaggaccccgtaccgtacgtttccgttacggttaccctttaccgttaccgtttacccgttccccgtcgttaaccg

SEQ ID NO: 127839 - DNA, 714 bp, Homo sapiens
  misc_feature: GYAE6OF01DP3DO.45.87.H10.1.454.CMB.1.raw
tcagacgcgatcgacacgaccggtgctcgatttagcagtactgcgtgggtttgggtgcccaagctgcgtggaggcacggtcaccacgctgctgaggtgaagagccgtggtcctcggtgaggtctccgtgcgaaggtcttcgtggaggcagtcttcagtactaactttcctatcgagtgtggtgcgacgcggcccgtagacgaggccgtagagtggagtggagagtcagtcgactaagtcgtagatacgagacagtacgtacgtactacgaactaacgtaccgaacgggtaccgtacgtactaccgtaagttactacggaccgaacaaccgtcctacccgaaccgaaccaaccgaccgtaacctacgagtacgacgcgtagaacgacgtcgagagttagtacgacgacgtacgtacttaagtttactgtacgtacggacgtagtcggtaccgggcgtccggacggtacgttcctcgtaacggtacggacggaccggtacgtaccgtacgtacccgtaccgtccttccgacctccgacccgtaacccgtacggtcccgtaccgtcccggtcccgtttcccccgtacccgttccgacccccgtaccgtacccgtacccgacgtaacgtccccgtaccggtccgggttaccggaccgtacggacccggtaccggtcccgtcgggtacccgtcggtaccgtaccggtacggtaacccgg

SEQ ID NO: 127840 - DNA, 790 bp, Homo sapiens
  misc_feature: GYAE6OF01A7QOM.45.87.H10.1.454.CMB.1.raw
  modified_base (130)..(130): a, c, t, g, unknown or other
  misc_feature (130)..(130): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctggtgaaggtctcctgnaaggtcttgtggaggcagcttcaacgctaactttccatcgagtcgtagggcgacgacgcggacccgtaggaaccgtaagggcctggaggtaggaagnggaaagntccgaagtcggaccaagtaacttgaatacgagacgaagacgtactacgtaacaacggtaacttaccggaacggaaccggtacgtaccaaccttaataacgttcggaacgtaccaaacgtactaccccaacggaacccaacgtaccgtaccgtaactaacggtacggaacgacgttaacgaacgtacgtaccgtaggtaacggttaccgttaaaggaaccggtaacgtacccggtaacttacgtttaacttcggtaagacgtacggtaaggtcggttccgggtaccgtacgggtaaccggttaccgtaaccgttacggtaaaccgtacgggtaccggggaccgtaaacgggtaacccgtaggtacccgtaaccgttccgtacgccgtaacacccgtaacccaacggtaaccgcccgtacgtcccgtccctacccgtccggacctaccccgtaccaacgaacgaccgtaacccgccggtaccggtgggaacccgtacgaacccggcgggtaccccgtcgggtacgtaccggcggtttaacccggacggttaaacccgg

SEQ ID NO: 127841 - DNA, 663 bp, Homo sapiens
  misc_feature: GYAE6OF01DUB8L.45.87.H10.1.454.CMB.1.raw
  modified_base (166)..(166): a, c, t, g, unknown or other
  misc_feature (166)..(166): n is a, c, g, or t
  modified_base (304)..(304): a, c, t, g, unknown or other
  misc_feature (304)..(304): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (653)..(653): a, c, t, g, unknown or other
  misc_feature (653)..(653): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgctactctggctcccagataccaccggaaaaattgtgttgacanagtctccaggcaccctgtctctgtctccgaggggagacacgccaccctctcctggcgagggccagtaggagtgtcagtaagtacttggctggtaccaacaagaacctggccaggctcccgaggcctcctcatccatgntcgcactccgaacgtcgggtccctcgggccgtcccaggacgtacgggttccgtgggcgtagggtgggtcgtagggacaggtcgttcacgttccncgaaccgtnacgacgcgcgtcggacgtcctggacttgtttacgtttgacccgtttaggttttacttcgttacgttcctaaggtccgttacggtcccggtttaccccgcccgtacccggtcccggtaccttccggttaccgggttcccggggggaccggggggttacgtacgggggttagacggtaggtacggaaccgggaaggttacgtgggacggtcgtcggctacgtctccgttcgttccttcacctttcccncccgcttacg

SEQ ID NO: 127842 - DNA, 678 bp, Homo sapiens
  misc_feature: GYAE6OF01D8BJ6.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctgggagcagcttcagctaactttcctatcagctgggtgcgacgacggccctaggacgaagggcctaggaggtggagtaggggaagaggtcagtcgacctaaagacttagaactacgagcgaacgaaacctaccgctacaagtaaacttccgaacggaccgagtcaacctattagtgaccggtacacactaccacgaccacacgctacagtaggacgctagagaacgtcctaggtatagttacgacgtacgacggtaccttagtttactttcgtgtcggtacggtaacggtaccgggtcgggtacgggtcggtccgggtaccttaccgtcggtaacgttaccgggtacggggaccgtaacggggaacccgtacgggtcctacccggtacctcctccgtacgtccctaccgaccgaacccgggtcctacgtccgttcccctcccgtcgaccctaccccgtccaacgacgccgaccgtccgtcgggcggccacggaccgtccgggacccgtcggtcctacggtccgtcggtacgtaacccgg

SEQ ID NO: 127843 - DNA, 866 bp, Homo sapiens
  misc_feature: GYAE6OF01D0VW7.45.87.H10.1.454.CMB.1.raw
  modified_base (171)..(171): a, c, t, g, unknown or other
  misc_feature (171)..(171): n is a, c, g, or t
  modified_base (198)..(198): a, c, t, g, unknown or other
  misc_feature (198)..(198): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
tcagacgcgatcgacacgaccggtgctcgatttagcagtactgcgttgggtttggggaggaactgctcagttaggacccagagggaaccatggaacgccccagctcagcttctcttcctcctggcactctggctcccagataccaccggagtaaattgtgtgacacagtcncagccacctgtctttgttccagggaanagccacctctcctgcagggccagtcgagggttattaacgagtcttaacgtacgcgtacgtaaccaaaacgaaaaccgtgaccaggtccacccgaggcctanactcattactaagtcgaaccgntaagaccgaaagacggaccacgtaggactacgtacccgagtcccggtaaagttccaaggtacggcgtaacgggtcgggtacctaggggtaaacctacgtaccgttaccgtaacctaccggttaacccaaacaccgtaaccgaacgggtaccctaaaccggttccccggttaacggtaaacccccgttaggggttaaacggttacgtttttacccgggtaacccttttaaacgtttttaaccgaacgttttacggacccgtaacgggtaccggttaacggaccgggttacgggaacccgacccgggtaacggttaccccggtaccgttaaccgttttaaccggggttacccggggtaacgggggtaaaacccgggggtaaaacccgttaagggggaacgggtaaacccgttaacgtaaacccgggtaaaaacgtaccgggtttacgggtaacggtacccggtacgtaaacccgtaccctaaacgtttcgtacggtttaccccttaacggtaacccttttaaccccggttacccctaagttaaccgg

SEQ ID NO: 127844 - DNA, 556 bp, Homo sapiens
  misc_feature: GYAE6OF01BPVM0.45.87.H10.1.454.CMB.1.raw
  modified_base (277)..(277): a, c, t, g, unknown or other
  misc_feature (277)..(277): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (550)..(550): a, c, t, g, unknown or other
  misc_feature (550)..(550): n is a, c, g, or t
  modified_base (552)..(554): a, c, t, g, unknown or other
  misc_feature (552)..(554): n is a, c, g, or t
  modified_base (556)..(556): a, c, t, g, unknown or other
  misc_feature (556)..(556): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaacctggccaggctccagctcatcatctatgacgcatcgaacagggccactggcactccagccaggttcagtggcagtgggtctgggacagcttcgactcncacatcagcagcctggaccctgacggtatttgcctatttactactgtcagcacgcgtcggccgaccgtaggccgtctccgtacgtttcggggcggtaacgggacctaggggtggaacggtactaaccgaaaacgtacgtcggtaggctcggacctaccgtatacttcgtcttactacgtccttcccgactactcgtctacgtacgacttcgtcgtacgtcgtacgggcggtcgtcggacgtacgggctacgtagtacgagtgacngacngacnannngn

SEQ ID NO: 127845 - DNA, 867 bp, Homo sapiens
  misc_feature: GYAE6OF01AGODR.45.87.H10.1.454.CMB.1.raw
tcagacgcgatcgacacgaccggtgctcgatttagcagtactgcgttgggtttgggtgcccaagctgctggagggcacggtcaccacgctgctgaggtgaagaagcctgggtcctcggtgaaggtctcctgcaaggcttcgtggaggcagcttcagcctaacttttcctatcagcgtgggtgacgacacggcccctggaccaagggcctgaggtggagtggggaagtagtcagtcgaccaagtacttagactacacgacacgtactacgctacgaagtaaacttccgaacggaccgagtaccaccgtattacgttcgacgtaccacacgtaccaaccgaccacgacgtaccctaacgacgtaggacgtcgtaggaacgaacgtcgtacggtagtacgtttacgggaaccgtaccgtaaccggtacctttagtttttaaccgtttcggtacggtacgtaccggtacggtcgggttacccggggtccgggttacgggtcccgggtaaccgtttaccggtttaccggtaccggttaacccgggttaccgggggaacccggtaaaccccgggggtaaaccccgtcccgggtacccggttaaccccggttacccgttaccccgtacccgtacccgtacccccgtaaccccgaaccgggtaaccccgggtaccccttaccgggttccccggtttaccccgtttccccccggttaccggtccccgtaacccccgttcccgtaaccccggaacggtaacccggtcccgtaaccccgggtttccgggaccggggtaacccggccccggtacccggtccccgggacccgggttcccgggtactccggggtcccgtaccggggttacccgaaacccgg

SEQ ID NO: 127846 - DNA, 790 bp, Homo sapiens
  misc_feature: GYAE6OF01EHN09.45.87.H10.1.454.CMB.1.raw
  modified_base (166)..(166): a, c, t, g, unknown or other
  misc_feature (166)..(166): n is a, c, g, or t
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
tcagacgcgatcgacacgaccggtgctcgatttagcagtactgcgttgggtttggggaggaactgctcagttaggacccagagggaaccatggaagccccagctcagcttctcttcctcctgcactctggctccagataccacggagaattgtgttgacacagtcnccagcctacctgtctttgttccagggaangcccacctctctgcgaggccagtcgaggtataacngtactactacgccgtacggtaaccaaacgtaaaaccgtcggaccacggtccctacccgaggtcctacacttccaacttactagtacgaaccggctaacgtaccggaaaccggacgggaccctacgtaggacctacgtcccgagtaccgtaggttacgaggtcggacgtggttacggggtactacggggaactacggtaaccttacgacgttcctacaaccctaagtacgacggtacctacggtacccgtcgggtaacccttagggtacgtttacgtttacgtaacctttaagtttaaccgtaacgttcggtaaccacgggtaccgtacgggtaccggtacggtccggtaacggtaccggtacgtaccgttaacccggttaccgggttaccggggaccgggggtaacgggttaaccgggtaagggtaacggtaacgtaaccggtaaacggtaaaaccgggtacgttaagggttaccggtacgttaccgaaccgttacccgtaaggttaccgttacgttacccgttaaccttaccgtttcccccgttacccgacgttaaccg

SEQ ID NO: 127847 - DNA, 797 bp, Homo sapiens
  misc_feature: GYAE6OF01EGG88.45.87.H10.1.454.CMB.1.raw
  modified_base (199)..(199): a, c, t, g, unknown or other
  misc_feature (199)..(199): n is a, c, g, or t
tcagacgcgatcgacacgaccggtgctcgatttagcagtactgcgttgggtttggggggaactgctcagttaggacccagagggaaccatggaagccccagctcagcttctcttcctcctgctactctcggccccagataccaccggaaaattgtgttgacacagtctccaggcaccctgtctctgtctccgagggganacagcccaccctctccgtgcgacgggccagtaggagtgtacagttaagtacttaggctaggtaaccaaacgacgaaacctgggaccaggcctcccgaggcctcctcactccatgatcgacactccgaaacgaccggggttccctcggcccgtacccaaggtaccgtacgggttccgcggcgtagggtcggtcgtgggacaggtacgttcaccgttcgtaccgaccgtcgacgtccgacgtccggtacgggaacgtcccgttagggtacttacggtttacgtttttacggtaccgtttaacggttttttacgtttcgttaccggtacgtaacggtacccgttaacgggttccccggttccccggaccccgtaccccgggtcccgtcccgtttacccgggttaacccggggttttcccggggggggaacccgggggtaacccggttaggggggtacggaacggttacggtaacgggaacgggtaaccggtaacggttcgggtacggccgttaccggaccgtaacccgtactttcccggttacgtttacccgttaccgttacccgttccccttaccccggtaccttacggttcgtaaccgg

SEQ ID NO: 127848 - DNA, 766 bp, Homo sapiens
  misc_feature: GYAE6OF01EAOMF.45.87.H10.1.454.CMB.1.raw
  modified_base (211)..(211): a, c, t, g, unknown or other
  misc_feature (211)..(211): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (370)..(370): a, c, t, g, unknown or other
  misc_feature (370)..(370): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtcctccagcccacccgttgttcttttgtttccgaaggggaaacgngcccacccttctcctggccgagggcctaggtcgagggttacgttaacagtcttacgttagcctacggtaacccaaacaaaaaccgtcggaccgnggtacctcccgaggtcctcactctatctaactgacncatacgaacgcggccacgtgacactccgngacctagttcgaggtcggaccgtagggttccgggtacgtcggggaactacggtacttcctaaccgtccgtaacctacccgtagtaccgacggtcccaacggtcccgtacccgggtacccggtaggtaacggtttacgttttaccggtaccctttaggttttaacccgtttacgtacgttaccgtacgggtctaacggggttccggtacgggacccgggtaccgaccgggtaccgtaccgttcccggtaaccggtttccggggaacggtaaccgggggtacggtaacgggtacggacgtaactaacgaacgtacgtcggtcgtaccggtctacccgtacgttcgttaccgtcttaccgttccgttacccttcccgtacccctccgttacttacccgg

SEQ ID NO: 127849 - DNA, 787 bp, Homo sapiens
  misc_feature: GYAE6OF01E1YYT.45.87.H10.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgctactctggctccagagacctccggagaaattgtcttgacacgagtctccagcctattctgtctcctctctccgagggganacacgccctaccnctcgatggaccagggccagtcaagtacgttataagaactacgttacgttcggccgtaggtaacttaccgaaattaacgaaacggtcctcggcccgtacggggtccccgtcctccctcgacttctagtcgtatcgccttccgagccgagggtcccacggtcggactaccgaccccgtaacggccgtacggtttaccggtaggtacggggttcggggtttacggggtttcggaccgtaacgaacgtttcccgttaccgtaccgtacttaccgaatacctaccgactacgaccgtacccgtaacccaaccgttacgtaacgttacgttttacgaacgttacgttaacttacgtttaacgttccgttaaacgaacccgtaacggtaccgttaacgtaacgggttacgttaaccgggtacccgtaccggttacccgttaaccggtttccggggaaacgggttaaccggggaaccggtaaacgggtacgggtaacgtaaccggttaaacggaaaacccgggttacgtagggtaccgtcgtacccggtacgtaaccttcggttcctcggtttaaccc

SEQ ID NO: 127850 - DNA, 732 bp, Homo sapiens
  misc_feature: GYAE6OF01D09XB.45.87.H10.1.454.CMB.1.raw
  modified_base (202)..(202): a, c, t, g, unknown or other
  misc_feature (202)..(202): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccattctgtctctctctccgagggganacacgcccaccctctcatcgcgacggccagtcagagtattagaactatacgttggcctggtactacaagtacaacgccgtaggccgtacggggtcccccgctccgctactctagtgtatcgccttaccgagccgacgggccctacgtacggccaactccccgagtccgtacggttcgagggttcggggtacgggtttcggggtttacggaccgtaacgtacggtaccctttaccgaaccgttccgttaacccaaccgtaacttaccgaacggaccctaaccgaccccttaacccgtaaaccgttgtaaacgtttagttttaccgacgttagtttacctttaagtttaccgtactacctaacgtaacgtacgtaacgtaacggttacgttacgggcccttacgttaccgttaccgggtttaccggggacgggtaaaccgggtaacgggtagggtacggaacggtacggttagggaacggaaccggttaaggtcggttacggtcgtacgaccgtaccgtagttcgttacccg

SEQ ID NO: 127851 - DNA, 724 bp, Homo sapiens
  misc_feature: GYAE6OF01E0QO4.45.87.H10.1.454.CMB.1.raw
  modified_base (225)..(225): a, c, t, g, unknown or other
  misc_feature (225)..(225): n is a, c, g, or t
  modified_base (359)..(359): a, c, t, g, unknown or other
  misc_feature (359)..(359): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttcgtggaggcagcttcagcaacttttcctatcagcgtgggtcgcgaccacggcccctaggacctaagggcctgaggtggagtgggaanagtcatcgaccaagtacttagatacagcacgactacgactacaagtaaacttccgaggaccgagtacacctattacgttcggaccggaccacactacccacgaccacacggacctacagtcgagtctagagacnccgtagagtattgacgacgacgaccttattttattcgtagtcgtacggtaggtacgttccgggccggttacggtccggttaccgttaccgtttacgtaacccgttacgggttaccggggacccgtaaccggggaaccccgtaccggtaccgtacccgttaccgttcccgtcaccgtacccctacccgaacccggaacccgggtacccctaccggtttcccggttccccttcccccggttaccggtacccctaccccgtacccgtacccgaacggaccctcccgtaccgttccggaccgggggactacccggaccgggtccccgcccgggtcgggtaccggtgtcccgggtggtaccggtaaccgg

SEQ ID NO: 127852 - DNA, 827 bp, Homo sapiens
  misc_feature: GYAE6OF01ETID5.45.87.H10.1.454.CMB.1.raw
tcagacgcgatcgacacgaccggtgctcgatttagcagtactgcgttgggtttggggggaactgctcagttaggacccagagggaaccatggaagccccagctcagctctcttcctcctggcactctggctcccagactaccaccggagaattgtcttgacacagtctcagccacctgtctttgttccaggggaaagagccaccctctcctgcgagggccagtcgaggtgtaacagactactagcctaggtaaccaaacgtaaaaccgtggaccaggtcctacccgaggtctacactcacttctaagtcgaaccgtcaacgtaccgaaacgaccggggtaccctaacggtccggactaacctacccggaacgaccccgtaagggtttcccgaagggttcgggaccgtaagggttcggggtaccgtaggggtaaaccaggtaaccctttcgaaccgtttaccgttaaccctaaccgtaacgacccgaacggaccgttaaacggccccgttaacgggtacccccgttaggtaaccgggttaacttttacgtaacccctttaatttaacccttacggcgtttaccgaacgggtcctaacgggtccggttaccgggtacccgggaacccgaacggtcccgaaccggtccgttaacccgggttttcccggggaaccgggtaaccgggggtaaccggtaaacgggttagggaacgtaacggtaaacccgtaaaaggttaaaccgttcggtaaggggtacctacggtacccgtaactacttaccggtacttaccttaccgaaaccctttccttccccggtaatcccgttaccgg

SEQ ID NO: 127853 - DNA, 662 bp, Homo sapiens
  misc_feature: GYAE6OF01AQ9EA.45.87.H10.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
tcagacgcgatcgacacgaccggtgctcgatttagcagtactgcgttgggtttggggggaactgctcagttaggacccagagggaaccatggaagcccccagctcagcttctcttcctcctggcactctggctcccagataccaccggagaaattgtgttgacacagtctccagccacctgtctttgttccagggaagngccaccctctcctgcagggccagtcagggtnttaacagtctacttagcctacggtaaccaaacaaaaccgtggaccgaggcctcccgaggctcgatcatctatgacgcactacggaacgacggggccacgtcggccactcccacggtccaagggttcaggtcggacgtagggtcgggtacgtgggacagtaccttcactcctacaaccactcacgccacgcccgtacgggacccttaggagttacgtttcgaccttactttacctacgtcgtacgacggacctacgggtccggttacgggacccgtaccggacggtccgtaccgtcgttaaccgggtttcggggaccgggaacggggtaaccgaaggggttacgaaggtacgtaaccgtaaacggacgttgggacgtacgtacgacctacgtgttccgtcgttccttacgtaccttccgtaccctctacgtcg

SEQ ID NO: 127854 - DNA, 753 bp, Homo sapiens
  misc_feature: GYAE6OF01D8JY8.45.87.H10.1.454.CMB.1.raw
  modified_base (140)..(140): a, c, t, g, unknown or other
  misc_feature (140)..(140): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttcnggaggcagcttcagctaactttcctatcagctgggtgcgacacggcccgtaggacgaagggcctgaggtggagtagggaacgagtcagtcgaccaagtaccgttagaactacgacgacaagacctaccgctacaaagtaaacttccgaacggtaccgagtaccaacctattacgttcggacgacacactaccaaccgaccacagacctacgagnggacngacggaagtaacgctaggagttagttacggacaacggtaccggtcttaaattttcttcgtaggtcgacggtagttacggtccgggtcggtacggtacggtaccgttacgttaccgtaccggttaacgggtccggggaaccgtaaccgggaaacccggtaccgtacccgtacccgttcctacccggtacccgacgtcccctaacccgtaacccggaaccggtaccccttaccggttccccgttacccccgtttcccccgtacccggtaccctaccccgttacccgtaacccgacggttacccacccggttacccgggtaccgggcggggtaacccaccggaccgggccccggtacggtccgggtctacccggtcggtaccgtaacggtaacccgg

SEQ ID NO: 127855 - DNA, 905 bp, Homo sapiens
  misc_feature: GYAE6OF01D3SJ6.45.87.H10.1.454.CMB.1.raw
tcagacgcgatcgacacgaccggtgctcgatttagcagtactgcgttgggtttggggaggaactgctcagttaggacccagagggaaccatggaacgccccagctcagcttctcttcctcctggccactcgtggcctacccagactaaccgaccggaagtaaatttgtacttgaccactagtcctaccacgtcctatttccgtgtaccttcttcctcgtaccggaaggggaacgaccacgaccctacccttcgtacaacgtcgaccggaccggacctagtaccgaagtaacgttaattaacggaacctaagttacggttacggtaccgttaggtaacttaacaaaacgtaaccgtaacggtcccggtacgggacccggtaaccggggttcccccgtacgttaccctacgacgtttacctagttacgtaacgtttccgtacccgttaccgaacgggaccggtacggtaccccgtaacggtccggtaacctaaccccgttacccgtaaccgggtaccggttaacggttacggtacggggtttacggggttaccgggggtttaggttttaccgggaaccgttaaccggtaaacggtttaccctttaccgaaccgtttacgtaaacccaacggtaccgttaaccgaacgtaacccgtaccgtaccccttaaaccggtaaacccgttaaggttaacgtttacgttaccgtaccgttaacgtttacttaaccgtttacgtaccgtaaacgtaaccggtaccgttacgtaacgtacggttaccgtacggtaccgttaccgttacgtaaccgggttacgggtacgggtaacggaaccggtaggtaacgtaacgtaacgtaacgtaaacggtcgtacgacgttacgacgtacctaacgttccttggtcttaccg

SEQ ID NO: 127856 - DNA, 669 bp, Homo sapiens
  misc_feature: GYAE6OF01B8Y1Q.45.87.H10.1.454.CMB.1.raw
  modified_base (146)..(146): a, c, t, g, unknown or other
  misc_feature (146)..(146): n is a, c, g, or t
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (647)..(647): a, c, t, g, unknown or other
  misc_feature (647)..(647): n is a, c, g, or t
  modified_base (652)..(652): a, c, t, g, unknown or other
  misc_feature (652)..(652): n is a, c, g, or t
  modified_base (655)..(655): a, c, t, g, unknown or other
  misc_feature (655)..(655): n is a, c, g, or t
  modified_base (662)..(662): a, c, t, g, unknown or other
  misc_feature (662)..(662): n is a, c, g, or t
  modified_base (667)..(669): a, c, t, g, unknown or other
  misc_feature (667)..(669): n is a, c, g, or t
tcagacgcgatcgacacgaccggtgctcgatttagcagtactgcgttgggtttgggggaggaactgctcagttaggacccagagggaaccatggaagccccagctcagcttctcttcctctggcactctggctccagtcgagggtnttaacagtctacgttagcctaggtaaccaaacaaaaccgtcggaccacggcctcccaggctacatcatctatggacncatacgaacgaggccaacgtcgactactcccgaggaccctagggttcgaaggtcgacgtggttgggtcgtagggactaggtacctaccgtctcctaccncgtatcgacgcgacgtccgttaggaccgttagtacgtttactttcgaacttactttacnccgtancacggtcgacggtcgaccggtacgaaccgcggtaccgtcttaccggacggtttaccgggcggtaacgggaaccggtaggtacgtaaacgtacaacgtaacgtaacgtggtacggactacgacgtaccgtctcgtacgttccttacgtaacccttcccggtacctaccgtagttcctaaggttaccgtacggtaccgtcccgtacggttaccgaccgggttaggacccgggtagtaccgggacgtacgggacctagacgtnagctnacnctgactnacgannn

SEQ ID NO: 127857 - DNA, 600 bp, Homo sapiens
  misc_feature: GYAE6OF01EJ42N.45.87.H10.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (373)..(373): a, c, t, g, unknown or other
  misc_feature (373)..(373): n is a, c, g, or t
  modified_base (547)..(547): a, c, t, g, unknown or other
  misc_feature (547)..(547): n is a, c, g, or t
  modified_base (587)..(588): a, c, t, g, unknown or other
  misc_feature (587)..(588): n is a, c, g, or t
  modified_base (590)..(591): a, c, t, g, unknown or other
  misc_feature (590)..(591): n is a, c, g, or t
  modified_base (594)..(595): a, c, t, g, unknown or other
  misc_feature (594)..(595): n is a, c, g, or t
  modified_base (597)..(600): a, c, t, g, unknown or other
  misc_feature (597)..(600): n is a, c, g, or t
tcagacgcgatcgacacgaccggtgctcgatttagcagtactgcgttggggtttgggggaggaactgctcagttaggacccagagggaaccatggaagccccagctcagcttctcttcctcctggcactctggctccagtcagggtgttaacagctacttagctggtaaccaacaaaacctggccagctccagctnatcatctatgacncatacgaacgagggccacgtgcactacccagtccgaggttcgaggtggcgtaggtgggtcgtagggacagtacttcactctccacatcagcgaacgcctacggaccctgaggttactttgccttattacctactgtcagctacggtggtacgaccgaccggacnccgtctacgtaccgttcggacggggaaccgggaacgaaggtcggaagtaacgtaaccggaaaacgtacggttcgtaggtaccgtacgtaccgtacctagtccgttacgttccttaccctacgtttccctaccccgtactacttcgtcgtacgtacgacggttacggtcttacgnggcgggcgggtcgaggcgaacgggtccgacgtagtacganncnnctnnannnn

SEQ ID NO: 127858 - DNA, 593 bp, Homo sapiens
  misc_feature: GYAE6OF01AQE7X.45.87.H10.1.454.CMB.1.raw
  modified_base (208)..(208): a, c, t, g, unknown or other
  misc_feature (208)..(208): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
tcagacgcgatcgacacgaccggtgctcgatttagcagtactgcgttggggtttggggggaggaactgctcagttaggacccagagggaaccatggaagccccagctcagcttctcttcctcctgctactctggcctccagagacctcggagtaaattgtcttgacacagtctcagtccattctgtctctctactccgaggggacacncgcccaccctctcatcgacgacggccagtcacgagtatagaatatcgtggtcctaggtatacgtaactacaggcctcggccgaccgggtccccgctcctnactctangtacgtcgtacctcacggtcgacgggcctacgtcgacctactccgacgtcgtacgtgacggtgggcggttggtacgctacgctactacnctntaccaacgactcgacgtcacgtccctacgtaactgtagtcttcacgtattctattacgcgtactacgactacgtacgacgtacgcgtcgtcgttactacgggtttaccgacgggtacgaccggtagggtacggaagtacaacggaacgtaggcgtaggtcctacggactagtactcgttacgttcc

SEQ ID NO: 127859 - DNA, 809 bp, Homo sapiens
  misc_feature: GYAE6OF01C4I25.45.87.H10.1.454.CMB.1.raw
  modified_base (224)..(224): a, c, t, g, unknown or other
  misc_feature (224)..(224): n is a, c, g, or t
  modified_base (339)..(339): a, c, t, g, unknown or other
  misc_feature (339)..(339): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagctaactttcctatcagtcttggtgcgacacggccccgtggaccgaacgggctggagtggagtagggaagngtcatcgaccaagtacttgatacagacagactacgctacgaagtaacgttccgaacggaccgagtacactattatcgacgacacactaccgacgaccacacgcctagagtggacnctaggaagacgcgtagagtacgttagaaccgtacgtaccggtactttagttttactttacgtggtcgacggtaggtacggtcccgggtccggtgggtcccgggtaccgttaccgttacggtaccgttaccggggtaccgggaacccggaaacccggggtaaccccgaccgggttacccgtaaccccgggttcccttacccgtacccgtaacccgtacccccgttaacccggaacccggtaaccgggaccccggttaacccggtttccccgggtttcccccgttcccccccggttaccgggacccccccttacccccggttacccctaaccgggaacccgtaccccgggttaccctaccccggggttccggggtacccgggggaaccctcccggggtaccggggtcccccgttcccgggtcgggttaccccgtcgggtaccccgggttacggtacccgggttaaacccggg

SEQ ID NO: 127860 - DNA, 751 bp, Homo sapiens
  misc_feature: GYAE6OF01CPPCG.45.87.H10.1.454.CMB.1.raw
  modified_base (261)..(261): a, c, t, g, unknown or other
  misc_feature (261)..(261): n is a, c, g, or t
  modified_base (495)..(495): a, c, t, g, unknown or other
  misc_feature (495)..(495): n is a, c, g, or t
tcagacgcgatcgacacgaccggtgctcgatttagcagtactgcgtttgggtttggggaggaactgctcagtttaggacccagagggaaccagtggaagccccagctcagcttctcttcctcctggcactctggcctcccagactaccaccggagtaaattgtgttagacacagtctcagcccaccgttgttctttgttccgaagggaaacgcgccctacccttctcctagccgagggcctagtacgagggttacttaacnggtacttacgttacggtccttacggtaaacccaaaaccgtaaaaccgtggtaccaacgggtccctacccgaggccttaccattacctacttcttaagccggtaaccacgtaacgaccggaaacgtcgggacctaccgtggaccctaccgtccccgacgtaccggttacgttcgacggtggtaccgaggggttcggacgttacgggaacttacggtcttccacttcaccgtaccntacgatccgacgtcccgttaggtaccctggttacgttacgtttcgaccttactttacgtacgtcgtccgagtcgacgtccggtacggaccggtacgaccgtccgtccttaccgtcggttaccgggacggggacggttaccgaagggtacgacgtaagttaaccgaaacggttcgtaggttccgacgtaccgtacctaacccgtatttacccggtttactccttttaacctcccgttcccgttccccgtaccttacg

SEQ ID NO: 127861 - DNA, 810 bp, Homo sapiens
  misc_feature: GYAE6OF01CLOB0.45.87.H10.1.454.CMB.1.raw
  modified_base (201)..(201): a, c, t, g, unknown or other
  misc_feature (201)..(201): n is a, c, g, or t
  modified_base (785)..(785): a, c, t, g, unknown or other
  misc_feature (785)..(785): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagagacctccggagaaattgtcttgacacagtctccagccattctgtctctctctccgagggganacacgccaccctctcatgaccgagggacccagttccaaggagttaacgtttaacgaactacttaaccgttcgggtaccgttagggttaacttaacgtaaaacttaacaaaaccggtcccgttacgggacccgtaacccgggggttcccccccggtccttaccccgtactaccttaccgtttaacgtagttaacgttccggtaccctttccgaacggtcggaacccgggggtaccctaccggttacgggaccaccgttaccccgaacggtccgtacgggtttaccgaaggggttcggggtaccggggtttcggggtttacgccgtaacgtaaccggtccgtttaccaacgtttccctaacgaacgtaacgtacccgtaacggtcctaacgtccccccttaaccgaaaaccccgttggttaaacgtttacgttttacggaacctttacgttaaccttaagttaccgtaacgtacctaacggtaacgtaccgtaactaagggttacgtcgggtaccctacgttaccgttaccggttacgggacgggacggtaaccgtagggtacgagtacgtaacaacggtagtcgngtacgtcgacacgtatcgtgttccg

SEQ ID NO: 127862 - DNA, 746 bp, Homo sapiens
  misc_feature: GYAE6OF01ANVKL.45.87.H10.1.454.CMB.1.raw
  modified_base (202)..(202): a, c, t, g, unknown or other
  misc_feature (202)..(202): n is a, c, g, or t
  modified_base (678)..(678): a, c, t, g, unknown or other
  misc_feature (678)..(678): n is a, c, g, or t
  modified_base (697)..(697): a, c, t, g, unknown or other
  misc_feature (697)..(697): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagcccaccctgttctttgtttccagggganacagcccaccctctcctgctagggccaggtaggagtgtcagttaagtacgttaggcttaggtaacccaagacgaaacctgcccgaggcctacccgaggtcccttccctacactaccattcggaatcgaaccatacccaaacggtaccgggtccctggcccgtacccgaacggaccgtacgggttcccggtgggccgttagggtcgggttccgtaggggtaaccaagggtagttccgtaaccgtccgttaccaacccgggtttcaacgggccctaacgggtcccgttagggaccgtaccttgggaatttcggtttactttcgggacctttaacggttttccttcgttacgttcaacggttaccgacggttcccgttacccgccgtaacccgggaccttccgttacggtaccggtttccgggggaccggggtacccgtaggggtccgtagacggtacaacgggaactacgttcgggtntaccggtcaccttacccgngtttcccgtgttacccttactccgtttacccgtcccgtacttcgtaccg

SEQ ID NO: 127863 - DNA, 731 bp, Homo sapiens
  misc_feature: GYAE6OF01EMRUB.45.87.H10.1.454.CMB.1.raw
  modified_base (184)..(184): a, c, t, g, unknown or other
  misc_feature (184)..(184): n is a, c, g, or t
  modified_base (263)..(263): a, c, t, g, unknown or other
  misc_feature (263)..(263): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctgggaggcagcttcagctaactttcctatcagcgtgggtgcgacncggcccgtggacgaagggcctgagtggagtgggaagagtcatcgaccaagtacttgatacgacgcaagacctacgctanaagtaaacttccgaggaaccgataccactattatcggcgacacactacccaccgaaccacacgtaccctaacgtagtaggacgacgtaggaacgtaacgtccgtaggtagtaagtttacggaaccgaccgtaccggtacctttaattttcgtttacttgggtacgacggtacggtacggtccgggtccgggtacgggtccgggtacctttaccggtacgtaccggttcggaccgggacggaccgggaaacccgtacgggttcctacccgttccctccgacccgtacggaccccttacccgaaccgtaccggtcccgtacgttccccggttccccgtttccccgcggtaccccctaccccgtcccaacccgtaacgcccgtaccgaccgttcgggacccggggacaccggtaccgggcccggtaccggtccgggtacccgtcggtcccggttcggtaacccgtaaccgg

SEQ ID NO: 127864 - DNA, 647 bp, Homo sapiens
  misc_feature: GYAE6OF01BJUP8.45.87.H10.1.454.CMB.1.raw
  modified_base (629)..(629): a, c, t, g, unknown or other
  misc_feature (629)..(629): n is a, c, g, or t
  modified_base (636)..(636): a, c, t, g, unknown or other
  misc_feature (636)..(636): n is a, c, g, or t
  modified_base (641)..(645): a, c, t, g, unknown or other
  misc_feature (641)..(645): n is a, c, g, or t
  modified_base (647)..(647): a, c, t, g, unknown or other
  misc_feature (647)..(647): n is a, c, g, or t
tcagacgcgatcgacacgaccggtgctcgatttagcagtactgcgttgggtttgggggaggaactgctcagttaggacccagagggaaccatggaagccccagctcagcttctcttcctctggcactctggctccagtcagggtgttaacagctacttagcctggtaaccaacaaaactggccaggctccagctcactcatctatgacgcatacggaacacgggaccacgtggaccatcccgagacctaggttcgaggttggaccgaggtcgggtcgtacgggacgtacgtacttcgacctcctaccaacctagtaccgagaccgtacgaccgttacggtacccgtaggtacggttactttttcggaccttaagtttttaccacgtacgtcgaaggtccaaggtccggtaggaccgtacggaggcaccgtccggtaaggttcgggacgggaacgggtaacgagggtggaactacggtaaccgaaacgtacggtagtacggtcgacacggtacctagttcgtacgttctaacgtccttcccgttaccgcctacgtactaggtaacttcgaacgttcgtaccgtgacggtaccgggcggtacggtcggaacgtacggacgtgaagtccgancgtgcgngctcnnnnngn

SEQ ID NO: 127865 - DNA, 735 bp, Homo sapiens
  misc_feature: GYAE6OF01AZRQF.45.87.H10.1.454.CMB.1.raw
  modified_base (205)..(205): a, c, t, g, unknown or other
  misc_feature (205)..(205): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggaagtaaattgtgttgacacagtctccagccacctgttctttcgttaccgaaggggaancgcctaccctctccgtgcgacgggccagtcgtagggtacgttaacagtactacgttacgccgttacggtaaccaaaacgtaaaaaccgtcggaccgacggcctacccgaggtcctcgaatccgtattactaacgtacgacgactaacgtaccgaaacggacggaccctacgtcggacctaccgtacccgacggtacccgtagggttaccgacgggttacggacgtacgggttcgggtcggttacgggaactaacggttacctacgtacctcgttaccactacgtcgacgaccgacgtaccgttacggaccgtaggtacgttacgtttctacttaacgtttacacgttatacgagtcgtacggtcggcgaccgacgcgcctacgtacgtaccgttacggggacgggtaacggaccgtaaggggtacgaaccgtacgaaccgtaaacggtcggtaggtcggtacctcgggacctacggttgttcccgttagttaccttacgttacctacccctttccggtacctggttaccg

SEQ ID NO: 127866 - DNA, 875 bp, Homo sapiens
  misc_feature: GYAE6OF01C977M.45.87.H10.1.454.CMB.1.raw
tcagacgcgatcgacacgaccggtgctcgatttagcagtactgcgtgggtttggtgcccaagctgctggagggcacggtcaccacgctgctgaggtgaagaagcctgggtcctcggtgaaggtctcctgcaaggcttctggagacagcttcagctaactttccatcagcgtgggtgcgacacggccctggacagggcctggagtggatcgggaagacgttcagtcgaccaagtacttggaactacgagcaggtactacgactacgaagtaacctccgaacggtaccgtaagttccaacctaattttacgtacggaccggtaacctaactaaacgttccccgaaccgtaaccaaccgtaacggtccccttaagacgttacgggaagtcctacggaaacggtaacgtccgtaaggtaaggttacgtttcggaaacccgcccgttaaccgggtaccctttaaagtttttaagtttcccggtagggttacgacggggtaacgtaccgggtacggtcccgggttacggtccgggtactttaaccgttacggtaaacccgttcgggttcggggaacccggtaaccgggtacccccgtaagggtccccggtaaacccgttccccgtacccgtaccggtacccgtaaccccggtaaccgaaaccccgggtaaaccgggtcccccttacggttaccccgggtttccccgttcccccggttaacgggtcccccccttaacccgttcccccgttaaacggtaccgtcccgtaaaccccggttcccgttaaccggggttacgggggaccccaacccggttacgggcccccgggttacccgtcggggtaacccttccgacccgggtttacggtaaacggtaaacccgg

SEQ ID NO: 127867 - DNA, 843 bp, Homo sapiens
  misc_feature: GYAE6OF01DNZJG.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctcccagactaaccaccggagtaaattgtgttgacacagtcctccacgccctacccttgttacttttcgtttccgaaggggaaacgacgccctaccctctcctggcgaacgggtccaggtccgtaggggttattaacgacgtccttaacgttcgacccgttacggaaaccctaaaaccgaaaaaccgtcgggacctaacggtcctcccgaagggtcctacaacttcctacttactacgacgaccgactacgtaccggaacggaccgggaccacggtacgaccgtaactccccgaaggtccccgtaaggttctaacgggtggacgttacgggtccgggttacggtaaggaaccgtttaggtaccctttacccaaccgttcaaccccaaactcgtaaccgcggtacaccggtccgtaaccggacccgttaggtaacgtttcgtttaccgtaactttacttttaaccgtacgttaccgtacggtaaccgtcggtaacgggtttccgggaaccggtaccccggtaccgggtaccgttccgttaaccgttaaccgttaccggggtttaacgggaccgggggtttaaccgggaccgggttaaagggtcggtaacgaacgtttaacggaaccttacgggtagtcccggtacgtacggacccttacgtaacgtttccgtaacgttcccggttaacttcccggttcccctcgtccgttacc

SEQ ID NO: 127868 - DNA, 966 bp, Homo sapiens
  misc_feature: GYAE6OF01AUSS0.45.87.H10.1.454.CMB.1.raw
  modified_base (138)..(138): a, c, t, g, unknown or other
  misc_feature (138)..(138): n is a, c, g, or t
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
tcagacgcgatcgacacgaccggtgctcgatttagcagtactgcgttgggttggggaggaactgctcagttaggacccagagggaaccatggaagccccagctcagcttctcttcctcctgctactctggcctcccanactaccaaccggtaaaaattgtgttgacacagtctccaggcaccctgtctctgtcnccgagggagacacgccacccctctccncgcgacggtaccgaggttacggagttggtaccgtaagttaaacgttacgttacggtccgttacggtaaccgtaaccgtaaacgtaacccggtacggcccgtaacgggtccctcccgtaacgggtccctaccctacgaccttaccgagttacggagtacggtaccaacgtaccccgtaaaccggtaccggggttacccggtccggtaccccggttaccccgaaccggggtaccgttcggggtttacccggcggggtccgtaacgggttaggggtaccggttcggggaaacgtacggttaccggtttacctacccgttcccgtaacgtaccccggtaccgaccggtcccgtaccgggtaccggtcgtaccggtcgtaaccgggttagttacgtttcggttttaacgtacccgtttaacgtttttccgtccggttttcgaaccgttacggtttccgacccgggttttaccccgtaccccggttacccggaacccgttcccccgggtcttttaaccccgggtacccggggggggttttaccccggggaaaccggggggttttaccggggaacggggtttaacccgggtaagggttaaccccgggtaaagggttacccccgggggaaattccccggggtaagggtttcccgggacctttaggaaccccctttaaaggttccccgttcgttttaccggtccttttaaacccccgttcggttaccccgtttacccccgaaaggtttccccgg

SEQ ID NO: 127869 - DNA, 1000 bp, Homo sapiens
  misc_feature: GYAE6OF01DCINY.45.87.H10.1.454.CMB.1.raw
  modified_base (201)..(201): a, c, t, g, unknown or other
  misc_feature (201)..(201): n is a, c, g, or t
tcagacgcgatcgacacgaccggtgctcgatttagcagtactgcgttgggtttgggggaactgctcagttaggacccagagggaaccatggaagccccagctcagcttctcttcctcctgctactctggctcccagataccaaccggaaaattgtgttgacacagtctccaggcaccctgtctctgtcctccgaagggganaccacgcccacctctcctcgcgagggccaaggtacggagtgacaagtaacgtacgttaggcttacggaaccaaacgtacgaaaccgttggacccgaacggccgttaccccgaagggtcccctttaccctaccgtacttacccccgtaagttacggtaaccgttcggaaccccgtaaaccttaaaccccccggaaaaacgggtttaacccgggggtttccccccggtaaaccgggggtcccccggtttaaaccccggaacccgggttaaacggttaaccccgggggggtttttacccccggtgggggaacccggtttaaccgggggttttcgggggtaaccggtacggggggttaaaaaccggttaaggtttaaccccggtttaccgttaaccccggttttcctttaaccccggaacccggtttacccgaacggggtacccttaacgggggaccccgtttaacgggggaaccgtttcccgtaaggttacggtttaggttaaccggttttacgtaacgtttacgttttactttacgttcgtaccgtacggtaccgaccgggtttcccgtacccgaccccgtaccggtcccgtccgtttaccggttacccggtttaccggggggtaacccgggggtaacggttaacggggtacgggtaaacgggtaggttccggtaaacgggaaacccgtttacgggtccgggttacgggtaccggtaccgtacccggtaaccttagttcccgtttacgggtttacccttactaaccccggtttcccttaccccggtacctcgtttacccgg

SEQ ID NO: 127870 - DNA, 685 bp, Homo sapiens
  misc_feature: GYAE6OF01DN3LL.45.87.H10.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagacgcgatcgacacgaccggtgctcgatttagcagtactgcgttgggtttgggggaggaactgctcagttaggacccagagggaaccatggaacgccccagctcagcttctcttcctcctggcactctggctccagataccaccggagaaattgtgttgacacagtctccagccacctgttctttgttccgaaggggaanacgcccacctctctgcacgggccagtcagggtntaacagctactcgcctacggtaaccaaacaaaccgtgaccacggcctacccgagtcctacatacatctagtagacgtcacgtacggaacgacgggacccacgtcggactaccgtccacggcctagggttcgagtacgggacgtaggtcggggtcgtaggactacgtaccgttacgacttcctacaaccgtatcgacgacgtaccgtacccgtacggtaccgtaggtacgttactttccgactttactttaacgtacgttcgtacacggctacggtcggtcggtaccgacggcgtccgtcgtacgttaccgggttacgggacggggtacggtaaccggtaagggcggacgtaacgtaacggtaaacggtcggttacggacggtacgttacggacttaacccgtagtttcccgttcgtttcctacttaaccgttccccgtacgtccttacg

SEQ ID NO: 127871 - DNA, 891 bp, Homo sapiens
  misc_feature: GYAE6OF01AZZV6.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctgggaggcagcttcagtctaactttcctatcagtcgtgggtcgcgacgacggcccctaggaccgaagggcctggaggtagggagtaggggaatacggtacacgtacgaccaacggtaactttagaactaacgacggacaacggtaaccgtaccgtacgtaccgaaagtaaacgttacccgaacgggaacccgtacgttaaccaacccgtaagtttaacggttccggaccgggaacctaacctaccgtacccgaaccgtaacccaacgtaacgtacccttaacgaaggttcgggtaacgtaccgttaaggaacgtaaccggtccgttaggtaaacgttagtttacgggaacccgtaccgtaccgggtacctttaagttttacgtttacggttagtccgggaaggtaacggtacggggttacccgggtacgggttcgggacgggtacccttaccgttaccggtaccgttaaccgggtaccgggggtacccgtaacgggtaaccccgtaccgggtaccctaccccggtacccgttacccgtaccgaccgtaccctacccggaacccgtaacccgggacccttacccggttcccggtttcccccgttacccccgtacgtccccctaccccgtccgtaacccgtaccggtacccgcccggtacccgttcggggtacccggggtaccgaccgggtccggtacccgggtcccgttaccgggccgttacccggtacccggttgggaaccccgttaaacgg

SEQ ID NO: 127872 - DNA, 851 bp, Homo sapiens
  misc_feature: GYAE6OF01EJF70.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagagcctgggtcctcggtgaaggtctcctgcgaaggtcttcgtgggaggcagcttcaagtactaacctttcctatcagtcgtgggtgcgacgcggccctggacgacggctggaggtggagtagggaatagtcagtcgacccgtaagtaccttagactacgagacgtaacgacctacgtctacgaaacgtaaacgttcccgaaggtacccgagtaccgaacgttaattacgtcgaccgaaccaaccacgtacccgaaccgaacccgaacgaccgtacccgtacgagtacgggtactacgtaaggaacggtaacgccgtagtaaggttacgtttaacgaacccgtacgtaccgttcctttaattttcgttcgtggtacggtacggtacgttagggtccggtgggtacggtcccggtaccttaccggttaccggtaaccggttccgggtacggggaacccgtaacccggggtaacccgtacggttacccgtacccggttccctacccgaccgtaccgtaccctacccggaacccggtaccgggtacccctacggttcccccgtaccccgttcccccgtaccggtaccccctacccccggttaccgaacccggtaacgacccggttaccccgtaccggtcccggggtaaccggggacccgtacccggaccccgggggtccccggttacccgggtcccgggtaccgggtaccccggtttacccggggttaaccggtaaacccgggttaaaccccggg

SEQ ID NO: 127873 - DNA, 784 bp, Homo sapiens
  misc_feature: GYAE6OF01ACL68.45.87.H10.1.454.CMB.1.raw
  modified_base (208)..(208): a, c, t, g, unknown or other
  misc_feature (208)..(208): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggcctccagataccgaccggagaattgtgttgacactagtctccagccctacctgttctttcgttccgagggtaaacncgcctaccctctccgtcgcgacggccagtcgtagggtcgtaacagtctactcgcctacgtaaccaaacgtaaaaccgtcggacacggtcctaccgaggtacctcgtacttactactacgtagtacggaccgtacaaccgtacggaaccggaccggtaccaaccggttcggacctaccgtacccgacggtaccggtacggttaacgcggtacggtacgtcggggttacggtaccggtacggggactacggtcccttacgtaccgttacctaccaactactacggaacctcgtaccggtaccgtaccggtacccggttagttaccggtttagtttcccgtaacgtttacttttaccgtacttacgtaccgaacgttccgaacgggtccggtaacggaccggtaccgtacggtcccgttccgttaaccggttcccgggttacggggaaccggggtaaccgggtaacggtacggggtacgtaacggaacggtaaccgtaaacggtccggtaggtaccggtccgacgtaccgtcctacgttaccgttacgtccttacgtcccgtcccttaaccgcttaccg

SEQ ID NO: 127874 - DNA, 763 bp, Homo sapiens
  misc_feature: GYAE6OF01AKGFN.45.87.H10.1.454.CMB.1.raw
  modified_base (399)..(399): a, c, t, g, unknown or other
  misc_feature (399)..(399): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagtaaattgtgttgacacagtctccagcctattctgtctctccgtctcgagggacacacgcccacctctcatgacgcgggcctagtacgagtagtaattaacgaactagttacggttcggtaccgtaggttaacactaactaaccgaacgtccgtcgggacccggaccggggttcccccggtcctcccctactaacttccttagtcggtacttccgtacccgttaccggacggtaccggaccgggtacccncggtaccggtacctacccgtacccgaccggtaccggtacggttcggacggggttcggggttccgggtttggggttaccgacgtaccgtacgtaccttccgtaaccgtcttactactaaccgtcgaccgaccgtaccctaccccgttaacccgtaaacttaggtaacgtttgttttaccgaaccgttactttacttaacgtttaccggtacgtaaacccgtaaggtaccggtacttaacgacggttccgttaccggacccgttacctcgggttaccgggttacgggacgtacgggtaacgtaggaggtacgtacgaaccgtaacggttgaccgggttgcctaacggcctacgtacgttgtctacg

SEQ ID NO: 127875 - DNA, 171 bp, Homo sapiens
  misc_feature: GYAE6OF02FURKD.45.87.H10.1.454.CMB.1.raw
  modified_base (171)..(171): a, c, t, g, unknown or other
  misc_feature (171)..(171): n is a, c, g, or t
tcagacgcgatcgacacgaccggtgctcgatttagcagtactgcgttgggtttggggaagaggaagactgacggtccccaggagttcaggtgctgggcacagcggccctgggctgcctggtcaaggactacttcctcgatcgcgtctgagcgggctggcaaggcgcatagn

SEQ ID NO: 127876 - DNA, 130 bp, Homo sapiens
  misc_feature: GYAE6OF02GH0VR.45.87.H10.1.454.CMB.1.raw
  modified_base (130)..(130): a, c, t, g, unknown or other
  misc_feature (130)..(130): n is a, c, g, or t
tcagacgcgatcgacacgaccggtgctcgatttagcagtactgcgttgggtttgggcacagcggccctgggctgcctggtcaaggactacttcctcgatcgcgtctgagcgggctggcaaggcgcatagn

SEQ ID NO: 127877 - DNA, 177 bp, Homo sapiens
  misc_feature: GYAE6OF02JBY6J.45.87.H10.1.454.CMB.1.raw
  modified_base (173)..(177): a, c, t, g, unknown or other
  misc_feature (173)..(177): n is a, c, g, or t
tcagacgcgatcgacacgaccggtgctcgatttagcagtactgcgttgggtttgggggaagaggaagactgacggtcccccaggagttcaggtgctgggcacagcggccctgggctgcctggtcaaggactacttcctcgatcgcgtctgagcgggctggcaaggcgcatagnnnnn

SEQ ID NO: 127878 - DNA, 533 bp, Homo sapiens
  misc_feature: GYAE6OF02JBIY2.45.87.H10.1.454.CMB.1.raw
  modified_base (439)..(439): a, c, t, g, unknown or other
  misc_feature (439)..(439): n is a, c, g, or t
tcagacgcgatcgacacgaccggtgctcgatttagcagtactgcgttgggtttgggggaggaactgctcagttaggacccagagggaaccatggaagccccagctcagcttctcttccggtcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttccagtggcaggtgggtctggggacagacttcactctcaccatcagcagcctggaccctgaggtattttgcctatttactactgtcagcagcgtggcgaccgngcgctcacgtttcggcgggacgggaccgaagggtggagagtacgaaacgacgtggtcggctgcaccactcgtcgtcttcactccttcccgctac

SEQ ID NO: 127879 - DNA, 148 bp, Homo sapiens
  misc_feature: GYAE6OF02IIR45.45.87.H10.1.454.CMB.1.raw
  modified_base (130)..(148): a, c, t, g, unknown or other
  misc_feature (130)..(148): n is a, c, g, or t
tcagacgcgatcgacacgaccggtgctcgatttagcagtactgcgttgggtttgggcacagcggccctgggctgcctggtcaaggactacttcctcgatcgcgtctgagcgggctggcaaggcgcatagnnnnnnnnnnnnnnnnnnn

SEQ ID NO: 127880 - DNA, 555 bp, Homo sapiens
  misc_feature: GYAE6OF02GUNNP.45.87.H10.1.454.CMB.1.raw
  modified_base (309)..(309): a, c, t, g, unknown or other
  misc_feature (309)..(309): n is a, c, g, or t
tcagacgcgatcgacacgaccggtgctcgatttagcagtactgcgttgggtttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacngggtccctggccgtcccagacaggttccgtggcagtgggtctggggacagagttcactctcaccgtcagcagcctggacgcctgatgtatttgctagtttacttctgtcagcagtccgttccgccacgcccgtctccgtaccgtttccggggccggggggtaccgacggggtggaaggtagtggacgacgacgtggtacggcgtcgcaccgtagttccgtgttccttctacttccttcccgctacg

SEQ ID NO: 127881 - DNA, 497 bp, Homo sapiens
  misc_feature: GYAE6OF02IOQR1.45.87.H10.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
  modified_base (434)..(434): a, c, t, g, unknown or other
  misc_feature (434)..(434): n is a, c, g, or t
tcagacgcgatcgacacgaccggtgctcgatttagcagtactgcgttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcagggccatggcatcccagccaggttcagtggcggtgggtttgcacagtacttcactctcacaatcagcagcctccaacctgaagtatttgctagtctattactgtacaacagtcgtacagtatgccnctcactttcggcgagggaccagttggagtactacaacgaactgtggctcgacaccatcgtgtc

SEQ ID NO: 127882 - DNA, 538 bp, Homo sapiens
  misc_feature: GYAE6OF02I80I0.45.87.H10.1.454.CMB.1.raw
  modified_base (309)..(309): a, c, t, g, unknown or other
  misc_feature (309)..(309): n is a, c, g, or t
  modified_base (349)..(349): a, c, t, g, unknown or other
  misc_feature (349)..(349): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccagtcaccattatgcggacacatccacgaccacagcctacatgganctgagaagcctgaagattgacgacacggcctatttattcngtgcgagagtcggcgtgcgggtctacgttcgactacgtgggccacgggacccaggtcgaccgtctcctcacgcctccaccgaacggcccacgtccggtccttccccgtcgcctaccctcctccgaacgacgccaccctcgtcggggccacgacgccggcccgtcggccgtcgccgtcggtacctaacgg

SEQ ID NO: 127883 - DNA, 533 bp, Homo sapiens
  misc_feature: GYAE6OF02IYG1D.45.87.H10.1.454.CMB.1.raw
  modified_base (419)..(419): a, c, t, g, unknown or other
  misc_feature (419)..(419): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagattgacgacacggcatttattctgtgcgagagtcgcgtgcggctactcgactacgtcgggtcagggaaccaggtcgaccgtctcctcacgtccnccaccaacggcccatccggtccttccccgtgccaccctcctcccaacgacgcacccgtcgtcggggcacgacgaccggcccgtcgggccgtacgcccgttggtaccgtaaccgg

SEQ ID NO: 127884 - DNA, 511 bp, Homo sapiens
  misc_feature: GYAE6OF02FOF5N.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcagtggtctgggacagacttcactctcaccatcagcagcctggaccctgaggatttgcctattactactgtcagcagcgtggcgaccgagcgctcactttcggcggagggaccaagggtggagatacgaaacgactgtggctgcaccatctgtcttcatcttcccgctac

SEQ ID NO: 127885 - DNA, 529 bp, Homo sapiens
  misc_feature: GYAE6OF02HXFQQ.45.87.H10.1.454.CMB.1.raw
  modified_base (370)..(370): a, c, t, g, unknown or other
  misc_feature (370)..(370): n is a, c, g, or t
tcagacgcgatcgacacgaccggtgctcgatttagcagtactgcgttgggtttgggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaaccaacaaaacctggccaggctcccaggctcatcatctatgacgcatcgaacagggccactggcatcccagccaggttcagtggcaggtgggtctggacagacttcactctcaccntcagcagcctggaccctgagtattttcgcctatttactactgtcagcagcgtgcgaccgagcgctcacgttcggcggaggaccgaagggtgagagtacgaaacgacgtggtaggcgtgaccactatcctgtccttcacttcccgttcccgcctattccg

SEQ ID NO: 127886 - DNA, 518 bp, Homo sapiens
  misc_feature: GYAE6OF02GD5WE.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcagtggtctgggacagacttcactctcaccatcagcagcctggaccctgaggtattttgcctatttactactgtcagcagcgtggcgacgagcgctcacgtttcggcggaggaccgaagggtcggagatacgaacgacgtgtcggctgcaccatctcgtcttcatccttcccgctac

SEQ ID NO: 127887 - DNA, 484 bp, Homo sapiens
  misc_feature: GYAE6OF02HJCRC.45.87.H10.1.454.CMB.1.raw
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
  modified_base (473)..(484): a, c, t, g, unknown or other
  misc_feature (473)..(484): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggaccctgaggtattttgcctatttactactgtcagcagcgtggcgaccgagcgctcacgtttcgggacgaggggacccaagggtcggagactacgaaacgactgtggctgcacatctgtctcattccttcccgcatctgactcgatcgcgtcngcgcggctggcgacggcncagtgnnnnnnnnnnnn

SEQ ID NO: 127888 - DNA, 518 bp, Homo sapiens
  misc_feature: GYAE6OF02GUQ18.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcagtgggtctggggacagacttcactctcaccatcagcagcctggaccctgagattttgcctatttactactgtcagcagcgtggcgaccgagcgctcacgtttcggcggagggaccgaagggtggagatacgaaacgacgtgtggctgcaccatctgtcttcatccttcccgctacg

SEQ ID NO: 127889 - DNA, 522 bp, Homo sapiens
  misc_feature: GYAE6OF02HTCA2.45.87.H10.1.454.CMB.1.raw
  modified_base (519)..(519): a, c, t, g, unknown or other
  misc_feature (519)..(519): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacaggggccactggcatcccagccaggttcagtggcagtgggtctgggacagacttcactctcaccatcagcagcctggaccctgaggtattttgcctatttactacttgtcagcagcgtggcgaccgagcgctcacgtttcggcggagggaccgaagggtggagatacgaacgactgtggcgtgcaccatctgtcttcacttcctcccgcctntcg

SEQ ID NO: 127890 - DNA, 472 bp, Homo sapiens
  misc_feature: GYAE6OF02FKF15.45.87.H10.1.454.CMB.1.raw
  modified_base (458)..(458): a, c, t, g, unknown or other
  misc_feature (458)..(458): n is a, c, g, or t
  modified_base (463)..(472): a, c, t, g, unknown or other
  misc_feature (463)..(472): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggacccctgaggattttgccatttactactgtcagcagcgtggcgaccgagcgctcactttcggcggagggaccaaggtggagatcaaacgaactgtggctgcaccatctgtcttcatcttcccgccatctgatcgatcgcgtctgagcggctggcaaggcgnatagnnnnnnnnnn

SEQ ID NO: 127891 - DNA, 486 bp, Homo sapiens
  misc_feature: GYAE6OF02IL8RC.45.87.H10.1.454.CMB.1.raw
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (474)..(486): a, c, t, g, unknown or other
  misc_feature (474)..(486): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaaacctggccaggctcccaggctcatcatctatgacgcatcgaacagggcccactggcatccccagccaggttcagtggcagtgggtctggggacaggacttcactctcaccatcagcagcctggacccctggaggattttgccattttactactgtcagcagcgtggcgaccgagccgctcactttcggcggagggaccaaggtggagatacaaacgactgtggctgcacntctgtcttcatcttcccncntctgntcgatccgcgtcgtgacgcggctggcagggcgacgagtagnnnnnnnnnnnnn

SEQ ID NO: 127892 - DNA, 479 bp, Homo sapiens
  misc_feature: GYAE6OF02GY8EI.45.87.H10.1.454.CMB.1.raw
  modified_base (288)..(288): a, c, t, g, unknown or other
  misc_feature (288)..(288): n is a, c, g, or t
  modified_base (389)..(389): a, c, t, g, unknown or other
  misc_feature (389)..(389): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
  modified_base (468)..(479): a, c, t, g, unknown or other
  misc_feature (468)..(479): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaaacctggccaggctcccaggctcatcatctatgacgcatcgaacagggccactggcatcccagccaggttcagtggcagtggtctgggacagacttcactctcaccatcancagcctggaccctgagtatttcgcctatttacactgtcagcagcgtggcgacgagcgctcgactttcggcggagggaccaagggtggagatcaaagactgngctgcacatctgtcttcacttccttccgctactctagactcgactcgcgtctgacgcgggtcnggacgaggcgnagtgnnnnnnnnnnnn

SEQ ID NO: 127893 - DNA, 535 bp, Homo sapiens
  misc_feature: GYAE6OF02JZFNP.45.87.H10.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgctactctggctcccagaaaccattggagaaatactgatgacgcagtttccagccaccctgtctgtgtctccaggggaaanagccaccctctcctgctgggccagtcagatgttagcaaccacttagcctggtaccagcagaacctggccaggctcccagactcctcatttatggttcttctaccagggccntggtactcccagccaggttcagtgccaggtggtctggggacaggagttcactcgtcaccatcagcagcctgcagtctgaagtatttgctagtttattctgtcagtctagtatactatacgtgtctgtactagtttcggaccgtagggaccaagctaggaactacgaacgtacgtgtgtacgtcgactaccgactcgtacgttcttactacttccttacccg

SEQ ID NO: 127894 - DNA, 548 bp, Homo sapiens
  misc_feature: GYAE6OF02ISC8H.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagatttgacgacacggccatttattctgtgcgagagtcggccgtgcgggtctacttcgactacgtggggccagggaacccaggtcaccgtctcctcacgccctccaccacgggcccagtccggtccttcccctcggccctacccctcctcccaacgacgccacccgtcgtcgggggccaccgacgcccggcccgtcgggcctcggcccgttcggtacctaacggg

SEQ ID NO: 127895 - DNA, 635 bp, Homo sapiens
  misc_feature: GYAE6OF02G4AHQ.45.87.H10.1.454.CMB.1.raw
  modified_base (431)..(431): a, c, t, g, unknown or other
  misc_feature (431)..(431): n is a, c, g, or t
tcagacgcgatcgacacgaccggtgctcgatttagcagtactgcgttgggtttgggggaactgctcagttaggacccagagggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggctcctcatctatggtgcatcctccagggccctcgtggtcgtccccgcctaggttcaggtcggcagggtgggtcgtggggacaggtagttccactcctaccacccgatccagccaacgtcccctgcctaggttcctaggaaacgttnttttcggacgttaatttttaacttatttcggtacttgtaccttaagtttaataaacgttagtccgttcgggtaccccttaggggtaccgtttcccgggacccgaagggggtacccgttaggggtttacgaaaacttaccggaaaacggttaaccttggtcggtacctacggacctacctacgttcgtacgtttccttactaccg

SEQ ID NO: 127896 - DNA, 521 bp, Homo sapiens
  misc_feature: GYAE6OF02H47RU.45.87.H10.1.454.CMB.1.raw
tcagacgcgatcgacacgaccggtgctcgatttagcagtactgcgttgggtttgggggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccgctcctcatctatgatgcttccagcagggcccatggcatcccagccaggttcagtggcggttgggttgcacagtacttcactctacacaatcagcagcctccaacctgaagtatttgctagtacttatttactgtcaacagacgtacagtattggccgtctcgtacgtttccgggcggtacgggaccgaggtggacgagtacaaacgtacgtaggtagtcgtgacacctatcgtgtcttac

SEQ ID NO: 127897 - DNA, 736 bp, Homo sapiens
  misc_feature: GYAE6OF02FEKP5.45.87.H10.1.454.CMB.1.raw
  modified_base (239)..(239): a, c, t, g, unknown or other
  misc_feature (239)..(239): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctccagataccaccggagaattgtgttgacacagtctccagcctacccttgttctttgttccgaggggaaacacgccaccctctcctgcgagggccagtcgtaggtntaacagtctactacgctacggtaccaaaccgaaactcggaccacggcctcccgaggcctcacttcatctatcgacctacacgtacgaacgacggacctacgtcgacctacgtaccgacgaccgtaggttacgaggtcggacgtagggtcggtacgtacgggacctacgtaccttaccacgttacctaccaccgtacgtacgacgtaccgtaccgtccgtacggtaccgttaggtacgtttactttacgtacctttaacgttacctacgttacgtacgacggtaccgtacggtcccggtacgggacccgtacggtccgtaccggtacgttaccggtacggggttaccggggaacgggtaaccgggtaacggtaaggggtacaaacggtactaaccggaacggttcgtacggtcggtaaccgtcgtaacccttacgttacgttaccgtttaccgttacccttacccgttacctttaccccggtacgtacgtttaaccgg

SEQ ID NO: 127898 - DNA, 547 bp, Homo sapiens
  misc_feature: GYAE6OF02JIF8J.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctgccaggctcccaggctcatcatctctggtgtatctaccagggccactggtgtcccagacaggttcaagggcagtgggtctgggacagagttcactctcaccatcagccggcctgcagtctagaagtattttggacttttattacttgttcagctagtataatctactggccgttactacgttttcgggccggggtaccaaggtccgtagggagtataccgaaacgaacgtgtggcctgcaccatcttgtcttacattccttcccgctactctgtactcg

SEQ ID NO: 127899 - DNA, 529 bp, Homo sapiens
  misc_feature: GYAE6OF02HDM21.45.87.H10.1.454.CMB.1.raw
  modified_base (432)..(432): a, c, t, g, unknown or other
  misc_feature (432)..(432): n is a, c, g, or t
  modified_base (526)..(526): a, c, t, g, unknown or other
  misc_feature (526)..(526): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcaggtgggtctgggacagacttcactctcaccatcagcagcctggaccctgaggtatttgcctatttactactgtcagcagcgtggcgaccgngccgctcacgtttcggcggagggaccgaagggtggaacgataacgaacgtaacgtgtaggctgacactatctgtcttctactccttcccgcctntcg

SEQ ID NO: 127900 - DNA, 531 bp, Homo sapiens
  misc_feature: GYAE6OF02GHG8B.45.87.H10.1.454.CMB.1.raw
  modified_base (233)..(233): a, c, t, g, unknown or other
  misc_feature (233)..(233): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtnttaacagctacttagcctggtaccaacaaaaacctggccaggctccaggctcatcatctatgacgcatcgaacagggccactggcatcccagccaggttcagtgcaggtggtctgggacagacttcactctcacatcagcagcctggaccctgaggtatttcgcctatttactatgtcagcagcgtggcgaccgagcgctcacgttcggcggacgggacgaagggtggaagacgtacgaaacgacgtgacggcgtgaccactagttcctgttcttctacttccttcccgtctacttcg

SEQ ID NO: 127901 - DNA, 520 bp, Homo sapiens
  misc_feature: GYAE6OF02GSGIH.45.87.H10.1.454.CMB.1.raw
  modified_base (200)..(200): a, c, t, g, unknown or other
  misc_feature (200)..(200): n is a, c, g, or t
tcagacgcgatcgacacgaccggtgctcgatttagcagtactgcgttgggtttgggggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagagtattagaacatacttggcctggtatcaatacaagcctggccagggtccccgctcctcatctatgatgcttcagcagggccactggcatcccagccaggttcagtggcggtggttgcacagacttcactctcacaatcagcacgccctacaacctgaagtattttgctagtctattactgtacaactagcgtacagtattcgccgtctcgtacgtttcggacggtagggacctagggtggacgatacgaaacgactgtcggctgacacagtctgtctcattcctccgctac

SEQ ID NO: 127902 - DNA, 517 bp, Homo sapiens
  misc_feature: GYAE6OF02GLV73.45.87.H10.1.454.CMB.1.raw
tcagacgcgatcgacacgaccggtgctcgatttagcagtactgcgttgggtttgggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggaccctgagtatttgcctatttactactgtcagcagcgtggcgaccgagcgctcactttcggcggagggaccgaagggtgagagtacgaaacgactgtggctgcaccatctgtcttcacttcctcccgtctactcg

SEQ ID NO: 127903 - DNA, 801 bp, Homo sapiens
  misc_feature: GYAE6OF02JSO7H.45.87.H10.1.454.CMB.1.raw
  modified_base (342)..(342): a, c, t, g, unknown or other
  misc_feature (342)..(342): n is a, c, g, or t
  modified_base (434)..(434): a, c, t, g, unknown or other
  misc_feature (434)..(434): n is a, c, g, or t
  modified_base (471)..(471): a, c, t, g, unknown or other
  misc_feature (471)..(471): n is a, c, g, or t
  modified_base (596)..(596): a, c, t, g, unknown or other
  misc_feature (596)..(596): n is a, c, g, or t
  modified_base (613)..(613): a, c, t, g, unknown or other
  misc_feature (613)..(613): n is a, c, g, or t
tcagacgcgatcgacacgaccggtgctcgatttagcagtactgcgtgggtttgggtgcccaagctgctggaggagcgacggtcaccgacgcgtcgcgtggaggtaggaaaggaacgtccggtcgggttcccgttcgggtaggtaacggttcctcccgtggaaccgaacgggtcctttcggtagggacgggcaggttccttacgacgacctttaacccgttttcctatacgacgtcggttggggcgaccgacgacccggtccccgtaggaacggaaccgggtcctaggtacggtggaacggtagggaaagacgtccagtccgacgaaacggttcgttagaacncgaaggcaacgtaccgtcgtactacaagtaactcgacggacagtcaactattagtcgacgacacgactaccacgaccacacgtccaactagnggactcgtacggaagcctaccgagtaagttacgttanaaccgacgtaccggtacttagttttaacgttcgtacggtgaacggacgttagggtcccgaccggttcggacccggttactttaccggtacgacgtaaccggggtcggaccggaaacggtacccgnggtacctacccgttacnccacgtccgccccgtaacgaaccggaccgtacccgtcgtttcccggtttacccctacccgggtcccgaccctacccctacccgtaaccgaccgacggttaccccctacgggttaccgggtgggaaccccctagggaaccccgtcccggtccgggtaccggacccttcggttcccggagttaacccggg

SEQ ID NO: 127904 - DNA, 540 bp, Homo sapiens
  misc_feature: GYAE6OF02J0M3X.45.87.H10.1.454.CMB.1.raw
  modified_base (215)..(215): a, c, t, g, unknown or other
  misc_feature (215)..(215): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
  modified_base (533)..(533): a, c, t, g, unknown or other
  misc_feature (533)..(533): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagngtcatgccaagacttgatacagcagactacgctcagaaattccaggaccagtcaccattaattgcgacacatccacgaccacagcctacatggagctgagaagcctgagatttgacgtacacggcctatttattctgtgcgagagtcggcgtagcggctacttcgacgtacgtcgggcctacgggaacccaggtcgacccgtctcctccgacgcctccaccgaacggcccacgtccggtaccttccccgtcgacctacccgtcctccaacgcgtcaccctcgcgggcnccgacgccggcccnggccgtcgcgtccgtntaaccgg

SEQ ID NO: 127905 - DNA, 617 bp, Homo sapiens
  misc_feature: GYAE6OF02HODI7.45.87.H10.1.454.CMB.1.raw
  modified_base (220)..(220): a, c, t, g, unknown or other
  misc_feature (220)..(220): n is a, c, g, or t
  modified_base (396)..(396): a, c, t, g, unknown or other
  misc_feature (396)..(396): n is a, c, g, or t
  modified_base (425)..(425): a, c, t, g, unknown or other
  misc_feature (425)..(425): n is a, c, g, or t
tcagacgcgatcgacacgaccggtgctcgatttagcagtactgcgttgggtttggggagggaactgctccacgttagggtacccaggagggaaccatggtaagccccagctcagcttctcttcctcctggcactctggctcccagtagtaccaccgggagaaatttcggttgtttgacactagttacgtccagccaccctgtctttgtttccagggaagngcaccctctccgtgctagggccagtccaggggtcttaacgagctacttacgccttggtaccaacaaaacctgccaggcctccaggctcgtatcatctatcgacgcactcgaacaggtccagtggccactccagcctagttcagtcggcaggtggtctgggacagtacttcgaatcncactaatcagctacgcctagacctgagtntttcgcctaagttactactcgtacacgtcacgtcgtggccgtacgacgtccgctacgtaccgttcggcggtacggaccgtaagggtcggacgacgtaccgaaacggtacttcggttacggacggttacgacggtaaccgtagtaccggtacgttccgttaccgttacgttcccgttacccggcccttaacgg

SEQ ID NO: 127906 - DNA, 579 bp, Homo sapiens
  misc_feature: GYAE6OF02GK8DT.45.87.H10.1.454.CMB.1.raw
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
tcagacgcgatcgacacgaccggtgctcgatttagcagtactgcgttgggtttggggaggaactgctcagttaggacccagagggaaccatggaagccccagcgcagcttctcttcctcctgctactctggctcccagataccaccggaaaaattgtgttgacacagtctccaggcaccctgtctctgtctccaggggagacagccacctctcctgccagggccagtaggagtgtcagtaagtacttaggctggtaccaacagaaacctggccaggctccaggctcctnatccatgatgcatccaacnggtccctggctccagacaggttccgnggcaggtcggtctgggacagacgttcactccgtcaccgtgaacgcctaggcctggacgccgtagactgtagttttcgactacgtttacttcgtcgtcagtctagtcgttccgcgtacgccgtctcgtaccgtttcgggaccgggggtacctaggggtcggaagtacgtcggacgtacgtacgtcggtcggtcgtacgcgaaccgtagtcgtcggttcttccgtacgttccgttacccgccgtacg

SEQ ID NO: 127907 - DNA, 535 bp, Homo sapiens
  misc_feature: GYAE6OF02HT6R7.45.87.H10.1.454.CMB.1.raw
  modified_base (213)..(213): a, c, t, g, unknown or other
  misc_feature (213)..(213): n is a, c, g, or t
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
  modified_base (418)..(418): a, c, t, g, unknown or other
  misc_feature (418)..(418): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttccatcagctgggtgcgacaggcccctggacaagggcctgagtggatgggaanagtcatgccaagacttgatacagcagactacgctcagaaattccaggaccgagtcaccattattgcggacacatccacgaccacancctacatggagctgagagcctgagattgacganacggcatttattctgtgcgagagtcggccgtgcgggctacgtcgactacgtgggccgaggacccgaggtcaccgtctcctcagccnccaccgacggcccacgtccgtccttcccccgtgtcccacccgtccctccaacgacgcacccgtcgtcggggccaccgacgccggcccgtcgggccgtcgccgtcggtaccgtaacgg

SEQ ID NO: 127908 - DNA, 646 bp, Homo sapiens
  misc_feature: GYAE6OF02H2LV9.45.87.H10.1.454.CMB.1.raw
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
tcagacgcgatcgacacgaccggtgctcgatttagcagtactgcgttgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcanaaatcaggacgagtcacatattgcganacatcacgacacagcctacactgganctagagaagcctgaagtatttagacgtaacaccgggcctaagttttaactttctacgtgtaccggaagtaacggtcgggtcccggtttggccggggtaccttaccggttacgaccgttacgtaggggtcccggaaggggaaccccgaggtcccgtaaccggtacctccgtaccacgtccctaccgaacccgaaaccgggtacccccaagttcccggtacccgtttccccccgtaggtcccctacccctcccgttaccaaccgacgtccgtaccgttcggggaccctaccgacggacccggcccgttcgggcctccggccgtcggttccgaaggttaacccg

SEQ ID NO: 127909 - DNA, 644 bp, Homo sapiens
  misc_feature: GYAE6OF02IQRD9.45.87.H10.1.454.CMB.1.raw
  modified_base (153)..(153): a, c, t, g, unknown or other
  misc_feature (153)..(153): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (527)..(527): a, c, t, g, unknown or other
  misc_feature (527)..(527): n is a, c, g, or t
  modified_base (619)..(619): a, c, t, g, unknown or other
  misc_feature (619)..(619): n is a, c, g, or t
  modified_base (625)..(625): a, c, t, g, unknown or other
  misc_feature (625)..(625): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
tcagacgcgatcgacacgaccggtgctcgatttagcagtactgcgttgggtttgggggtagggaacgtggctcagttaggacccagagggaaccatggaagcccagctcagcttctcttctcctggcactctggctccagtcaggtgttaacngctacttagcctggtaccaacaaaacctgaccagctccaggctcatcatctaatnacgcatcgaacnggccatggacatccagccaggttcagtcggacaggtcggtcgtagggactacggactttcacttcgtacaacccagttacaggcacggccgttcggaccccgtggaacggttacttttcggaccccttaattttaccgtaaccttgggttaccaggtacctaaggtcggtccggtacggaacccggtacggcgtccctacgttaccgtttcggggaccgggtacgggaaacccggaaggtgggaagtcctaaacgaacgtaacgtgtacggtacgtcgaccgacgtacgtcgtacggtcttaccgtnttacccgttaccgcctagtccgtagtactcggacttacgccgttacgcgtacggtcggtcggtacggacgtacggcctagtccgtagacgtnctacgnacgctaagtcntacgntcg

SEQ ID NO: 127910 - DNA, 611 bp, Homo sapiens
  misc_feature: GYAE6OF02IPN5R.45.87.H10.1.454.CMB.1.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (339)..(339): a, c, t, g, unknown or other
  misc_feature (339)..(339): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttcagcaggccactggcacctcgacgccgtaggtcagggnggtcgggttgggttcgacagtacgtactcgacttctacaacaactcgacgactacgtccctaaccgaaccgtagaacgtttcttacgaccgttattacttaacgtttcgttacgtaccaacgtacgtaccgttaacgtagtcgtttaccggcctaccgttacgttaccggtttacgggaccgggtaacggaaccgtagggtacggacgttaacgtaacggaaacggtacgtcggtaggactacggtccaaccgttatcgttcgtacttaccg

SEQ ID NO: 127911 - DNA, 537 bp, Homo sapiens
  misc_feature: GYAE6OF02JA6LJ.45.87.H10.1.454.CMB.1.raw
  modified_base (419)..(419): a, c, t, g, unknown or other
  misc_feature (419)..(419): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagatttgacgacacggccattttattctgtgcgagagtcggccgtgcgggctacgttcgactactggggccagggaacccaggtcacgtctcctcncgcctccaccaaggcccatccggtccttccccctggccaccctccctaccgaacgacgccaccgtccgtcggggcctaccgacgccggcccgtcgggcctcggccctggtctaacggg

SEQ ID NO: 127912 - DNA, 690 bp, Homo sapiens
  misc_feature: GYAE6OF02IV99Q.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtcttgtttccagggaaagagccaccctctcctgcaggccagtcagggtgttaacagctacttagcctggtaccaacaaaacctggaccaggcctcccaggcctacgactcattactacgtgaccgcatcgaaacacgggccaacgtcggacactcccgagccgtaggttcagtcggacgaggtggtcgtaggacagacttcgactcacacctatacgacgcaacgccgtacggacccttaggtacggtactttttcggacctacgttttaaccgtacgttacgttaccacggtacacggttacggttcggaccggtaaccggtacgcccgtaccgtccgtaaccggttttaccggacggggtaacggggaaccgtaaggggtcggaacggtacgtaaccgtaaaccggtaacggtcgtttacgggacgttaccgggaaccttaacccggacttaaccggttcgttacccgtttacgtacccgttaccgtttacccccggcttaaccgg

SEQ ID NO: 127913 - DNA, 516 bp, Homo sapiens
  misc_feature: GYAE6OF02JDC75.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccgagccaggttcagtggcagtgggtctgggacagacttcactctcaccatcagcagcctgaccctgagtattttcgctatttactactgtcagcagcgtggcgacgagcgctcacgttcggcggacgggacgaaggtggagagtacgaacgacgtgcggctcgcaccatctgtctctactcctcccgcctc

SEQ ID NO: 127914 - DNA, 528 bp, Homo sapiens
  misc_feature: GYAE6OF02IABE1.45.87.H10.1.454.CMB.1.raw
  modified_base (203)..(203): a, c, t, g, unknown or other
  misc_feature (203)..(203): n is a, c, g, or t
  modified_base (373)..(373): a, c, t, g, unknown or other
  misc_feature (373)..(373): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaccaaacaaaaacctggaccaggctcccaggctcatcatctatgacgcatcgaacaggggccactggcatcccagccaaggttcagtggcaggtggtctggggacagacttcactcncacatcagcagcctaggaccctgaggtattttgcctatttactactgtcagcagcgtggcgacgagcgctctacgtttcggcggagggaccgaagggtggagatacgaacgagtggtggctgacaccatcgtcgtcttcgactccttcccgctac

SEQ ID NO: 127915 - DNA, 933 bp, Homo sapiens
  misc_feature: GYAE6OF02H634S.45.87.H10.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (444)..(444): a, c, t, g, unknown or other
  misc_feature (444)..(444): n is a, c, g, or t
tcagacgcgatcgacacgaccggtgctcgatttagcagtactgcgttgggtttggggaggaactgctcagttaggacccagagggaacatggaagccccagctcagcttctcttcctcctgctactctggctcccagataccaccggaaaaattgtgttgacacagtctccaggcaccctgtctctgtctccgaggggganacacgcccaccctctcctgcacgggccaggtaggagtgtcaagtaagtacttaggctggtaccaanagaacctggccaggctccaggctcctnatccatgatcgacatccgaacgacgggttccctagggccgtacccgaaggtaccgacgggtttcccgtgggacctaagggttcggggaccgttacggggggaacctagggtacggtttacccaaccgttccgtaccgtaaccccgggttnaaacggtcccgaacggtcccggtttaggggacccggtacccgttagggtacgttttacgggttaacgtttttttacgggaaccgttttaaacggttttttaacccgtttaccgtttacggttttaccggtaaaccgggttacccgttaaaccgggttccccgggttttacccccggtaccccgtaaaccccgggtcccccgggtacccgtttacccggttaaaccccggggtttttcccggggggggaaccccggggggggggttaaacccggtacgggggggtttaaaccggggtaacgggtaaacgggttaccggggtaaaccgggttaaacccggggtaaccggtttccgggggttaacggggtcccggttaacccgggtaacccggtaaccccggtttaaccgttcccgggttttacggtttacccggttttaacccgttaacccggttttccccgttttacccccccggtaccgtttaacccgg

SEQ ID NO: 127916 - DNA, 599 bp, Homo sapiens
  misc_feature: GYAE6OF02GGS7A.45.87.H10.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagacgcgatcgaccacgaccggtgctcgatttagcagtactgcgttgggtttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtcttaggctggtaccaanagaaacctggccaggcctcccaggctcctcatccatgatgcatcccaacgacgggtccctgggccgtccccagaccgagggttccgtggcaggtgggtctggggacaggacgttcactctcaccgtcagcacggcctggacgctgatgtatttgcttagtttacttctgtcagtcacgtccgttccgccgccgccgtctcgtaccggtttcggggccggggggtaccgaggggtacgggaggagtcggacgtacggtacgttcgggtcggtcgtcggaccgtaccgtacgttccgttcggttccttaccgtaccgtttcccgttaccccgtccgtacg

SEQ ID NO: 127917 - DNA, 541 bp, Homo sapiens
  misc_feature: GYAE6OF02HUYLW.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatccccagccaggttcagtggcagtgggtctgggacagacttcactctcaccatcagcagcctggaccctgaggtattttcgcctatttactactgtcagcagcgtggcgacgagccgctcacgttcggcggagggaccaagggtcggaagatacgaacgacgtggtcggctcgacaccgtaactcgttacgttccttctacttccttcccgaccttacg

SEQ ID NO: 127918 - DNA, 745 bp, Homo sapiens
  misc_feature: GYAE6OF02H8NC3.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagccgtgggtcctcggtgaaggtctcctgcaaggcttcgtggaggcagcttcagctaactttcctatcagcgtgggtgcgacgacggccctggacgaacggcctgagtggagtgggaagagtcagtcgaccaagtacttagaactacgagcagactaccgctacagtaaacttccgaacggtaccgagtcaacctattagttcggacgaacacgactccaaccgaccacgacgacctacagtacggagctagagaacgcgtagagtattcggaacgaccgaccggtaccttaatttactttcgtgtcgcggtagtacggtccgggtccggtcgggccgggtcttaccgttcgaaccgttacgggtccggggaccgaacggggtaaccccgtacggggttaccctaccccggttacctcccgttaccgacgtcccctaacccgaacccggaaccgggtaccccgtacgttcccggttaccccgtttccccgtcccggtacccctaccccgttaccctacccgtaaccggaccgtccccgtaccggttcccgggttaccgggggacctaacccggaccggtcccgggtaccccggttcggggtcccgttccggggaccccggtttcggtaacccggtaacccggg

SEQ ID NO: 127919 - DNA, 525 bp, Homo sapiens
  misc_feature: GYAE6OF02IP267.45.87.H10.1.454.CMB.1.raw
  modified_base (494)..(494): a, c, t, g, unknown or other
  misc_feature (494)..(494): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggaccaggctcccaggctcatcatctatgacgcatcgaacagggccacgtggcatccccagacaggttcagtggcagtggtctgggacagacttcactctcaccatcagcagactggagcctagaagtatttgctagtgtattactgtacaactagtatgtacctctacctttcgtcttccggcctcggacctaagtcgtaatatacaaacgtactgtagcgtnacacatctgttctctattcctcccgctatcg

SEQ ID NO: 127920 - DNA, 576 bp, Homo sapiens
  misc_feature: GYAE6OF02JCPAS.45.87.H10.1.454.CMB.1.raw
  modified_base (201)..(201): a, c, t, g, unknown or other
  misc_feature (201)..(201): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (563)..(563): a, c, t, g, unknown or other
  misc_feature (563)..(563): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggcctaggtcagagtattagaacatacttggacctggtatcaatacaagcctggccagggtccccgctcgtcatctatgactgcttcagtcagggccactggcatccgagccaggttcagtggcgttggttagcacgagtacttcacgtctnacagtcagcagtcccnctaactgtaaagtntttggacctagtactttaacttacgtagtacaaactagaccggttaacaggtatttcgggaccgtccttaacggtaccttttcggaccgggttaaggaccctagggttacgggaacttaacgtacgaaaacggtcttaggtacggacttggccaaccgtntaccgtcgttaac

SEQ ID NO: 127921 - DNA, 486 bp, Homo sapiens
  misc_feature: GYAE6OF02G9RY0.45.87.H10.1.454.CMB.1.raw
  modified_base (348)..(348): a, c, t, g, unknown or other
  misc_feature (348)..(348): n is a, c, g, or t
  modified_base (409)..(409): a, c, t, g, unknown or other
  misc_feature (409)..(409): n is a, c, g, or t
  modified_base (430)..(430): a, c, t, g, unknown or other
  misc_feature (430)..(430): n is a, c, g, or t
  modified_base (434)..(435): a, c, t, g, unknown or other
  misc_feature (434)..(435): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (477)..(486): a, c, t, g, unknown or other
  misc_feature (477)..(486): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagtcagggtgttaacagctacttagcctggtaccaacaaaaacctggccaggctcccaggctcatcatctatgacgcatcgaacagggccactggcatcccagccaggttcagtggcaggtgggtctgggacagacttcactctcaccatcagcagccctggaccctggaggtattttcgcctatttacactgtcagcagcgtggcgacgngcgctcacgtttcgggcggaggaccaagggtcggagactacgaaacgactggtgctgcacntctgtctcactcctcccgctntctnntcgatcgcgtctggacgtcggcgtggacgagggcgnagtncnnnnnnnnnn

SEQ ID NO: 127922 - DNA, 513 bp, Homo sapiens
  misc_feature: GYAE6OF02GU1ZJ.45.87.H10.1.454.CMB.1.raw
  modified_base (420)..(420): a, c, t, g, unknown or other
  misc_feature (420)..(420): n is a, c, g, or t
  modified_base (463)..(463): a, c, t, g, unknown or other
  misc_feature (463)..(463): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagatttgacgacacggccatttattctgtgcgagagtcggccgtgcgggctacgttcgactactggggccaggggaacccaggtcaccgtctcctcngcctccacacggccatcgtctcccctgcaccctcctccagacncaccgtctcggggcacacgccggccctgggcctcggccgtggtccaacgg

SEQ ID NO: 127923 - DNA, 538 bp, Homo sapiens
  misc_feature: GYAE6OF02I9OOP.45.87.H10.1.454.CMB.1.raw
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
  modified_base (424)..(424): a, c, t, g, unknown or other
  misc_feature (424)..(424): n is a, c, g, or t
  modified_base (464)..(464): a, c, t, g, unknown or other
  misc_feature (464)..(464): n is a, c, g, or t
tcagacgcgatcgacacgaccggtgctcgatttagcagtactgcgttgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaanagtcatgccaagacttgatacagcagactacgctcagaaattccaggaccgagtcaccattattgcggacacatccacgaccacagcctanatggagctgagaagcctgagatttgacgacacggccagttttattctgtgcgagagtcggccgtggcgggctacgttcgactacgtggggccagggaacccaggtcaccgtctcctcngccctccgaccgaggcccatccggtccttccccgtcgccnccctcctccaacgcgccaccgtcgtcggggccacgacgccggcccgtcgggcctcggccgttggacgtaaccgg

SEQ ID NO: 127924 - DNA, 551 bp, Homo sapiens
  misc_feature: GYAE6OF02F456J.45.87.H10.1.454.CMB.1.raw
  modified_base (371)..(371): a, c, t, g, unknown or other
  misc_feature (371)..(371): n is a, c, g, or t
  modified_base (482)..(482): a, c, t, g, unknown or other
  misc_feature (482)..(482): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggaccaggcctcccaggctcatcatctatgacgcatcgaacacgggccacgtggcactcccagccaggttcagtggcaggtggtctgggacagacttcactcncacatcagcagcctaggaccctgacgtatttcgcctatttactactgtacagcagtcgtggtcgaccggagccgtctcgtacgttcgggacggacgggaccgagggtgganacgtaacgaacgtactggtacgcgtcgaccaccgtatccgttgtccttctaccttcctcccgtctatcg

SEQ ID NO: 127925 - DNA, 610 bp, Homo sapiens
  misc_feature: GYAE6OF02JZOO9.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaacttaccacggacgacgtcacattatgcgtacacatccacgaccacacgcctacactaggacgctagagaacgcctgagtagtttacggacgacgacggcctaattttatttctagtcgacgtagacggtcggccgtggcgggtcttacgttacgacgtacgtcggggaccgacgggtaacccgacggtccacccgtctcctccgacgtccctccaccgaaccggcccacgtccggtccttccccgtcgccctacccgtccctaccgaaccgtacgaccacccgtccggtcggggaccaccggaccgcccgggtacccggtcgggtccgttcggtcccgttcgggtaccgtaaccgg

SEQ ID NO: 127926 - DNA, 612 bp, Homo sapiens
  misc_feature: GYAE6OF02GXZSS.45.87.H10.1.454.CMB.1.raw
  modified_base (202)..(202): a, c, t, g, unknown or other
  misc_feature (202)..(202): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaangccaccctctcctgcagggccagtcagggtgttaacagctacttagcctggtaccaacaaaactggccaggcctccaggctacatcatctatgacgcatcgaacacgggccacgtggccactcccaggccaggttcaggtggacaggtgggtctggggacagtaccttcgaactctacacctatcagcacgccgtacggaccctggtacggtattttcgaccttatttactacgttgtacacgcgtacgcggttggccgacgacgccgtcttcgtaccgtttcgggacgggtacgggaccgtaagggtcgggaacgaacgtaaccgaaacgtacgttacggtacggtacgtacggacctaaccgtagtcgttacgttccttacgactttcccgttaccccgccttaaccg

SEQ ID NO: 127927 - DNA, 605 bp, Homo sapiens
  misc_feature: GYAE6OF02HXTTB.45.87.H10.1.454.CMB.1.raw
  modified_base (495)..(495): a, c, t, g, unknown or other
  misc_feature (495)..(495): n is a, c, g, or t
tcagacgcgatcgacacgaccggtgctcgatttagcagtactgcgttgggtttgggggcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgcaaggcttcgtggaggcagcttcagctaacttctatcagctgggtgcgacacggcccctgggacaacggggcctgaggtggagtgggaagagtcagtgccaaagacttgatacagcaagactacgctcaagtaaaactttccgaacggaccggagtcctaacctaagtttaattcggacggaactaacgactacccaacgtacccaacgacgaccctacaatagggacgcgttaggaagaacgtcctaggaacgtntttacggactaacgaccgtaccttattttacgtttacgtgtggaccggtaagtacgggtccgaccgggttggcccggggtacttacccggttaccggtacttaaccgggg

SEQ ID NO: 127928 - DNA, 595 bp, Homo sapiens
  misc_feature: GYAE6OF02I2VGR.45.87.H10.1.454.CMB.1.raw
  modified_base (176)..(176): a, c, t, g, unknown or other
  misc_feature (176)..(176): n is a, c, g, or t
  modified_base (306)..(306): a, c, t, g, unknown or other
  misc_feature (306)..(306): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtncgacaggcccctggacaagggcctagagtggatgggaagagtcatgaccaagacttgatacagcagacacgctcagaatacagacgagacacattatgacggacacactacacgaccacagcacataganctagagagactgagtagttagacgacacgggggacctatttaacgtttctagtgtacgagtagtcggtcgtcggcggtacgtacgttacgtacgtacgtcgggacgaacggaaccgacggtacgtaccgtcctacctcgacgccgtaccgacgaccggaccacgtccgtaccgttcccgtaccgaccgtaccctacccgtacccgtaaccgacgaccgtaccgtccggtaccgggacgaaccgacgtcccggacccggtcggccgttccgaccgtcggtacgtaaccgg

SEQ ID NO: 127929 - DNA, 588 bp, Homo sapiens
  misc_feature: GYAE6OF02I02CI.45.87.H10.1.454.CMB.1.raw
  modified_base (177)..(177): a, c, t, g, unknown or other
  misc_feature (177)..(177): n is a, c, g, or t
  modified_base (217)..(217): a, c, t, g, unknown or other
  misc_feature (217)..(217): n is a, c, g, or t
  modified_base (474)..(474): a, c, t, g, unknown or other
  misc_feature (474)..(474): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaacttttcctatcagctgggtncgacacggcccctggacaagggcctgagtggatgggaagngtcatgccaagacttgatacagcagactacgctcagaaattccaggaccgagtcaccattatgcgacacatccacgaccacagcctacatggagctagagaacgctagagatttcgacgacacggacctattttacttctgtgacgagtaggtccggcgtgcggtctacgtcgactcgtgggccagggacccaggtccaccgtcctcctcacgtccctaccgaccgaacgggccctacgtccggttccttcccccgngggtacccaccccttcccgtaccaacgccgaccgtacccgtccggtacggggaccctaacggaccgcccgggtcccgtcggggcctacgggtcccgtgggtaccgtaaaccggg

SEQ ID NO: 127930 - DNA, 506 bp, Homo sapiens
  misc_feature: GYAE6OF02GQ9RQ.45.87.H10.1.454.CMB.1.raw
  modified_base (428)..(428): a, c, t, g, unknown or other
  misc_feature (428)..(428): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
  modified_base (504)..(504): a, c, t, g, unknown or other
  misc_feature (504)..(504): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggcccatcatctatgacgcatcgaacagggccactggcatcccagccaggttcagtggcagtggctggacagacttcactctcaccatcagcagcctggaccctgagtattttgcctattactactgtcagcagcgtgcgaccgngcgcctcacgtttcggcggacgggaccagggtgagatcaaacgactgtgctgcacntcgtgtctnctcctcccgcntc

SEQ ID NO: 127931 - DNA, 544 bp, Homo sapiens
  misc_feature: GYAE6OF02HNCYH.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaacttttcctatcagctgggtgcgacaggcccctggacaagggcctgagtggatgggaagagtcatgccaaagacttgatacagcagactacgctcagaaattccaggaccgagtcaccattattgcggacacatccacgaccacagcctacatggagctgagaagcctgagatttgacgacacggccatttaatttctgtgcgagagtcggcgtgcgggctactcgactacgtgggccagggaacccaggtcaccgtctcctcacgcctccaccaacgggcccacgtccggtccttcccccgtcgtccacccctcctacccaagacgccacccgtcgtcggggcaccgacgccggacccgtcgggcctcgcccgtcggtcctaaacgg

SEQ ID NO: 127932 - DNA, 663 bp, Homo sapiens
  misc_feature: GYAE6OF02H51BI.45.87.H10.1.454.CMB.1.raw
  modified_base (144)..(144): a, c, t, g, unknown or other
  misc_feature (144)..(144): n is a, c, g, or t
  modified_base (172)..(172): a, c, t, g, unknown or other
  misc_feature (172)..(172): n is a, c, g, or t
  modified_base (637)..(637): a, c, t, g, unknown or other
  misc_feature (637)..(637): n is a, c, g, or t
tcagacgcgatcgacacgaccggtgctcgatttagcagtactgcgtggtttgggggtaggaacgtgctcagttaggacccagagggaaccatggaagcccagctcagctctcttcctcctggcactctggctccagtcagggtnttaacagtctactagcctggtacctaanaaaaacctgccaaggctcccaggctacatcatctatgacgcatcgaacagggcacgtggcactccagccaggttcaggtcggcaggtcggtcgtgggacagtacttcgactctaccgaccatcagccacgcctagaccctgtacggtctttgcctaatttacactgtacgtatcgagtcggtcgaccgtaacggacgcgtacctacgtaccgttcgggaccgggtaacggaccgtaacgggttaggaacgtaaccgtaccgtaaacggtaacctacgggttaccgggtacggtaccggacgtaacccgtaacgtaccgttacggttacttaccgttaaccgtttccccgttacccgtacccgttaacttaccgtacggtacgttaccgtaacgtcccggtacgttccggttacggtacggtccgggtacggcggtaccgacggtaccggtcgtaacgtggtaacncgaatcaggtctcgagctcgatcgag

SEQ ID NO: 127933 - DNA, 612 bp, Homo sapiens
  misc_feature: GYAE6OF02H19XB.45.87.H10.1.454.CMB.1.raw
  modified_base (348)..(348): a, c, t, g, unknown or other
  misc_feature (348)..(348): n is a, c, g, or t
tcagacgcgatcgacacgaccggtgctcgatttagcagtactgcgttgggtttgggggcatcacataacaaccagattcctcctctaaagaagcccctgggagcacagctcatcaccatggactggacctggaggatcctcttcttggtggcagcagccacaggagcccactcccaggtgcagctggtgcagtcgtggggctgaggtgaagagccgtggggcctcgagtgaggtctcctgcaaggcttcgtggatacaccttcaccggctactatatacacgtggtgccgacacggccccgtggacgaagggtctaggagtggagtgggagtggactacaaccgtaanagtggtagacacgtaaactagtagcaactagtaagtttcgaagggacgtacggtcaccgtagtcgaaccgagggacaccgtacacgtcgacgcacgacgacctacgagtcggagcgtaggacgacgtagtcgtagacgtacgtcgacgaccggaccgaccggtaccggttaggtaaccgttaacggttccggtaggtaaccggacgggtaacggaccggtaaggttaacggttttaccggtttaggtttaagggtttaacgggg

SEQ ID NO: 127934 - DNA, 633 bp, Homo sapiens
  misc_feature: GYAE6OF02H1FQK.45.87.H10.1.454.CMB.1.raw
tcagacgcgatcgacacgaccggtgctcgatttagcagtactgcgttgggtttgggggcatcacataacaaccagattcctcctctaaagaagcccctgggagcacagctcatcaccatggactggacctggaggttcctctttgtggtggcagcagctacaggtgtccagtcccaggtccagctggtgcaatcgtggggctgaggtgaagaagcctgggtcctcggtagaaggtctccgtgcaaggtcttcgtggaggcagtcttcagctaactttcctatcagtcgtgggtgcgacgacggtccccgtggaccgaacgggcctaggacggtggagtaggggaagtagtcagtcgaccgtaaagtcgttgaatacagacacgaactacgctacgaagtaaactccgaaggacccgtagtaccacctaatttaagtacggacgaactacactacccaacgaaccaacacacctaacagtaggacgacgtaggaacgaacgccgtaggtacgttagtttacggaacgacgtacggtacctttatttacgtttcgtcggttcggtacgtacggtacggttccgggtccggttcgggtaccgggtacctttaccgttaccggtacgttaacccggg

SEQ ID NO: 127935 - DNA, 573 bp, Homo sapiens
  misc_feature: GYAE6OF02HOOPG.45.87.H10.1.454.CMB.1.raw
  modified_base (397)..(397): a, c, t, g, unknown or other
  misc_feature (397)..(397): n is a, c, g, or t
  modified_base (436)..(436): a, c, t, g, unknown or other
  misc_feature (436)..(436): n is a, c, g, or t
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccacgtcggcactccagccaggttcagtggcaggtgggtctggacagacttcactctcacatcagcagcctcggaccctgacggtntttgctatttactactgtcagcaggcgtcggccgaccgngcgcctctacgttcggcggtacgggaccgtaagggtcggaagacgtaacgaaacgtacgtaggtcggtaccgtcggacctaaccgtacttccgtcgttccgttacctaccgtttcccttacccgtacctacgtaccg

SEQ ID NO: 127936 - DNA, 759 bp, Homo sapiens
  misc_feature: GYAE6OF02ILVND.45.87.H10.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctccagataccaccggagaaattgtgttgacacagtctccagccaccctgtctttgtttccagggaangccacctctcctgcagggccagtcgagggttnttaacngtcttaacttacgcctaggtaaccaaaactaaaaaccgtggaccacggcctacccgaggtcctacactcactctatcgacncagtaccggaaacgacggggcccacgtcggacctaccttccccgaacggtcccgtaagggtttcaagggttcggacgtagggttcgggtacgttcggggaactacggtaccttcaccttctaccaaccgtatacgagtccaacggtcccgtacggtacccgtggtaacgttacgttttcgacctttaactttaccgtacgttcgtactagacgtaggtccgtacgggaccgtacccggacggtccgtaccgttaccgttaccggtttccggggaccgggtaacgggtaaccggtaaaggggtacggaacgtaaccgttaaccgaaacggttaccgttagggtaccggtacgttaccggtacctaaccgttaccgtttaccgtttaccggttttacctttaacctacccggttttacccccgttaccccggtaccgttaccg

SEQ ID NO: 127937 - DNA, 733 bp, Homo sapiens
  misc_feature: GYAE6OF02HT244.45.87.H10.1.454.CMB.1.raw
tcagacgcgatcgacacgaccggtgctcgatttagcagtactgcgtgggtttggtgcccaagctgctggagggcacggtcacacgctgctgagtgaagaagcctggtcctcggtgaaggtctcctgcaaggcttctggagcagcttcagcaacgtttcctatcagtcgtggtgcgacaggcccctaggacaagggcctaggagtaggagtagggaacgagtcaagtcgacctaagacgttgattacgagtacacgacgtacgctaccgagaaacttccgaggtaccgacgtacaccgtattacgttgcggtaccacgagttacccaggtacctaaccgcggtacctaacgagtcggacgtcgtagaacgtagtccgtggtaacgtatttcgaacgtacaccggtacttagtttacttcgtcgttacggacgtaacggtagtttcccgggccgttagggaccggttaccttaccgttttacggaaccgttacggttacgggaccgtaacgggtacctcgtacggttaccctacggtaccctccgttaaagcccggttaacctaccggaacccgttacggaccccttagggttaccccgtttacccggtcccgttacgacccgtttaacccgtacgtaccgtaacgtccgtaacccgtcgtacccggggtacgtaccgaacccgttggacccgggttccgtaccgggtcgttaacccggttcgtaccgtaaccgg

SEQ ID NO: 127938 - DNA, 564 bp, Homo sapiens
  misc_feature: GYAE6OF02HM6ZT.45.87.H10.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (357)..(357): a, c, t, g, unknown or other
  misc_feature (357)..(357): n is a, c, g, or t
  modified_base (424)..(424): a, c, t, g, unknown or other
  misc_feature (424)..(424): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaangccaccctctcctgcagggccagtcagggtnttaacagctacttagcctggtaccaaacaaaacctggccaaggctcccaggctcatcatctatgacgcatcgaacagggcccacgtggcactccccagccaggttcaagtcggcaggtgggtcnggggacaggtacttcactctacacatcagcagcctgacctgagtatttcgcctattactactgtcanactagcgtggcgacgacgcgctcctacgtttcggcgggacgggaccgaaggtcggagaactaccgaaacgacgtaggtacggcgtacgaccgaaccacgttacgttcgttcctactacttcgttaccccgtacctaaccg

SEQ ID NO: 127939 - DNA, 705 bp, Homo sapiens
  misc_feature: GYAE6OF02INYY1.45.87.H10.1.454.CMB.1.raw
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctccagataccaccggagaaattgtgttgacacagtctccagccaccctgtctttgtttccaggggaaagagccaccctctcctgcagggccagtcagggtgttaacngctacttagcctggtaaccaaacaaaaacctggaccaggcctcccaggcctcatcatctatcgacgacatcgaacnggggcccacgtggacactcccgagccctaggttcaaggtcggctaggtgggtcgtagggacagtaccttcgacttcgtacaccgtatccgaagccgagcccgtcggacctaggtagtcttttacgcttactttactacgtgtcacgtctacggtcgtcggacggaccgtagccgtacgtaccgttacggtttccgggacgggggtaaccgggtaaccggtaacggggttaacggggtaacgtaaacgtaacccgtaaaaacggtaccggttagggttaccgggtaacggttaccggaacccgtaacccgtaaccggtttacccgtttacggtttacccgtttacccgtaaaccgttttccccccggttaccccggttaccccttaaccgg

SEQ ID NO: 127940 - DNA, 850 bp, Homo sapiens
  misc_feature: GYAE6OF02JUDJZ.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaggcttctggaggcagcttcagctaactttcctatcagctgggtgcgacacggcccctggacgaacgggccgtgacggtggagtacggggaagacgtcagtacggccaaaggtcttaggaactacgagaccagtacctacggccttagaagaaacgttccaggacccgagtccaccatttatggccgacaccgatcccaacgaccaccagacctacgaatgggaactcggtagaacgtaacgcctaggtagtaacgttacggaccgaaaccggccggtaccttaagtttttacgtttacctggttacgacggtacgggtaggtcccgggtcgggtaccggtcggtaccggttaaccgtttaccggtaacccgttaccgggttaacgggggtaccccggtaaccgggggtaacccggtaaccggggttacccggtaccccggtttaacccgttcccgttaccccggtacgtacccccgttaacccgaaccccgggtaaccgggtaccccgttaaacccggtttcccggttacccccgtttcccccccggttaccgggtacccccttaccccgttacccccgttacccgaaccggttacccgtacccgtaccccggttcccgggtaaccggggttacccgaaacccgggtcccggtacccgggtcccgtacccgggggccgtttacccgggcccggtttacccgggtaccggtaacccggg

SEQ ID NO: 127941 - DNA, 527 bp, Homo sapiens
  misc_feature: GYAE6OF02GVVBV.45.87.H10.1.454.CMB.1.raw
  modified_base (433)..(433): a, c, t, g, unknown or other
  misc_feature (433)..(433): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacaggggccactggcactcccagccaggttcaggtggcaggtggtctgggacagacttcactctcaccatcagcagcctgaccctgaggtatttgcctatttactactcgtcagcagcgtgcgacgngcgctctacgttcgggcgacgggaccgaagggtcggagagtacgaacgtacgtgtacggctgacacagtcgtcgtcttcactcctcccgctacg

SEQ ID NO: 127942 - DNA, 695 bp, Homo sapiens
  misc_feature: GYAE6OF02G8VM8.45.87.H10.1.454.CMB.1.raw
tcagacgcgatcgacacgaccggtgctcgatttagcagtactgcgttgggtttggggcatcacataacaaccagattcctcctctaaagaagcccctgggagcacagctcatcaccatggactggacctggaggttcctctttgtggtggcagcagctacaggtgtccagtccccaggtccagctggtgcaatcgtggggctgaggtagaagaagccgttgggtcctcggtagtaaggtcctcctgcgaaggtccttcgtgggacggcagcttcagcctaactttcctaatccagtcgtgggtgacgacgacggccccgtaggaccgtaagggcctggaggtgggaagtggggaagtagtcgatacgccgaaagtactgaatacgagacagacctcgactacgaacgtaaacttcccgaaggtaaccgacgtaccaaccgttaattaacgttacggaccgtaacctaacgaaccgttaccccgaaccggaacccaacgtacgaccctaacgaagtacggacgtacgttaacggaacggtaacgtacccgtaggtaacgttagtttaccgaaacggtaaccgtaccgtaccttacgttttactttaccgtaggttcggtaccggtaggtaccgggtaccggtacccggttcggggtccggttacctttaccggtttaccggtacgttacccggggg

SEQ ID NO: 127943 - DNA, 745 bp, Homo sapiens
  misc_feature: GYAE6OF02H6FC3.45.87.H10.1.454.CMB.1.raw
  modified_base (241)..(241): a, c, t, g, unknown or other
  misc_feature (241)..(241): n is a, c, g, or t
tcagacgcgatcgacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccacatcaactgcaagtccagccagagtgtttagacagcnccaacaataagaactacttagcttggtaccagcagaaaccaggtcagccctacctaagcctagcctctattttacgtgggctactaccgtaacccggggaacgtcccgggggtcccctacggacccgtagttccgaggttcggaccgagggtccgggggttacgtcgggggtaaccgtaggttacgtttttaccctaaccgttacccttaaaccctacgtaccgaacggaccgaacggtccctaggaccgacgggtaccgttaaggaagtaacgttgggtagggtaccgtttaaggttttacgtttcggtctttacggtacgtaaggtacctaaagtttaattttaaagtttaactttaaccgtttaccccgtttacccgtttacccgtttttcccgggtaccccgggttaacggggtaaaccccttaaaaggggttaccggtaattaaccgtaaccggtaaaaccgttaaccgttcgggttacggtccgttacggtaaccccg

SEQ ID NO: 127944 - DNA, 856 bp, Homo sapiens
  misc_feature: GYAE6OF02H0D0T.45.87.H10.1.454.CMB.1.raw
tcagacgcgatcgacacgaccggtgctcgatttagcagtactgcgttgggtttgggggagaactgctcagttaggaccagagggaaccatggaagccccagctcagcttctcttcctcctggcactctggcctccagactaccgaccggagtaaattgtgttgacacagtctcacgccacctgtctttcgttccgaggggacacacgccctacctctccgtgcgacgggccaggtaggacgtgtacgaaggttaacgtacgttaggacttcggtaaccaaagtacgaaaccgttcggaccgacggtcctacccgaggtcctaccgtactacgtaccgtatacgagtcgtactacgttaaccgaacggtccgggtccccgtacgggacccgtacccgtaaggtaccgtacggtttccggtggtaccgtagggttccgggtcgttaagggacccttaggtacgttaccacgttacccgtaccgtacccgtcgtaagtaccgtaccggtccggtacgggccgtaccgttggtaaccgtttaggtttaacgtttttacgaaccgtttttaacggttttaccttaccggtacggtaccgttacgggtaaccgttaccgggtacccgtttacccggaacccggttacccggtccccgttaaccgttcccgtttaaccgggtttcccggggggaaccgggggttaaccgtagggggtaacgtaacggtccggtaaaggaaccgggtaaccggtacggtttaggccgggttaacgtccggtaaccctaaccgtttacggttaccgttcggttacccttttaccgtaccgttttacccccggttcccgttacgtaccggtttcgg

SEQ ID NO: 127945 - DNA, 742 bp, Homo sapiens
  misc_feature: GYAE6OF02GS5RF.45.87.H10.1.454.CMB.1.raw
  modified_base (411)..(411): a, c, t, g, unknown or other
  misc_feature (411)..(411): n is a, c, g, or t
tcagacgcgatcgacacgaccggtgctcgatttagcagtactgcgttgggtttggggggaactgctcagttaggacccagagggaaccatggaagccccagctcagcttctcttcctcctgctactctggctcccagagacctccggagaaattgtcttgacacagtctccagccattctgtctctctctccgagggagacacgcccaccctctcatcgcgacggccagtaccaggagttataagaactatacttggcctaggtatacaatacaagccgtcggaccgacgggtccccgctccgtctactctatgatcgtccttcagcgacggccacgtcgcacctcccgacgtccgtaggttacgagggttcgggtcgggttgggttacggacgtactacggtacttaccncttacgtaccaacgtaactcgaacgccgtaaccgaccccttacccgaaaccgttaggtaaacgtttacgtttacgacgtttaagttaacctttaagttaacccgttagtaaacccgtaaacgtacggtaaccgttaaacgaaggttaccgttaacccgggtccgttaacccgttacgttacccggggtttaaccggggacggggttaaaccggggaacccggttaaggggttacggaaacgtaaccggtaaacggaaaaccggttacgttaacgggtacggttctaacggtaccgtaacccgttagttacccgtttaggtccctttaaccg

SEQ ID NO: 127946 - DNA, 649 bp, Homo sapiens
  misc_feature: GYAE6OF02FRF43.45.87.H10.1.454.CMB.1.raw
  modified_base (387)..(387): a, c, t, g, unknown or other
  misc_feature (387)..(387): n is a, c, g, or t
tcagacgcgatcgacacgaccggtgctcgatttagcagtactgcgttgggtttgggggcatcacataacaaccagattcctcctctaaagaagccccctgggagcacagctcatcaccatggactggacctggaggttcctctttgtggtggcagcagctacaggtgtccagtcccaggtcccagctggtgcaatctggggctgaggtgaagagcctggtcctggtgaaggtctcctgcaaggtcttcgtggaggcagcttcagcaactttcctatcagcgttgggtcgcgaccgaccggtcccccgtaggaaccgaacgggtccgtaggtaggtgggaagtacggggaaagtagtacgagtacggaccaaagtacttagactaacngacacggaacctaccgcctacaagtaaacttccgaggacccgtagtaccacgttattacgtagtaccggaacacctactacccgaaccgtacccaactacgaccctacaagtcggaacgtcgaggaagaccgtacgtaaggacgttagttacgaaccggaactaaccggtctttacgtttattccggtaggttaccgacggtaacgtcggtaccggtccggtacggtcccggtacgttacgtacccggtacgttacccgggg

SEQ ID NO: 127947 - DNA, 910 bp, Homo sapiens
  misc_feature: GYAE6OF02H0YQ0.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctgctactctggctccagataccaccggaaaattgtgttgacacagtctccaggcaccctgtctctcgtctccgaggggagacacgccaccctctcctgcgcgggaccaggtaggagtgtcgaagttaagtacgttaaggcgtaggtaaccaaacgaacggaaaccgtacggaccgtaacggccttacccggaacggccttcctacactccgtaataggatcgactactaccgaaacgtccgggtcccgtacggcccgtacccgtacggaaccgttaccgggtttaccggacggtaccggtacgggttcggggttacccgtaggggaacctaagggttaaccggtttcctaaccgttacccgttccggtaacccgttccgtaaacggtcccggaccgttaccgggttacgggaaccgttacccggtaagttaccgtttacgggtttaaacttttccgggacgtttttaaacgttttaacccgtttacgttcggttacgtacggtaacccgttacggggttcccgtttaccccggacccggtacccggtacccggttaccggttaccccgtttaacggggggtttaaccccggggggtaccgggggggggttaaaccccgtaagggggggttaaccgggtacgggttaaacggttcggggaaaaccgggttaacccgggtaacgtttcgggggtaccgttaacggtacccggtacgttaaacccgtcggtttacccgttacgtttcccgttaaccgttacccgtttcccggtttaccccgagtttaaccgg

SEQ ID NO: 127948 - DNA, 674 bp, Homo sapiens
  misc_feature: GYAE6OF02IWYII.45.87.H10.1.454.CMB.1.raw
  modified_base (313)..(313): a, c, t, g, unknown or other
  misc_feature (313)..(313): n is a, c, g, or t
tcagacgcgatcgacacgaccggtgctcgatttagcagtactgcgttgggtttgggggaactgctcagttaggacccagagggaaccatggaagccccagctcagctctctcctcctcgcgactctgctcccacgatacaccgagaaatagtgttgacacagtctccacgccaccctcgtctttgtttccgtacggggaaagaagccacccctcctcctcgcgacggccagtcagggtcgttcgcaccggactacttacggtcctacggtaccgacgcacgagacctcggccgacgaccctcccacgcgtccncactccatgatgaccactaccaaccgtacgggtcccgtcggccgtccgacgactacggttccgtcggtcgaacggtggggtctggggacctaaggtcgttcgactcctacacccggtctagaccgaggtccctggtagccgtgtacgtacgtacgttttaggacctaagtttaccgttcgtcgtacgacgtacgacggtaccgtcccggtacccgaccgacccgtcgttaccgtaccgtttccggggcggggggtaaccgtagggtacgggtaagtagtacgacgtaggtaacccgtgtccgggaagtccggactaacccgtatccgttacgtcgttactacgtcccttcccgccctaacg

SEQ ID NO: 127949 - DNA, 759 bp, Homo sapiens
  misc_feature: GYAE6OF02HKU5A.45.87.H10.1.454.CMB.1.raw
  modified_base (214)..(214): a, c, t, g, unknown or other
  misc_feature (214)..(214): n is a, c, g, or t
  modified_base (306)..(306): a, c, t, g, unknown or other
  misc_feature (306)..(306): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttccatcagctgggtgcgacacggcccctggacaagggcctgagtggatgggaanagtcatgccaagacttgatacagcagactacgctacagaaattccgaggaccgagtcacctattatcgtcggactacgactccacgaccacncgacctacagtcggagcgtagaacgaacgtcctaggtaagtagtttaggaccgtaaccgaccgggtaccttaactttttaacgtttcgtacggtcgggacgtaacggtacgggttccgggtcccggttagggtccgggtaccgtttaacccgttccgtaaccggttaccgggttcgggggaacccgtaacggggtaaccccgtacgggtacccgtaacccggtttcccgtacccgtaccgtaccgtcccctaccccggtaaacccggaccgggtaccccgtaccgttcccgggttacccccctttccccgggtccgaccccttaccccttcccgtacccgtaacggacccgtacctaccccgggtccgggtccggggaccctaacggtaccggtaccccgggaccccggttcgggtccgtcccgggtccggtaccgggttaacgtaacccggg

SEQ ID NO: 127950 - DNA, 718 bp, Homo sapiens
  misc_feature: GYAE6OF02FR9GZ.45.87.H10.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagngccaccctctcctgcagggccagtcgagggtntaacagctactagcctggtaccaacaaaacctggccaggctcccgaggctcatcatctatgacgcatcgaacgngggccacgtcggcactcccagcctaggtcagtggctaggtcgggtctggggacagtacttcactctcacctancacgcacgccgtacggaccctaggacggttacttttcgacccttagtttaacctacgttagtaccgtacggtaccgtaacggtccggttacgggacccggtaacccggtacggtcccggtacccgttcccggtaacccggttttcccgggggaaccggggtaaaccgggggtaacccgtaaacgggggttacgggtaacggtaaaccgtaaccggtaaaacggtaccgttacgggtaacgggtcccgtaccggacccgtaacccgtaacgtttcccggttacgtttcccgtttaaccgttaccgtttcccccgttaccccggtacccttaaccgg

SEQ ID NO: 127951 - DNA, 714 bp, Homo sapiens
  misc_feature: GYAE6OF02JSFHA.45.87.H10.1.454.CMB.1.raw
tcagacgcgatcgacacgaccggtgctcgatttagcagtactgcgtgggtttgggtgccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcaagaaacttccgaggaccgagtcaccattatgacggacacatccacgaccacacgcctacagtcggacgctaggaagaacgccgttagaaggtatttacggaaccgacgaaccgggtaccctaagtttttaactttcgtagtcgacggtaagtacggtccgggtccggtcggtcgggtacttacgttccggtaacgtacggtcggggtacccgtaacggggaaacccgtacgggtaccgtacccggttccgtacccgtaccgtaaccgtccctacccgaaccgaaccgggtaccctaccggttacccggttcccgttacccccgtacggtcccctaccccgttaccctacccgtaacggtaccgaccctacccggtcccggtaccgggggacctaacccggaccgggtcccggtaccccggtcggggacccttccgggtcccggttaccgggtacgtaaacccggg

SEQ ID NO: 127952 - DNA, 559 bp, Homo sapiens
  misc_feature: GYAE6OF02FQD9P.45.87.H10.1.454.CMB.1.raw
  modified_base (204)..(204): a, c, t, g, unknown or other
  misc_feature (204)..(204): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagngccaccctctcctgcagggccagtcagggtgttaacagctacttagcctaggtaccaacaaaacctggccaggctcccaggctcatcatctatgacgcatcgaacgacgggccactggcactcccagcctaggttcaggtgcaggtggtctgggacagacttcactctcaccntcancacgtcctcggaccctggacggtattttgcctatttactactgtcagcagcgtggcgaccgngccncgtactacgttcggcggtagggaccgaagggtgaggtacacgaacgtacgtggtcggtccgtgaccgtacctagtacgttcgttcttacgtactccgttaccccgacctaac

SEQ ID NO: 127953 - DNA, 625 bp, Homo sapiens
  misc_feature: GYAE6OF02G9I4K.45.87.H10.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattaagaacatacttggcctggtatcaatacaagcctggccagggtcccccgntcccgtcatctatgtatcgcttccagcagggccacgtggaccactcccgagcctaggttcagggttgggtcgggttggggtttgcaacgagtaccttcacttcctacactaactcacgcacgccctaccaaccgtgtaactatttagctagttcttattacttacgtacctaagtacggtactaacgagttacgttcggccgtccttaccgttaaccggttttcgggaccggggtaacggggtacccgtaaggggtaggaacggtaacgtaaccgaaacggtaacgttcggtacggtaccgtacggacccgtaacctacgttaccgttacggtttacc

SEQ ID NO: 127954 - DNA, 817 bp, Homo sapiens
  misc_feature: GYAE6OF02GPFY7.45.87.H10.1.454.CMB.1.raw
  modified_base (202)..(202): a, c, t, g, unknown or other
  misc_feature (202)..(202): n is a, c, g, or t
  modified_base (497)..(497): a, c, t, g, unknown or other
  misc_feature (497)..(497): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggcctccgagataccaccggagaacttgtgttgaccacagtctccagccacctgtcttcgttccagggaaancgccacctcgtcctgctacgggccagtccgaggttcgtaacgacgtcgtactacgtccgtaggtaaccaaaaccgtaaaaccgtgaccgtaacggtcctaccccggaggtcctacgaactactacgtactaacgtacggacctcgtaactaccggtaacggacgggacctaacgttcggacctaaccgtcccgaacgccgttaacgggttaccacgggtacggtaccgacggggtttcggtaccgaccggggtaacacggttacccttacgtaccttaccgtaccaaacccggtnttaccgaacggtaccttaccggcctacggtacccgtaaggtacgttacgtttacgtaacttacgtttaaaccgtacgttacggaccttacggaccttaacgggccggttaccgggacctaaccggggtcctacccggttaccgttaccttacccgggtttacgggaaccgggtaaccgggtaaccgggtaacggtacggtaacgtaacgaaccggtaaaccgtacgggttagcggtaaccgtaaccggacctaacccggttagtccgttaccggttttaccgtaacgtccccgttttaacccggtccccgtaacttccgg

SEQ ID NO: 127955 - DNA, 653 bp, Homo sapiens
  misc_feature: GYAE6OF02FMMH0.45.87.H10.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagngccaccctctcctgcagggccagtcagggtgttaacngctacttagcctggtaccaaacaaaacctggaccaggcctcccaggcctcatcatctatgacgcatcgaacagggccacgtggcaactcccgacgccgaaggttcaggttcggctagggttgggtcgtaggggactaggtaccttcactccgtacaccagtcagcctaaggcccgtacggacccgtggtaggttacttttcgaccttaactttacctacgttcgtacacgtcgagtcggtcgggaccgaccgcggccgtccgttaccgtaccggtttaccgggaccggggtaacgggaaccggtaaggggtggaacgtaacgtaacgtaaaccggtacgtcgggtacggtcgtacgaccctaacctacgttaccgtcgttccttactacttccccgttcccgtacttaaccg

SEQ ID NO: 127956 - DNA, 549 bp, Homo sapiens
  misc_feature: GYAE6OF02GQJAN.45.87.H10.1.454.CMB.1.raw
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (482)..(482): a, c, t, g, unknown or other
  misc_feature (482)..(482): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggtttctggaggcagcttcagcaactttcctatcagctgggtgcgacaggccctggacaagggcctgagtgatgggaagagtcatgaccaagacttgatacagcagactacgctcagaaattccaggaccgagtcacattatgcgacacatccacgacacagcctacagtggagactggagaagcctgagtatttggacgacgacggtcctatttactttctgtgcgaggacgtccgcgtgcggctacgtcgactcgcgggcgacgggaccaggtcaccgtctccncncgcctccaccgacgcctacgtccgtcccttcccgtcggccctaccctccctaccgacgacnccaccgttcggcggggcacgcggccgcccgtcgggccttcggacccgtggtaccgtaacggtacccg

SEQ ID NO: 127957 - DNA, 547 bp, Homo sapiens
  misc_feature: GYAE6OF02HC4C5.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattatgcggacacatccacgaccacagcctacatggagctgagagcctgatattgacgacacggctatttatttctgtgcgagagtcggcgtgcgggctacttcgactacgtgggccgacgggacccaggtccgaccgtcctcctcacgccctccgaccgaacggcccacgttccgtccttcccccgtcgcccacccgtcctaccgaacgacgccaccgtcgtcggggccacgcggaccggcccgtcgggccgtcgtccgtcggtaccgtaacgg

SEQ ID NO: 127958 - DNA, 797 bp, Homo sapiens
  misc_feature: GYAE6OF02JTXGU.45.87.H10.1.454.CMB.1.raw
  modified_base (399)..(399): a, c, t, g, unknown or other
  misc_feature (399)..(399): n is a, c, g, or t
tcagacgcgatcgacacgaccggtgctcgatttagcagtactgcgtgggtttgggtgcccaagctgctggagggcgacggtcaccacgctgctgaggtgaagaagcctggtcctcggtgaaggtctcctgcaaggcttctggaggcagcttcagcaactttcctatcagctgggtgacgacacggccccgtggacgaagggcctggagtgggagtaggggaagaggtacacgttgacccgtaaaggtaccttaggaattaaccgaaggtcaacggaaccttacggaccttacgaaagtaaacttcccgaaggtaccggaacgtcctaacctagttaattacgggaccggaccaacgtacctacccgaacgaccaacgacgaccctaacacgtaggaacncgtagtaacgaacggtccgagacgtagttacgaacggtacgaccggtacttaacgtttactttagttctcggtacgggtaacgtgggtacccgggccggtacggtcggggtaccttaaccgtttccggtaaccggttacggtcggggtaaccgtaccgggggtaaccctaacgggtacccgttacccggttaccgtcccgtaccgtaccgttaccccgtcccgtaaccgggtaccggtaaacccgtacgttccccggtacccgttttcccccggaccgtcccctacccgtaccccgtacgaaccggcctaccgacccggttcgggtaacccggggctaacccggtccggtaccggtcccgtaccgggtccgtcgtacccggtcggtacccgtaacggg

SEQ ID NO: 127959 - DNA, 657 bp, Homo sapiens
  misc_feature: GYAE6OF02GHDD8.45.87.H10.1.454.CMB.1.raw
  modified_base (391)..(391): a, c, t, g, unknown or other
  misc_feature (391)..(391): n is a, c, g, or t
tcagacgcgatcgacacgaccggtgctcgatttagcagtactgcgttgggtttgggggcatcacataacaaccagattcctcctctaaagaagcccctgggagcacagctcatcaccatggactggacctggaggttcctctttgtggtggcagcagctacgaggtgtccagtcccaggtccagctggtgcaatcgtggggctggaggtgaagagccgtgggtcctcggtgaaggtctccgtgcaaggtcttcgtggaggcagtcttcagctaacttttcctatcgagcgtgggtcgcgacgaccgggccctaggaccgaagggcctggagtggagtagggaagacgtcagtcgacaagtacttgaatacgatacgacgactacgccgtanaacgtaactccgaaggtacccgtagtacctaccttagttacgttcggaccgtaacacgtactacccgaaccgaccaagaccgtacctaacacggtagtacgtcaggaacggtaccgccgtaggaaaccttgtttaccgaacggaccgtaccgggttactttattttacgttcgttacgggtcaccggggtagttaccgggttccgggtaccggttcggggtacccggttaccttacccgggttaccggaacccgggtttacccggg

SEQ ID NO: 127960 - DNA, 550 bp, Homo sapiens
  misc_feature: GYAE6OF02GLTEZ.45.87.H10.1.454.CMB.1.raw
  modified_base (437)..(437): a, c, t, g, unknown or other
  misc_feature (437)..(437): n is a, c, g, or t
  modified_base (481)..(481): a, c, t, g, unknown or other
  misc_feature (481)..(481): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaattccaggaccgagtcaccattattcgcggacacatcccaacgaccacagcctacatggagctagagaagcctagagtatttagacgacgacggtacctattttacttctgtgacgagagtcggcgtgcggacttcgtcgactcgtgggaccagggacccgtaggtccgtaccgtctcctcgacncctaccgaccgaacggccctacgtccgtccttccccgtcgaccnccctccacgacgcgaccaccgtggtacgggacacgacgcggccgtcggcctcgccgtgtacgtaaccgg

SEQ ID NO: 127961 - DNA, 688 bp, Homo sapiens
  misc_feature: GYAE6OF02H0EKA.45.87.H10.1.454.CMB.1.raw
  modified_base (152)..(152): a, c, t, g, unknown or other
  misc_feature (152)..(152): n is a, c, g, or t
  modified_base (660)..(660): a, c, t, g, unknown or other
  misc_feature (660)..(660): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctccagtcagggtgttaacngctacttagcctggtaaccaacaaaaacctggccaggctcccaggctcatcatctatgacgcatcgaacagggccacgtcggcactcccgagccgtaggttcaggtcggctaggtgggtctgggacagccttcactctccaccatcgagcacgcccgtggaccccgtggacggttacttttcgacctttagttttacctacgttgtacgagtcctaggcggtcggaccgaccgacgccgacgttccgtacggtttccggggacgggtaacgggaacccgtaagggtggacgtaacgtaacgaaacgtaacgtcggtagggtcctacggtacctaccgtacgtcgttacgttcctttacctaaccgtttcccgtttacccccggactttaccgttaccgttagtacgtttacccgacgttacccggtcgttaccgttacggggacggtcccggggtacgtaccggggtacgtaacgggtacccgacgtaaaggttcgggataccggtcncgtgtacgtcgcgtcgacgtcgtagtcg

SEQ ID NO: 127962 - DNA, 665 bp, Homo sapiens
  misc_feature: GYAE6OF02FM5IW.45.87.H10.1.454.CMB.1.raw
  modified_base (223)..(223): a, c, t, g, unknown or other
  misc_feature (223)..(223): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaagggtcctcctgcaaggcttctggaggcagcttcagccaactttccgtatcgagctagggtcgacgacacggcccctggacaagggcctgagtggatgggaanagttcatcgaccaagacttgatacagcagactacgctcaagaacttccaggaccgtacgtcacctattacttacggacggaccactactaccacggaccacagaccctaacagtaggacgacgtagaacgacgtccgtagacgtattacgaacgacgtacggacccttaattttacttcgtgttcgacggaggtacggtacggtccggtggtcgggtacttacgttcgtacgtacggtgggaccgaacgggacccaggtccgtaccgtcctccgtaccacgtcccgtaccgaccggtaacggcccttaagtcccgggttacccttccccggtcgtaccctacccgtccgtaccgacgtaccgcgtacccggttccggacggggaccctacgtacggtcccggtaccggtcgggtacctcggtaccgttaggtaaccgtaccg

SEQ ID NO: 127963 - DNA, 725 bp, Homo sapiens
  misc_feature: GYAE6OF02JETPC.45.87.H10.1.454.CMB.1.raw
  modified_base (296)..(296): a, c, t, g, unknown or other
  misc_feature (296)..(296): n is a, c, g, or t
  modified_base (383)..(383): a, c, t, g, unknown or other
  misc_feature (383)..(383): n is a, c, g, or t
  modified_base (411)..(411): a, c, t, g, unknown or other
  misc_feature (411)..(411): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaattgtgttgacacagtctccagccaccctgtctttgtttccaggggaaagagccaccctctcctgcagggccagtcagggtgttaacagctacttagcctggtaccaacaaaacctggccaggcctcccaggctcatcatctancgacgcatcgaacgaggccacgtggccactccccagtccaggttaccaggtcgggcggttgggttcggcacgagtaccttcacctcncacaatcagcacgcctccaactgaagtntttcgctagttcgttaatacgtggttaccaacgtacgtaccgtactaacgttaggttaccgggcccgtccgtttaaccgttaccccgtttttaccggggggaaccggggttaaccggggggtaaccccggtaaaggggggttcgggaaaccgggttaaaccgttaacccggtaaaaccgggtaaccggttttcggggaccggtttaccgggtaaccggttaccccgtaaaccgtaccggtttaccgtttacggtttacccgttttacctaaccgtttcccccgggtttacccccgtacccttagggtttacccc

SEQ ID NO: 127964 - DNA, 540 bp, Homo sapiens
  misc_feature: GYAE6OF02F1A1A.45.87.H10.1.454.CMB.1.raw
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaacttttcctatcagctgggtgcgacacggcccctggacaagggcctgagtggatgggaanagtcatgccaagacttgatacagcagactacgctcagaaattccaggaccgagtcaccattattgcggacacatccacgaccacagcctanatggagctgagagcctgagattgacgcacggctatttattctgtgcgagtcgtcggcgtggacgggtctacgttcgactcgtcggggccacgggacccgaggtccgaccgtctccgtcacgcctccaccgaacggccacgtccgtcccttcccgtcgccctcctcctccaacgcgccaccgtcgtcgggcacgcgccggcccgtcgggacctcggcccggtaggtcgtaacgg

SEQ ID NO: 127965 - DNA, 698 bp, Homo sapiens
  misc_feature: GYAE6OF02H4FYZ.45.87.H10.1.454.CMB.1.raw
tcagacgcgatcgacacgaccggtgctcgatttagcagtactgcgttggggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaagagccaccctctcctgcagggccagtcagggtgttaacagctacttagcctggtaccaaaccaaaaaccgtcggaccacggcctacccgacggcccagtccatctagtcgacgcactcgaacgagggccacgtcggccacgtccccgagccgtaggttccgaggtcggcgtaggtcgggtcgtacgggacagtaccttccgacgttctaccactacgtcacgtcacgtcccgtcgggaccctggtacggttacttttacggtacccttactttaccgttacgttcgttacgacggtacgtaacggccggtcggacccggaccggacggtccgtaccgttccggttaccggttttccggggaccggggtaacggggtacccggtaagggttagggaacgtacgtaaccgaaaccgtacgttacggtcggtacggtcgtaccgtaaccgtacttcgttacgttccgttacgtccttacccgtttcccgccttagtccg

SEQ ID NO: 127966 - DNA, 886 bp, Homo sapiens
  misc_feature: GYAE6OF02HIQ2W.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggaaaaattgtgttgacacagtctccaggcaccctgtctctgtctccaggggagacagccctaccctctcctgcacgggccaggtacggagtgtcaaggtaacgtacgttacggcgttaggtaacccaaacgaacgaaaacccttggaccccgaagggtccctaccccggaagggccttccctcgactcccaatcgtagtcggacctaacttaccccaaacggtccggggttaccccctggggtcccttaccccggaacggtaacccgtaccggggtttaccggtcggggacccgtaggggttacggggtccggttacgggggaacctaaggtccggtttaccgtaacccgttcctttacccgggaaaccgttcccgaaaggtccccgtaaccggtcccggttaacgggaacgtcccggtttaggtaacgtttcggttttaacgttttggtaaccctttacgggttttttaaccttccggtttcgtaccgtaacgggtacctacgggttacccctttcccgggaccccgtacccggtacccgttccgttacccgggtttaccggttcccgggggggtaaccgggggggtaaccggttacgggggtacgggtacggtaacggttagggaaccggtaccggtacgttcgggtacggtccttaggggacccctacggttacggttcccttaacggtttcccttacgttacccgtttcccgtttaccccgcctttaaaccggg

SEQ ID NO: 127967 - DNA, 716 bp, Homo sapiens
  misc_feature: GYAE6OF02FSJB7.45.87.H10.1.454.CMB.1.raw
  modified_base (539)..(539): a, c, t, g, unknown or other
  misc_feature (539)..(539): n is a, c, g, or t
tcagacgcgatcgacacgaccggtgctcgatttagcagtactgcgttggggtttggggaggaactgctcagttaggacccagagggaaccatggaacgccccagctcagcttctcttcctcctggcactctggctccagataccaccggagaattgtgttgacacagtctaccagccacctgtctctgtctccgaggggacacgacgcccacccgtctccgtgacgacgggaccaggtaggtagtagtctaggttaatacgttaggctacggaaccaacgacggaaaccgtcggaccgacggtacctacccggacggtcctacccgtacactcctaagtcgtatcgtactaacgtacccgaacggtaccgggtcccgtacggcccgttacccgaaggtaccgttacgggtttccgtagggccgtaggggttcgggtacggtaggggactacgggtacgttaccacgttcctacgaccgtacacgcctacgccgtaggcgtacctgtactacggttctttcgactttagtttaccttcgnggttctaacggctccggtccgttccgaccctaccgggtccttcctaccggttttacggggtcccgggggtacgggaccgttacggggtacgacggtaagacggtacgacgtacggtacggtcggacgttcaccgtaccgtagttcgtacgtttcctacgtaccttcccgtaccgtcc

SEQ ID NO: 127968 - DNA, 733 bp, Homo sapiens
  misc_feature: GYAE6OF02GXJ6O.45.87.H10.1.454.CMB.1.raw
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaacttttcctatcagcgtgggtgcgacacggcccctggacgaagggcctggagtggagtgggaagagtcagtgaccaagtacttgatacagcagactacgctcaagtaaattccaggaccgagtcacctattatcgcggacacactccacgaccacngacctangtgganctagagagcgtgatagttagacgacgaccggtactaattttcttctgtgacgtaggtcggtccggcgtacggtcgggtacttacgttcggtacgtaccggtcggggtacccgaacggggtaaccccgtacgggtaccgtacccgttaccttcccgtccgaccgtcccgttaccccaacccggaaccggggtaccccctacggtttacccgggttccccgtttaccccccggtccggtacccccgtacccccgtttaccccgtacccgtaaccggtacccgtacccgtaccccgggttccgggtacccgggggggtaacccaacccgggtaccggggtccccgggtccccgggtccggggtcccggttaccgggtccccgggtttacgggaaccggttaaaccccgggg

SEQ ID NO: 127969 - DNA, 713 bp, Homo sapiens
  misc_feature: GYAE6OF02JEXD4.45.87.H10.1.454.CMB.1.raw
  modified_base (395)..(395): a, c, t, g, unknown or other
  misc_feature (395)..(395): n is a, c, g, or t
tcagacgcgatcgacacgaccggtgctcgatttagcagtactgcgttgggtttgggggaactgctcagttaggacccagagggaaccatggaagccccagcgcagcttctcttcctcctgctactctggcctcccagataccaccggagaaattgtgttgacacagtctccaggcaccctgtctctgtactcgaggggacacagcccacctctccgtagccgagggccaaggtaggagtgtcaaggtaacgttacgttagggcttaggtaaccaacgagaaaccgtggaccctagggcctacccgaggtcccttcctacgtactcccaagtcgatcgacacttaccgaacgacggggttccctagggccctcccaggtaccgtcgggtttcccgnggtactggtcggggtctaggggacctaggttacttacgaccgttcctacggaccgttcgacgacctcgtccggtagaccgtccgtaaggtctagggttattttcggactttaacggtttcttcgttacgtactacggtcttacggtccgtttacccgcccgtcgacccgttcgtacccgtacgggtttccgggacggggtaaccgtggggtagggtactacgtagggaaccgttacggacgttggtacggtacgtacggacctccgttaagtcccgttacgtttaccgttacccgtcgttccccgttaccgcgttacg

SEQ ID NO: 127970 - DNA, 584 bp, Homo sapiens
  misc_feature: GYAE6OF02IJN0E.45.87.H10.1.454.CMB.1.raw
  modified_base (306)..(306): a, c, t, g, unknown or other
  misc_feature (306)..(306): n is a, c, g, or t
  modified_base (558)..(558): a, c, t, g, unknown or other
  misc_feature (558)..(558): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagtcagggtgttaacagctacttagcctggtaccaaacaaaaaacctggccaggctcccaggctcatcatctatgacgcatcgaacagggccactggcatccagccaggttcagtgcagtggtcgtgggacagacttcactctcaccatcagcagcctggacctggagtntttcgctaatttacactgtcagcagcgtggcgtaccgagcgctacgacgtttcggacgggaacgggtaaccgtaagggtcggaagacgttaacgaaacggtacgttaggtcggtacgtacgtacgaacctaagtcctacgttccttacgtaaccttcctcccgtacctactcgtacgtacgtcgtaacgtccgtacgtcgtacggacggtaccgggtacgtcgggaacgaacgggcgaacgtacgtacgtancgagngtancgtagcagtacncgncg

SEQ ID NO: 127971 - DNA, 1036 bp, Homo sapiens
  misc_feature: GYAE6OF02I6L25.45.87.H10.1.454.CMB.1.raw
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttccatcagctgggtncgacnggcccctggacaaggcctgagtggatgggaagagtcagtcgaccaagtacttgatacagcagacctacgctacaagaaacttccgaaggacccgagtaccaacccgtatttaacgttggaccggtaacaaccactccccgaaccggaacccaccaacgaccctaacagttgggaacgcgtaggaacggaacgcctaggtacgtaacgtttaggaaccggaacccgtaaccgggtacccttaaagtttttacctttttacgtcgggttacgtaacccgggaaaggttacgggttcccggggacccgggttccggggtaccccgggggttacccctttaaccgggttttaccccggtaacccgtttaacccgggggtttaccggggggggaaccccgggtaaaaacccgggggttaacccccccggggtaaaccggggttttaccccggtaacccccgggtttttacccccggtttaccccgttaccccggttaaaccccggttccccccccgtaacccccggtaaacccccggtaaacccgggggggtaccccccccttaaaacccggggtttttccccccggggttttaaaccccccccgtttttccccccccccggggttaacccggggttaaccccccttaacccccccccccggtttaacccgtttaacccccgaaaaccccgggtaaccggttacccccgtaacccccggttttcccggggaacccggggggggtaacccccgtaacccgggttaacccgggtcccccccgggggttaccccggaccggggggtttacccgtcccggggtaccccccggttttacggggtaaccccggttaaaccccggggg

SEQ ID NO: 127972 - DNA, 757 bp, Homo sapiens
  misc_feature: GYAE6OF02IA4HK.45.87.H10.1.454.CMB.1.raw
  modified_base (524)..(524): a, c, t, g, unknown or other
  misc_feature (524)..(524): n is a, c, g, or t
tcagacgcgatcgacacgaccggtgctcgatttagcagtactgcgttggggtttgggggaggaactgctcagttaggacccagagggaaccatggaagccccagctcagcttctcttcctcctggcactctggcctcccagactaccaccggagaaattgtgttgacacagtctccagccacctgtctttcgttaccgaggggagacagcccaccctctcctgcacgggccagtaggagtgtcagtaaagtactaggcttacggtacaacgagaaacctggaccaggtcctaccgaggcctcctcactccagtgactcgactacgtaccaacgtcgggtccctacggcctaccgagaccgtaggttccgtgcgtaggtcgggtcgtacgggactaagtacgtcctacgttaccacgacgtactactacggccgaacgtccgtttaacgggaccttagggtaaacggttttcttttacccgggacccctttaaagggtttttaactaccgtacggttaacccggngtaaccgttacgggtccggggtaccggaccggtaaccggtacggtcccgttaccgttaccggttaacccgggttccgggggaaccggggtaaccgggtaaaccggtaacggggttagtaaccggtaaacgaaacccggttaaagtaccggtcggtaccggacgtccggtaacccacggttaccttacggtccttaccgtactcccggttaaccctacccgtacgtacgttcgg

SEQ ID NO: 127973 - DNA, 631 bp, Homo sapiens
  misc_feature: GYAE6OF02FUWRH.45.87.H10.1.454.CMB.1.raw
  modified_base (331)..(331): a, c, t, g, unknown or other
  misc_feature (331)..(331): n is a, c, g, or t
  modified_base (356)..(356): a, c, t, g, unknown or other
  misc_feature (356)..(356): n is a, c, g, or t
  modified_base (415)..(415): a, c, t, g, unknown or other
  misc_feature (415)..(415): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (623)..(623): a, c, t, g, unknown or other
  misc_feature (623)..(623): n is a, c, g, or t
tcagacgcgatcgacacgaccggtgctcgatttagcagtactgcgttgggtttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcgacggccaggtaggagtgtcagtaagtacgttaggctcggaaccaacgaagaacctggaccaggcctcccgaggcctcctacactccatgatcgcactccaacgcggtcccncggccgtcccagacgtacggttcgnggcgtaggtcggtcgtgggacagtacgtcactcgtcacgtcgagcacgccgtagggacnccgtagacttgtacttttgactttacgtttactnacgtcagtcncgtaccgttcccgaccncggtccnccgttcgtaccggttcgggggaccggggtacctaggggttcgaagtcggtagacgacggttacgtcgggtcggtaacctacggaccctacgttacggttccttaggtttcccgtacttacccggttccccgttacccggntttaccgg

SEQ ID NO: 127974 - DNA, 709 bp, Homo sapiens
  misc_feature: GYAE6OF02F9KDU.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagcgtgggtgcgacacggcccctggacgaacgggcctggagtggagtgggaagagtcatggaccaagtacttgatacgagacaagactacgctacaagtaaacttccgaaggaccgagtccaacctattattggaccggacacgactaccaacgaccacacgacctacgagtggacgcgtagaggaacgcgtaggaacgtatttacggaaccgacgaccggtacttaatttttcttcgtggtacgaggacgtcggtacggtcgtgccgggtactacgttcgaccgttacggcggggaccgacgggtacccacgggtaccctaccggtcccttacctaccgccgtaccccgtaccgaaccggtacccgggacctaccggttcccggttcccgttaccccgttccggaccctaccccgtaccctacccgaacggtacccgtaccctacccgggttccggggcgggggtaccctaacccggaacgggtccccggacccgggtcggggtcccttacgggccccgtttagggaaccgttaacccggg

SEQ ID NO: 127975 - DNA, 571 bp, Homo sapiens
  misc_feature: GYAE6OF02IVYWB.45.87.H10.1.454.CMB.1.raw
  modified_base (202)..(202): a, c, t, g, unknown or other
  misc_feature (202)..(202): n is a, c, g, or t
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
  modified_base (450)..(450): a, c, t, g, unknown or other
  misc_feature (450)..(450): n is a, c, g, or t
tcagacgcgatcgacacgaccggtgctcgatttagcagtactgcgttggggtttggggaggaactgctcagttaggacccagagggaaccatggaagccccagctcagcttctcttcctcctggcactctggctcccagataccaccggagaaattgtgttgacacagtctccagccaccctgtctttgttccagggaaagngccaccctctcctgcagggccagtcagggtgttaacagtctacttagcctaggtaccaaacaaaaacctggaccaggcctacccaggcctacatccatcctatgacgctaatcgaacagggccacgtggcactcccagccaggttcagtggcaggtggtctgggaacagacttnactcacaccatcaagcacgctgaccctgacgtntttcgactatttactactgtcagcacgcggtcggccgacgngccgtctcgtaccgtttcggacggacgggaaccgaagggtggaagtacgtaacgaaacggactaggtacggcgtacgaccacctaagtccttacgtcttactcgtacccttcccgacctac

SEQ ID NO: 127976 - DNA, 583 bp, Homo sapiens
  misc_feature: GYAE6OF02IBBQY.45.87.H10.1.454.CMB.1.raw
  modified_base (363)..(363): a, c, t, g, unknown or other
  misc_feature (363)..(363): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacaggcccctggacaagggcctgagtggatgggaagagtcatgaccaagacttgatacagcagactaccgctacagaaaattccaggaccgagtcaccattattgcggacacatccacgaccacacgcctacatggagctagagaagctgacgatttgacgacgacggactatttatttctgtgngtaggagtcggccgtgcggtctacgttcgactacgtcgggaccagggacccaggtaccgaccgtctacctcacgcctccaccgacggaccctacgtcccggttccttccccgttcggcccaccctccctacccaacgacgacctacccgtccggtcggggacaccgtacggcccggtacccgcggggtcccgtacggtccgttaccgggtcgtaaccggg

SEQ ID NO: 127977 - DNA, 838 bp, Homo sapiens
  misc_feature: GYAE6OF02GBXGS.45.87.H10.1.454.CMB.1.raw
  modified_base (233)..(233): a, c, t, g, unknown or other
  misc_feature (233)..(233): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcaggccagtcagggtnttaacagctactagctggtaccaacaaaactggcagctccaggctcatcatctatgacgacactacgaacgacgggcctacgtcggaccacgtaccccacgccgtacggttacgaggttcggacgtagggttcggggtccgtaggggactacggtactttaccaccgttcctaccgtaaccctacttaccaacggacctaacggtcccgttaccgggtacccgtaggtaacggtttacgttttacggtaccctttaagttttacccttaacgttacggtacctaacggaccgtacggtaccgggtacgggtacccggtaacccgggaacggtcccggtaccgttacccgtacccgggttttaccggggaaccgggggttaaccggggtaacccggttaaaacgggggttacgggtaaaccggtaaaccgttaaacccgggaaaacccgggtttaacccggttaacggggttaccgggtaccggttaaccgggtaaccccggttaaaccccgttaccgggttaaccgttttacccggtttacccggttttaacccgttacccggtttttaccccccgttacccccgggtaacccttttaacccggg

SEQ ID NO: 127978 - DNA, 756 bp, Homo sapiens
  misc_feature: GYAE6OF02G1LCQ.45.87.H10.1.454.CMB.1.raw
  modified_base (216)..(216): a, c, t, g, unknown or other
  misc_feature (216)..(216): n is a, c, g, or t
  modified_base (610)..(610): a, c, t, g, unknown or other
  misc_feature (610)..(610): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagcaactttcctatcagctgggtgcgacacggcccctggacaagggcctgagtggatgggaagngtcatgccaagacttgatacagcagactacgctacagaattccaggaccagtcacctattattcgcgacacgactccgacgaccacacgtacctaacagtcggacgcgtagaacggaacgtcctaggtaacgtagtttacggaaccggaacgacccgggtaccctaagtttttaactttcgttaggtcggtacggtaggtacggttcgggttccggtagggtccgggtaccctttacgttaccggtaccggttaccggtcgggggtaccccgaacggggtaaccccgtacgggtcccgtaacccggttcccttacccgtacgacccggtcccctaacccgaacccggtaaccggggtcccctaacggttccccggtttacccttccccccgggngtacccccgtacccttcccgtacccgaaccgtaccgtcccacccggttccgggtacccggggacccaaccgggtaccggtcccgggtaccccggttcggggtaccctttcccggggtacccggttccgggtaccgtaaacccgggg

SEQ ID NO: 127979 - DNA, 783 bp, Homo sapiens
  misc_feature: GYAE6OF02IZL5O.45.87.H10.1.454.CMB.1.raw
  modified_base (209)..(209): a, c, t, g, unknown or other
  misc_feature (209)..(209): n is a, c, g, or t
  modified_base (248)..(248): a, c, t, g, unknown or other
  misc_feature (248)..(248): n is a, c, g, or t
tcagacgcgatcgacacgaccggtgctcgatttagcagtactgcgttgggtttggggggaactgctcagttaggacccagagggaaccatggaacgccccagctcagcttctcttcctctggcactctcggctcccagactaccgacggataaattgtgttagacactagtctccacgtcccacctgtctttcgttccgaaggggaaancgccacctcgtctgcgagggcctagcgaggttagtaacngctactacgccgtagtaccaaaactaaaccgtgaccgtacggcctaccgtaggcctacaactactaactccgtatcggacgactaacgtacggaacgcggtcctacgtacggctaccgtcccagtacccgtggttacacggtacggtacgtaggtccgggtacgtacgggttacacggtttaacctcctaaccgttctaacccggaacctaggttacccgaagtacccggtacgtttacccggacggtaaccggtttacggaacggttttaccgtttaccggtaacccttttaactttaaccggtttaccgtaacggtccgtaagtcccggtaaggtaccggtcccggaacgtacccggaggtccgtaccggttacccgtaacgggttaccgggaccggtaacggggtaaccggtaaacggggtcgtaacgtaacgaacggaaaccgttaggtccggtacggtaccacgtaacgtccgtaattccgtacgttacttaccgtaacgttccccgtttaaccgacctttcttaaccgg

SEQ ID NO: 127980 - DNA, 945 bp, Homo sapiens
  misc_feature: GYAE6OF02G8YCZ.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagtcaacttttcctatcagcgtgggtgcgacacggcccctaggacgaagggcctggaggtaggatggggaagagtcatcgaccaagacttagatacgagcagactacgctacaagtaaattccaaggaccgagtaccaccaattagttgcggacacactccaccgaccacacgcctacatggacgactggaagaacgtccgtaggtaatagtttacggaacgtaaccgtaaccgggtaccttaatttttaacgttttacgttggttacggtaccggtaaacgggtacgggtttacccgggttacgggttacggggtacccgggggtttaccggtttaaacccgttttacccgggggtaacccgtttaacccgggttaccgggggggtaaccccgggtaaaccggggggtaaaccccccggtaaccggggttaaccccgtaccccgggttaccccgttttccccggtacccgtaaacccgggtcccccggttaacccccgaaaccccgggtaaacccgggggttaccccccgtaacccggttttacccccggggtttaccccgtttacccccccccggtttaccgggggtaacccccttaaaccccccggttaccccccgtaaccccgtaaacccgggtacccggtaccccggtaacccccggttccggggtaccccggggggttaaccgaaccccgggtaacccgggtaccccgggggttacccccgggtaccgggggttaccccggttcccgggtccccggttaccggggtttaaccgttaaaccccggggg

SEQ ID NO: 127981 - DNA, 776 bp, Homo sapiens
  misc_feature: GYAE6OF02JTQ79.45.87.H10.1.454.CMB.1.raw
  modified_base (205)..(205): a, c, t, g, unknown or other
  misc_feature (205)..(205): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccaggctaccctgtctctgtcctccgaagggganacacgcccaccctctcctgaccgagggaccaggtacggtagtcgtacgaagtaacggttaccgttagggcgttaccggtaaccaacgaacggtaaaccgtggaccgacggcctaccgacggtccttccactacgtacctagtacgatcgctaactaaccgaaccggtacccgggttcctccgggacccgtacccgaacggtaaccggtcgggtttcccgaggaccggtaggtcgggtaccgtacggggaactacggacgtttcctaccgtcctacgaccgttcgacgtcacgggtccgtacggggactcgttacgtacgtacggttagttttacccgacgtttacgtttaccgttcgtacgacgtagtacccgtaccgggtcccttaaccgtcccggtaaccgccgttaaccgttccgggttaccgggttcccgggggtcggggtaaccggtggggttaaccgaggtaccgaggaccgggtaccgtaacggttcggtacgtccgttacggacccgttaccctaggtttcccggttgttacccggttctaacccggttcccgtaacccgtcg

SEQ ID NO: 127982 - DNA, 790 bp, Homo sapiens
  misc_feature: GYAE6OF02IHTW2.45.87.H10.1.454.CMB.1.raw
  modified_base (203)..(203): a, c, t, g, unknown or other
  misc_feature (203)..(203): n is a, c, g, or t
  modified_base (449)..(449): a, c, t, g, unknown or other
  misc_feature (449)..(449): n is a, c, g, or t
tcagacgcgatcgacacgaccggtgctcgatttagcagtactgcgttggggtttgggggaggaactgctcagttaggacccagagggaaccatggaagccccagctcagcttctcttcctcctgctactctggctcccagataccaaccggaaaattgtgttgacacagtctccaggcaccctgtctctgtctccgagggganacgacgcccaccctctcctgcgacgggaccaggtaggagttgtactaaggttaacgtacgttaggccgttaggtaacccaaacgaacgtaaaaccgtcgggacccgaacggcccttacccggaacggtcctacgaacttcaaacttctaacgttacgaccgaactacggttaaccggaaacggacgggacccaacggttcggacctaaccgtccccgaagtacccggtaagtttccgaaggtcggngtaacgggttcgggtcgtacgggactacggtaccttacgtactaccgtaaccgaacccgtgtaccgacgtacgtaccggtccgtaccggacccggttagaaccgggtttcttttacgaccgtttacttttaaccacgtttacggactcggtaccgtacggtcgggtacggtaacccgacggtcgaccgttccgtaccgggtttaccggttaccggggaaccggtaaccgggaacgttaacgggggtacggaactaaccgaaggtaaccgtcggttacggtaccggcgttaacccgacttaccgtacgttacttaccggttcctacgttacccgtaccccgg

SEQ ID NO: 127983 - DNA, 716 bp, Homo sapiens
  misc_feature: GYAE6OF02JYBDI.45.87.H10.1.454.CMB.1.raw
  modified_base (362)..(362): a, c, t, g, unknown or other
  misc_feature (362)..(362): n is a, c, g, or t
tcagacgcgatcgacacgaccggtgctcgatttagcagtactgcgtgggtttgggtgcccaagctgctggagggcacggtcaccacgctgctgaggtgaagagcctgggtcctcggtgaaggtctcctgcaaggcttctggaggcagcttcgagcaacctttctatcagctgggtgcgacacggccctaggacaagggcctggagtggagtagggaagtagctagtcgaccaaagtacttagactaacgagacaagtacctacgtctacgtaacgaaaacttccgaaggtacccgagttaccaacctatttacgttcggaccggtaaccaactagtcccaacgaccacgtacgtaccctaanagtacggatcgtaggacgaacggtctaggataacgttgaaccgaccgtacggtacccttaattttacgttcgtggtagaccggaggtaccgggtccgggtcggtcgggaccggttaccgtaacttccggtaacgttacggtacggggacctacgggaaacccgtcggttacctacccgttctccgtaccgtacgtaccctacccgaccgtaaccggtccctacgttcccggttcccgttccccgtacggtacccctaccccgttccgtaccgaacgtcccgacctaccggtccggtaccggaccgacgtccggtaccgcccgggtagtcccgttcgaccggttcgataacccgg

SEQ ID NO: 127984 - DNA, 549 bp, Homo sapiens
  misc_feature: GYAE6OF02HOSMD.45.87.H10.1.454.CMB.1.raw
  modified_base (175)..(175): a, c, t, g, unknown or other
  misc_feature (175)..(175): n is a, c, g, or t
  modified_base (214)..(214): a, c, t, g, unknown or other
  misc_feature (214)..(214): n is a, c, g, or t
  modified_base (311)..(311): a, c, t, g, unknown or other
  misc_feature (311)..(311): n is a, c, g, or t
tcagacgcgatcgacacgaccggtgctcgatttagcagtactgcgtgggtttggtgcccaagctgctggagggcacggtcaccacgctgctgaggtgaagaagcctgggtcctcggtgaaggtctcctgcaaggcttctggaggcagcttcagcaactttcctatcagctgggtncgacaggcccctggacaagggcctgagtggatgggaagngtcatgccaagacttgatacagcagactacgctcagaaattccaggaccgagtcaccattattgcggacacatccacgaccacagcctacatcggancgtgagaagcctgagattgacgacacggccatttattctgtgcgagagtcggccgtgcgggtctacgttcgactactggggcctagggacccaggtcaccgtctccgtccagccctccaccacgggcccacgtccggtaccttcccccgtcggtccacccctcccgtccgaacgacgcctacccgtcgtcggggccacgacggtcggcccgtggccgtcggcccgttggtcctaacgg

SEQ ID NO: 127985 - DNA, 709 bp, Homo sapiens
  misc_feature: GYAE6OF02JGSUI.45.87.H10.1.454.CMB.1.raw
  modified_base (201)..(201): a, c, t, g, unknown or other
  misc_feature (201)..(201): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtcttgacacagtctccagccattctgtctctctctccgagggganacacgccaccctctcatgcagggccagtcagatattagaacattacttaggcctaggtactacaataacaagactaggccgacgggtaccccggcgtacctccatacctagtgagttcgacttccgacgtcgaacgggccctaacgtcggacctacgaccctacggaccgtaggttaccgaggttacgggaccgggttgggttttcggacctacgaacgtacgttaccaccgtttacgtacctaacgaacgttccgaacgtacggtaacccgaccccgtttaaccccgaaacccgttaccgttaaaggttaacttttaccggtaacgtaaccggtttaaccttaacgttttaccgtaccgttaaccgtaaactacgggtacgttacgtaacgtacgttcgggtaccgtacttaccgttcgttacggacgggtacggaccggtagtcgggtaagaccgtactaacgtacgttacgaggtacgtcgacgaccttacgacttcggttaacc

SEQ ID NO: 127986 - DNA, 904 bp, Homo sapiens
  misc_feature: GYAE6OF02GUNJM.45.87.H10.1.454.CMB.1.raw
tcagacgcgatcgacacgaccggtgctcgatttagcagtactgcgttggggtttggggaggaactgctcagttaggacccagagggaaccatggaagcccagctcagcttctcttcctcctggcactctggctccagactaccacggagtaattgtgttgacacagtctcacgccacctcgtctttcgttccgagggaagacgccacctctccgtcgacgacgggcctagtacgtagggttacttaacgacgtacctacgttacgtaccgttacggtaaccaaaacctaaaaaccgttcgggaccgtaacggtaccctacccgtacggtacctaacgtactacaacgttaccgtaagtacgtaacgtacgtacctaacgtaaccgaaccggtaccgggttaccccgtacgggtacccgtacccgtaacggtaccggttacgggttacccgtagggtacgtacgggttacggggtaccgtacggggtaacctacgggtaaccgtttaccgtaccgttaccgtaccggtaaccgtacggtaacgtacccgtaacggtcccgtacgggtaccgtacgtacggtaactttacggttactttacggacttttaacggtttacctacgttaacgacggtaacgtaccgttacgggttaccccgttaaccgccgtaaccggtacccgttcgttaaccggttacccgggtttacggggggaaccgggggttactaacgggggttacgaacgggttaacgttccgggtaaacgtaaaccggttaccggttaaggttccggggaaaccctttcggtaacccttaccggtaagttttacccccgggtttaagttacccgtttacccgttacggttaccccgttaccccgtaacttaccgggtttacccgtaacgg

SEQ ID NO: 127987 - DNA, 989 bp, Homo sapiens
  misc_feature: GYAE6OF02GK5P6.45.87.H10.1.454.CMB.1.raw
tcagacgcgatcgacacgaccggtgctcgatttagcagtactgcgttgggtttggggggaactgctcagttaggacccagagggaaccatggaagccccagctcagcttctcttcctcctggcactctggctcccagataccaccggagaaattgtgttgacacagtctccagcccaccctgtctttgttccgaggggaaagcgcctaccctcctcctgcgacgggccagtccgtaggggtacgttaaacgagtccttacgttacgcccgttacgggtaaaccctaaaacctaaaaaacccgtcggtaccccgaacggtccctaccccgaacgggtcctaccgtaataccgtaacttaccgttaacgtacggtaaccggactaaacgtaaccggtaaaccggaccggggtacccctaacggttcggaaccctaaccgttacccccgaacgggtacccgttaacgggtttaccgtacgggttaccgggacgttaagggggttccggggttccggtaacggggtaaccgtaaacggtttaacccgtttaccgtaacccgtttcccgttaacccgtaacccgtaacgtttacccgaacggtaacccggtaacccgggtccccgtttaacccgggaacccggtttgggtaaacggttttaccgttttaccgaacccgttttaaaccgtttttacccgtacgtttaccggtaccgaccggtaccggtaacgggtccggggttaccggaaccccgggtaaccgggacggttcccgtaccgttaaccgggtttacccggttaccgggggggaccgggtaaaaccggggtaacccgggttaaagggggtccggtaaaacctaaccgggttaaaaccgtaaaaccggggtcgtaccgggggttacgacccgttaacggaccctaaccggtaacgttttccgtaccggtttacttcccgtaacccgtttcccccgtaccgttacccgttgttacccggg

SEQ ID NO: 127988 - DNA, 695 bp, Homo sapiens
  misc_feature: GYAE6OF02GBLWW.45.87.H10.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaangccaccctctcctgcagggccagtcagggtnttaacagctacttgcctggtaaccaaacaaaacctggccaggctcccaggccccatcatctatcgacgcatcgaacgagggccacgtggcactcccagccaggttcaggtggctaggtgggtctgggacagtacttcgacctctccacctatcagccacgtccgtacggtacccctggtaacggtattttccggacctttaacttttaaccgtaccttcgtaccgtacgccgtaacggtccggttacgggacccggtaaccggacgggtaccgtaccgttacccggttaccggttttaccgggggaccggggtaaaccggggtaacccggtaacggggttacgggaacgtaacgttaaaccgaaaaccgtaacgttcggtacggtaccgtacgacctaaccgtacgttccttacggttccttacgtaccgtttacccgttaccccggtactacgttacccg

SEQ ID NO: 127989 - DNA, 699 bp, Homo sapiens
  misc_feature: GYAE6OF02GYO70.45.87.H10.1.454.CMB.1.raw
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (687)..(687): a, c, t, g, unknown or other
  misc_feature (687)..(687): n is a, c, g, or t
  modified_base (693)..(693): a, c, t, g, unknown or other
  misc_feature (693)..(693): n is a, c, g, or t
  modified_base (697)..(697): a, c, t, g, unknown or other
  misc_feature (697)..(697): n is a, c, g, or t
tcagacgcgatcgacacgaccggtgctcgatttagcagtactgcgttgggtttggggggaggaactgctcagttaggacccagagggaaccatggaagccccagctcagcttctcttcctcctggcactctggctccacgtcagggtgttaacagctacttagcctcggtaaccaacaaaaacctggaccaggctcccaggctcatcactctatgacgcactacgaacgacggggtccaacgtcgggacctacgtaccccgaacggaccgtagggttccaagggtcggacgtagggtcggggtcgtcggggaacacggtacttcaactctccacgtatcagcacgccgtggccctagacggtctttcgcctatttacgtactntctaagcacggtcctggaccgacgngcgctcctacggttcgggacggacgggacctaaggggacgaagtacaacgaaacgtacgtaggcggtctacgtccgaaccgtacgttaccgtacggtttcttaaccggttaccctttccgggtttaaccccctaccgttaccgttaaccttaccggtaaaccgttcccggttaacccgtacccgggttcggtttaaccgggtcggtaaccgggtccgggggtcttaccgggaacgtaccggggtacgggtaacagggtcgagttacggctactaacggngcgcgncgcngc

SEQ ID NO: 127990 - DNA, 713 bp, Homo sapiens
  misc_feature: GYAE6OF02FL77E.45.87.H10.1.454.CMB.1.raw
  modified_base (205)..(205): a, c, t, g, unknown or other
  misc_feature (205)..(205): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggcctcccagataccaccggagaaattgtgttgacacagtcctccagcccaccctgtctctgtctccgagggganacacgccaccctctcctgcgacgggccaggtaggagtgtacaagtaagtacgttaggcgtaggtaaccaacgaacgaaaccgtcggaccaggcctacccgaggtcctcctcactccatcgatcgccactacccgaacgacgggtccctacgggcccgtcccgaaggaccgtacgggttccgtggactagggtcggtacgtagggactagtacgttcacttcgtaccgtaccgtcgacgtcgacgtccgtaggacctccgtagtacgttgttacgttttcgacgtttacgtttactcgtacgtacgtacgtaccgtacggttcccgttacccgccgacccggtccgttaccgtaccgttaccggggtttccggggggaccggggtaccgggtacggggtacgggaacgtacggtacggaacggtacggacggttcgggacggtccgtacggaacctaccggttattcggttaccttccgttaccgtaccgtttccccgtacccgtaccg

SEQ ID NO: 127991 - DNA, 755 bp, Homo sapiens
  misc_feature: GYAE6OF02JIOZO.45.87.H10.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggcctcccagataccaccggataaattgtgttgacacagtctcagccacctgtccttgtctccgagggaancgcccacctctcctgcgaggccagtcagactattcgnggcagcttacgttagcctggtaccaggactaacggaacctcggccaggtccctccgaggcctacagtcctattcctaagtcgacctactaataccggaacgaccgggcctacggtcgacctacgtacccaggaccgtcggttacgaggtccgtacgtggtcgggtcgagggacctacgtaccgttacctacctcgtaccacgttacgtaccgacgtccgtaccggtacccggtacggtacccgtagggtaacggtttccgttttacgaacccgtttacgtttaaccgttacgttcggttaacggtacgtacggtacgggttaccggttacgggacccgtaacggggtccgttacccggtccgtttacccgggttacccgggttacggggacccgggtaaccgggtaaaccgtggggttaacggtacgtaaacccggtaaccggtaacggtaaccggtgggttacccggtaacgttacccggtaaccgtaccttacggttcggttaccgtttaacccg

SEQ ID NO: 127992 - DNA, 820 bp, Homo sapiens
  misc_feature: GYAE6OF02GTM2H.45.87.H10.1.454.CMB.1.raw
  modified_base (155)..(155): a, c, t, g, unknown or other
  misc_feature (155)..(155): n is a, c, g, or t
  modified_base (205)..(205): a, c, t, g, unknown or other
  misc_feature (205)..(205): n is a, c, g, or t
  modified_base (781)..(781): a, c, t, g, unknown or other
  misc_feature (781)..(781): n is a, c, g, or t
tcagacgcgatcgacacgaccggtgctcgatttagcagtactgcgttggggtttgggggaggaactgctcagttaggacccagagggtaaccatggaagaccccagctcagcttctcttcctcctggcactctggctaccagactaccaccgganaaattgtgttagacacagtctccagccacctgtcttgttccgagggaacngcccacctctcctgcgacggccagtccgagggttcgtaacagtctacgttacgcctggtaaccaaacaaaccgtcggaccacgggacctacccgaggtacctactaactaccgtaactccgttaagttaccgaccggtactaaccgtaaccgggtaaaccggtacggggtaccctacggtaccgggtaacctaccctccccggaaccggtacccgttacgggtttaaccgtacggggtacggtacccggttaagggggttccgggggtacgttaacgggggtaaaccctacgggttaacccttaccgtacccgttacccgtaacccgtaaccgtaacgttaccgacggtacccgtacggtaccccgttacggacccgttagggtaccgtttacttttccgactttaacgtttacgcgttacgtacctagaccgtaaggtccgtacgggaccgaccgacggtccaccgttacggtacccgtttaacggggcggttaaccgggaaccgtaagggtcggtaaacgtaaccgtacgaaacgttacgtcggtaacggtcgtaccgacctacgttaccgttntaccgttacgtcctaccgttccgttacccgacttaccgg

SEQ ID NO: 127993 - DNA, 803 bp, Homo sapiens
  misc_feature: GYAE6OF02JD090.45.87.H10.1.454.CMB.1.raw
  modified_base (445)..(445): a, c, t, g, unknown or other
  misc_feature (445)..(445): n is a, c, g, or t
tcagacgcgatcgacacgaccggtgctcgatttagcagtactgcgtgggttggtgcccaagctgctggagggcacggtcaccacgctgctgaggtgaacgaagcctgggtcctcggtgaaggtctacctgcgaaggctttctggaggcagcttcgagactaactttcctatcgagcgttgggtgacgacacgggtccctggacgaagggtcctggagtcggagtggaaacgtgtctagtacgaccgaaggtctttgaactacacgtacaagtacgtacgtccttagaagtaaacttcgaaccggtaccgtacgtccgtaacctaagtttaagttacggacggaacctactaaccgtttaaccgaccgaaccctaacaccggtaacttaccgaagtacggtacgcgtaacgacggaaacgtctacggtacgtacgtttaacggacnccgaaccggttacctaaagtttttcgttaccgttgcggttaccgagaccgggtttcggaccggggttacgaccggggtttacccttacggttcccggtaaacgtccgggttacgggaacccgggttaacggggtaacccggtaaggttccccgaaccggtttaccccggtacccgtctaccccgggtaacctaccccgaacgggttaaccgacccctacggtttccccggttaccctttaccccgggaccggtaccctttaccccgaacgaaccggttcacccgttcggtaaccgggtcggacctaaccggccgtaccggcccgtacggccgtaccgcgtacggtccggtaattcccg

SEQ ID NO: 127994 - DNA, 723 bp, Homo sapiens
  misc_feature: GYAE6OF02JXPUZ.45.87.H10.1.454.CMB.1.raw
  modified_base (199)..(199): a, c, t, g, unknown or other
  misc_feature (199)..(199): n is a, c, g, or t
  modified_base (322)..(322): a, c, t, g, unknown or other
  misc_feature (322)..(322): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctcagccacctgtctttgtttccagggtaanacgcctaccctctcctgcagggccagtcgagggtcttaacgacgtctacgttcgcctaggtaacccaaactaaaaccgtcggacctacggcctacccgaaggcctacactacgtactacttancggaactcctacgtacgaaccgcgggtacccacgtagggaccaactccccgaacgccggtaggttaccaaggttcggaccgttaagggtcggggttcccgtagggggtaacctaaccggttaccggttaacctaccgttcccttaaacgaaaccctcgtttaccgaacggcccgtaacggtcccgtacggtaaccccgtacggtaggttaaccgtttccgtaccgttaacgtttaacgtaacctcggttacgacgtacgtcgtaccgggttacgacccgtacggtaacgtcccgtgttacggttaccgtacggtacgggacggtacgtaggacgagacgtacgaactagtgtacgcggactcgcgttacgtctgttccgtactccgtaccttccgataccg

SEQ ID NO: 127995 - DNA, 754 bp, Homo sapiens
  misc_feature: GYAE6OF02HBON0.45.87.H10.1.454.CMB.1.raw
  modified_base (201)..(201): a, c, t, g, unknown or other
  misc_feature (201)..(201): n is a, c, g, or t
  modified_base (665)..(665): a, c, t, g, unknown or other
  misc_feature (665)..(665): n is a, c, g, or t
  modified_base (688)..(688): a, c, t, g, unknown or other
  misc_feature (688)..(688): n is a, c, g, or t
tcagacgcgatcgacacgaccggtgctcgatttagcagtactgcgttggggtttggggggaactgctcagttaggacccagagggaaccatggaagccccagctcagattctcttcctcctgctactctcggcccccagactaccaacggaaaaattgtgttgacacagtctcaggcaccctgtctctgtctccgaggganacagcccaccctctcctagcgacgggccagtaggagtcgtactaagtaagtacgttaggctcggtaaaccaacgaacgtaaaccgtcggaccgaacgggccctacccgaaggtccttacccttacgaactaccccgaagttacgaacgtacgacctaaccgttacccccgaaaacggttacccggggttccccgtacgggcccgttaccccggaagtaaccggtaacggggttcccggtagggccgtagggttccggggtacgtacggggaacgtaggtacgtttacccaccgttacctacccgaccgtcgaagcctaggccgtaggacgtcctagtattcgttaacgttttcgactttaacggtttccttacgtgttaccgaagtacccgaggttacccttccccggaccaccgtccgtctaccgggttaccggtcgggggaccggggtacaggggtacgtanaggtccgaaggacctagggtcgnggtctacggtacctactagtacgttctacgttacccgtactttcccgaccgtacgtacctgtaacg

SEQ ID NO: 127996 - DNA, 938 bp, Homo sapiens
  misc_feature: GYAE6OF02GYA3F.45.87.H10.1.454.CMB.1.raw
  modified_base (188)..(188): a, c, t, g, unknown or other
  misc_feature (188)..(188): n is a, c, g, or t
  modified_base (234)..(234): a, c, t, g, unknown or other
  misc_feature (234)..(234): n is a, c, g, or t
tcagacgcgatcgacacgaccggtgctcgatttagcagtactgcgtgggtttgggtgccaagctgctggaggcacggtcaccacgctgctgaggtgaagaagcccgtgggtcctcggtgaaggtcctccgtgcaaggcttcgtggaggcagcttcagtcaactttcctatcagcgtggtcgacgaacnggcccctggacgacgggccttaggagtcggatgggaagtagtccancgaccgaaacggtacttggaactacaggactaacgaaccttaccggtacctacgaacgtaaacgttcccgaaggaccgtaacgttccgaacctaacgtttagttaccggccggtaaccacgtaactacccgaacgaacccgtaaccgaacgcccttaaagcgtagggaacctaccgtaggaacgaacggcccgtaggagttaacttcggaaccgacgtaaccgggtcccttaagtttttacgtttaccgtcgttaacgggtcccgtaagggtaacgtccccgggtaacgggttcgggtacccgggtttaaccgtacccggttttaccggaaccgtttaaacccgggtcggggtaacccgaaacgggaaaccccggttaccggtacccggttaaccccggttacccgtacccgtaccggaaccgggttccctaacccggtaaacccggtaaacccgggaccccggttaacccgtttaaacccgggggtttcccccttttacccccccggttaacgggtaccccccggtaacccgttacccccgttaaccggttaaacccgggaacgttcccccttaaaccggggttcccccgggtttaacggggggaacccctaacccggggaaccccggtcccggggtaaccccggttcggggtaaccccggtttacgggccccggttttacccggtacggttaaacccccggg

SEQ ID NO: 127997 - DNA, 759 bp, Homo sapiens
  misc_feature: GYAE6OF02I5LI0.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaattgtgttgacacagtctccagccacctgtctttgttccgaaggggaaagcgccctaccctctcctgcgacggccagtcagagtatagaacagtacgttcggcctggtatacaatacgaagccgtcggacccgtacgggtccccgctccgtactactctatgattccgtcgttccgagccgaccgggacctacgtcggacctacctcccgaggcccgttacgggttcgacgggttgggtccggggtttcgggttacgaccgtaacgtacggttacctttaccgtaccgtaccgttaccaacgttacgtaccgtacgtacccgaccgttaccccgtaaccgtaaaacccgtttagggtaaacgttttacggtttcggaaccgttaaccggtttaaccgtttaacgtttacccgaacggttaaacccgaacgtaaccggtttaccgttacgtaacggttccggtaccgccggttacttaccgttaccggggtttccggggacggaacgggttaccaggggttacgaactaaccggtaacaacgggtctagggtcctaagtccgaacgtaccttcggttattccggtccttactaccgtcccgtcccgac

SEQ ID NO: 127998 - DNA, 600 bp, Homo sapiens
  misc_feature: GYAE6OF02GLUZG.45.87.H10.1.454.CMB.1.raw
  modified_base (176)..(176): a, c, t, g, unknown or other
  misc_feature (176)..(176): n is a, c, g, or t
  modified_base (353)..(353): a, c, t, g, unknown or other
  misc_feature (353)..(353): n is a, c, g, or t
  modified_base (429)..(429): a, c, t, g, unknown or other
  misc_feature (429)..(429): n is a, c, g, or t
  modified_base (533)..(533): a, c, t, g, unknown or other
  misc_feature (533)..(533): n is a, c, g, or t
  modified_base (553)..(553): a, c, t, g, unknown or other
  misc_feature (553)..(553): n is a, c, g, or t
  modified_base (564)..(564): a, c, t, g, unknown or other
  misc_feature (564)..(564): n is a, c, g, or t
  modified_base (571)..(571): a, c, t, g, unknown or other
  misc_feature (571)..(571): n is a, c, g, or t
  modified_base (581)..(581): a, c, t, g, unknown or other
  misc_feature (581)..(581): n is a, c, g, or t
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctgcaaggcttctggaggcagcttcagtcaactttcctatcagctgggncgacagccctggacagggctgagtggatgggaagagtcatcgccaagacttgatacgagcagactacgcttacgaaagtaacgttccgtaagggaccgtagtaccaaccgttagtttaattcgaaccgggactaaccgtacgtcccgaaaccggaacccaacgaccgacccgttaanacgtagggaacgtcgtaggaacgtaagccgtagaagtagttcgagtaccgacgtctatttacttcgtgtgcgtagngtcgcgtcgcgtctattccgacttcggcggacgacggtaaccacggtcctaccgtctaccgtcaccgtccaccgacgtaccggctaccgtccgttacctcccgngtccctaccgtcacgacgcnccgtcgtcggnggtaccncgtcgcggcnggtccacgcgtgactacgg

SEQ ID NO: 127999 - DNA, 725 bp, Homo sapiens
  misc_feature: GYAE6OF02H5QXF.45.87.H10.1.454.CMB.1.raw
  modified_base (705)..(705): a, c, t, g, unknown or other
  misc_feature (705)..(705): n is a, c, g, or t
  modified_base (714)..(714): a, c, t, g, unknown or other
  misc_feature (714)..(714): n is a, c, g, or t
  modified_base (721)..(721): a, c, t, g, unknown or other
  misc_feature (721)..(721): n is a, c, g, or t
tcagacgcgatcgacacgaccggtgctcgatttagcagtactgcgttgggtttgggggagaactgctcagttaggacccagagggaaccatggaagccacagctacagcttctcttcctcctggcactctggctccagtcaggtgttacagtctactagcctaggtaccaactaaaaacctgccaggctccgaggtctacatcatctagtgacgcagtcgaacgagggcctacgtcggcactacccgagccgtaggtcacggtgacgtaggttgggtacgttagggaccgaggttacttcaccttacgtaccaacccgtattaccgaacgccgtaaccgtaccgtacgggtacccgtaggtacggtttactttcgaccctttaagtttaccgtaacgttcgtacctaaggtacgacgtacggttcggaaccgtaccggacgtcgtaccttcgttaccggtacgggtacggacggtaacccggtaaggacggtaacgtaacgtaacgaaacggttacgtacggtcggtacgtcgtaacctacgtacttacgttcgttaccgttacgttaaccgttcccgttacccgtcctaacggtttccgtacgtaccgttacggaccgttccggtacgtcggtacgggtaacgggtccggtagttacggaaccgttaggaccgtaccgtaaaggtccgaggtctacacgttagngcgttaacncgtacgngtac

SEQ ID NO: 128000 - DNA, 770 bp, Homo sapiens
  misc_feature: GYAE6OF02G50BH.45.87.H10.1.454.CMB.1.raw
tcagacgcgatcgacacgaccggtgctcgatttagcagtactgcgtgggtttgggtgcccaagctgctggagggcacggtcaccacgctgctgaggtgaagaagcctgggtcctcggtgaaggtctcctagcaaggcttctggaggcagcttcagcaactttcctatcagctgggtgcgacgtacggcccctggacgaagggcctggagtgggacgtggggaagtagtcgaattcggacctaaaggtactttaggacttacgagcgaacggactacggctacgtaagtaaaacttcccgacggaccggagtccgtaactaagtttacttacggccggaactaacctacgttacccgaaaccggacccaaaccgacggacccttaaacgacgttagggacgcttacggaaggaaccgtccgtaggaagttacttacgggacctacgtaacccggtcctaagtttttacttttcgtacggttgaccggtaggtaccggggtcgtccgggtcggccggggtactttaccgttacgacgttaccggtcggggtacccggaacggggtaaccctacgggtccgacccgtaccgtcccgtcgtaacccgtcccgtacccaccggtaacccgggcccttaccgttcccgggttcccgttccccgtccgggtaccctaccccgttccaccgtaaccgcgaaccgtacccgtcgggtcgggaccgacgccggacccggtccgtcggggtacctcgggtccgttacggtacggtaaccgg

SEQ ID NO: 128001 - DNA, 905 bp, Homo sapiens
  misc_feature: GYAE6OF02JG8HS.45.87.H10.1.454.CMB.1.raw
tcagacgcgatcgacacgaccggtgctcgatttagcagtactgcgttgggtttggggaggaactgctcagttaggacccagagggaaccatggaagccccagctcagcttctcttcctcctggcactctggctccagataccaccggagaaattgtgtgacacagtctccagccacctgtctttgtttccaaggggaaagacgcccaccctctcctgccgtaacgggccagtcgagggttcttaacagtactacttagccgttacggtaaccaaaccgtaaaacctcgggaccacgggtccttaccccgaacgggtcctaccgtactaccgtacgttacctaacgttacgaacccggtactaacgtaaccggaaaacccggtaccggggtaccctaaccggttaccgggaaccttaaccgttacccccggtacggtaaccccggttaacgggtttcccgtaagggttcggggaaccttacgggggttaccgggggttacggttaccgggggaacgttaacgggtacccgtttacctaacccggtttaccgttacccggtaaaccggttaccgacgggtttaacccgaacggttccccgggttaaggggaccccgttaccggttaaaggtcctttacggggtttaacgttttcggtaaacccgtttaagttttaccggttaccgtaccggtttacaccggttacgtaccggttcccggtaccccgacgtaccctcccggtactccgggttaacccgggttacgggggaccccggggtagtacgggggtactacggaaggtaccggttaacggaccgtaccgttgggcggtttacgaccgttacggtaacccttacgtttccgtcggtttaccgtaacgttaccctttcccggtaacccctctacgg

SEQ ID NO: 128002 - DNA, 690 bp, Homo sapiens
  misc_feature: GYAE6OF02FVINO.45.87.H10.1.454.CMB.1.raw
  modified_base (122)..(122): a, c, t, g, unknown or other
  misc_feature (122)..(122): n is a, c, g, or t
  modified_base (143)..(143): a, c, t, g, unknown or other
  misc_feature (143)..(143): n is a, c, g, or t
  modified_base (179)..(179): a, c, t, g, unknown or other
  misc_feature (179)..(179): n is a, c, g, or t
  modified_base (218)..(218): a, c, t, g, unknown or other
  misc_feature (218)..(218): n is a, c, g, or t
  modified_base (435)..(435): a, c, t, g, unknown or other
  misc_feature (435)..(435): n is a, c, g, or t
tcagacgcgatcgacacgaccggtgctcgatttagcagtactgcgtgggtttcgggtgcccaagctgctggagggcacggtcgaccacgctgctgaggtgaagaagccgtgggtcctcggtnaaggtctcctgcaaggcttcnggagcagcttcagcaactttccatcagtcgtgggtncgacacggcccctaggacacgggcctgagtggatggganagtcatcgacctagactgactacagtacagtacctacgcctcgaagtaaacttccgaagggtacctacgttccaacgtattaagttcggaccggtacactacttacccgaaccgaacccactacgccctttaacgacgttacggaacgtccttaaggaacggtacgcccgtaggacttacggttcgacgtaccgacggtacttacgttttaattcgngtggactaggtacgtccggtacggcggtaccggtcgttacgttacgacgttacggcggggtaccgaccgggtaaccgcggtaccgtacccgtactcccgtcaccgtccctaccgaccggaccggtaccctacgtcccgttacccgtccccgcgtacccaccccgttctacccgatccgaccgaccgttcggacgggtaccaccggccggtaccggtcccggtacgggtccgtcggtcccgtaggtacctaaccgg

SEQ ID NO: 128003 - DNA, 853 bp, Homo sapiens
  misc_feature: GYAE6OF02F9LL6.45.87.H10.1.454.CMB.1.raw
  modified_base (201)..(201): a, c, t, g, unknown or other
  misc_feature (201)..(201): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggaaaaattgtgttgacacagtctccaggcacctgtctctgtctccgagggganacacgccacccgttctcctgccgacgggccgaaggtagggagtcgtacgaaggtaagttacgttaggaccttgggtaaccaaacgaacgtaaaacctagaccgaaggcctcccgaaggtccttcctacagttccaatagattcgactacgtaccgaaacggtcgggtcccgtgggacccgtaccccgaaggtaccgtacgggttccggtaggtacgtagggttcggggtcgttacgggggaacaacgggttactttacccgtacgttacctaccgacccggtataaccggcctaacggtccccggtaagggtaacggtcccgttaagggtaccgttttaaggttttacggttttttaaaccgggccgttttaaacgggtttttactttacccggtttacggtaaccgtaaccggttcgggtttaaccggtttcccgtttaacccccggacccgtaacccggtcccgtcccgttttaaaccggttacccgggggttttaccgggggggaccccggggggttaacggtacggggttaacggggtaacgtaacgggtagggtaaccgacgggtttacggcgggtggtaccgtacgaccgtacgtattttccggtactttcggtacccttacgttccccggttacccaccgtttcg

SEQ ID NO: 128004 - DNA, 726 bp, Homo sapiens
  misc_feature: GYAE6OF02HF7EA.45.87.H10.1.454.CMB.1.raw
tcagacgcgatcgacacgaccggtgctcgatttagcagtactgcgttgggtttgggggaggaactgctcagttaggacccagagggaaccatggaagccccagctcagcttctcttcctcctgctactctggctcccagaaaccattggagaatactgatgacgcagtttccagccaccctgtctgtgtctccgaggggaagcgcccaccctctcctgcgtcgggccagtccagtagtgttaagccaacctacttacgcccttggtaaccagacacgaaacctggcccaggcctcccagacctcctctatttagtcggtttcctcctaccgcggggtcctcgttaggtacctcccgagtcccgtagggttcccaggttccgaccgtaggtcgggtacgtacggggacaggtacgttcctaccgttctaccactaacgtcgaacgccgacgtccctagtccgtacgttacgttacggtaaacgtttacggttttacgtccgtttaacgtttttactttccgtacggttaccgtaacggtaccttaggttacctaccgttaagtaaccggttcggtacgtttacgttaacgttacggttttccgggaccggtaacgggtaaccgtagtaccggtaagtaaacgtacgtaaacggtccgtaggtacggtctaccggtacctacgtacgtaccgttaccggttccttacggttaccttccccgttacccg

SEQ ID NO: 128005 - DNA, 756 bp, Homo sapiens
  misc_feature: GYAE6OF02I0HV0.45.87.H10.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (382)..(382): a, c, t, g, unknown or other
  misc_feature (382)..(382): n is a, c, g, or t
  modified_base (497)..(497): a, c, t, g, unknown or other
  misc_feature (497)..(497): n is a, c, g, or t
tcagacgcgatcgacacgaccggtgctcgatttagcagtactgcgttgggtttgggaggaactgctcagttaggacccagaggaaccatggaacgccccagctcagcttctcttcctcctgcctctcgtggcctaccagataaccaccggtaaaattgtgttgactacgagtctaccgaggccacccgttgtccgtctcgtacgtcccgaagggganacgacgtccaccctcgtcncgcgacgcaggtacgtatcggacaaggttaactacggttacggactacggtaacaacgtacgaacgtcggaccaggtcctaaccgtacggacctccactaccttaccgatcgtactacgctaaccgaccgtaaacgtccggtaccncggtacccgtaccgaacgtacgttcgggtccgtagccggtacggtacggtacgagggaccgtagttaccggtacgtcctaacgtccgaccgtttacgacgtccggacgttccggngtaaccgtcgttagtacgttaggttaccgtttacgttaccgttagtttaaccgttgttaccgtagaccgttacgacgttccgtacccgtaccgtaccgtcccgttacgccgttaccggttcgggtaaccgggtaccgggtacggtacgtacggtacgtacggtacgtagtacgtaccggtcggttacgaaccgttccgaaccgtcttaaccggtcgttaccccggttataaccccggtttcgtaccccgtagttacccg

SEQ ID NO: 128006 - DNA, 299 bp, Homo sapiens
  misc_feature: GYAE6OF01BZ58V.1.60.F05.1.454.CMB.1.raw
  modified_base (292)..(299): a, c, t, g, unknown or other
  misc_feature (292)..(299): n is a, c, g, or t
tcagacgagtgcgtcacgaccggtgctcgatttagtacgtcatcatcgcgggaatacggggtccctgaccgattcagtggcagcgggtctgggacagatttcactctcaccatcagcagcctgcaggctgaagatgtggcagttttatttctgtcagcaatattatactactcttccaactttcggccctgggaccaaagtggctatcaaacgactgtggctgcaccatctgtcttcatccttcccaccctcctcacgcactcgtcctgagcgggctggcaaggcgcatagnnnnnnnn

SEQ ID NO: 128007 - DNA, 612 bp, Homo sapiens
  misc_feature: GYAE6OF01CJHN7.1.60.F05.1.454.CMB.1.raw
  modified_base (302)..(302): a, c, t, g, unknown or other
  misc_feature (302)..(302): n is a, c, g, or t
  modified_base (450)..(450): a, c, t, g, unknown or other
  misc_feature (450)..(450): n is a, c, g, or t
tcagacgagtgcgtcacgaccggtgctcgatttagtacgtcatcagggaaagggggaggaactgctcagttaggacccagacggaaccatggaagccccagcgcagcttctcttcctcctgctactctggctcccagataccgctggagaaatagtgatgacgcagtctccagtcaccctgtctgtgtctccgaggggaagcgccaccctctcctgcagggccagtcacagtatagcagctaacttgcctggtaccagcaacgaacctggccaggcctccgaggctcctcactctagtggtnctactcccgaccgacgggcccacgtcggtactccccgagtcccgtaggttccaggtcggcgtagggttcggggtcgtaggggacctaggttactttccacttcctaccacctatccgagccgtacgccgtgctagtcgtagtaagttntttgacttagtttactacgtgtacagtactaagttactaacgtacgtgtccttacgacggtaccgttacggaaccgtaagggtaaccgtaaagggtaacgaaacgtaccgtaaagtacggttcggtacggactacggtaccactatccttcgttccttaccg

SEQ ID NO: 128008 - DNA, 295 bp, Homo sapiens
  misc_feature: GYAE6OF02FTVIG.1.60.F05.1.454.CMB.1.raw
  modified_base (289)..(295): a, c, t, g, unknown or other
  misc_feature (289)..(295): n is a, c, g, or t
tcagacgagtgcgtcacgaccggtgctcgatttagtacgtcatcatcgcgggaatacggggtccctgaccgattcagtggcagcgggtctgggacagatttcactctcaccatcagcagcctgcaggctgaagatgtggcagtttatttctgtcagcaatattatactactcttccaactttcggccctgggaccaaagtggctatcaaacgaactgtggctgcaccatctgtcttcatcttcccgcatctgaacgcactcgtctgagcgggctggcaaggcgcatagnnnnnnn

SEQ ID NO: 128009 - DNA, 220 bp, Homo sapiens
  misc_feature: GYAE6OF01AG9DN.33.33.C11.1.454.CMB.1.raw
  modified_base (218)..(220): a, c, t, g, unknown or other
  misc_feature (218)..(220): n is a, c, g, or t
tcagtacacacactcacgaccggtgctcgatttagagtgagctcgttgggtttgggggaagaggaagactgacggtcctcccaggagttcaggtgctgggcaccttgggcacggggaggtgtgtcacaagatttgggctctgggcacagcggccctgggctgcctggtcaaggactacttccagtgtgtgtactgagcgggctggcaaggcgcatagnnn

SEQ ID NO: 128010 - DNA, 239 bp, Homo sapiens
  misc_feature: GYAE6OF01CI3PE.33.33.C11.1.454.CMB.1.raw
  modified_base (222)..(239): a, c, t, g, unknown or other
  misc_feature (222)..(239): n is a, c, g, or t
tcagtacacacactcacgaccggtgctcgatttagagtgagctcgttgggtttggggggaagaggaagactgacggtcctcccaggagttcaggtgctgggcaccttgggccacgggggaggtgtgtcacgaagatttgggctctgggcacagcggccctgggctgcctggtcaaggactacttccagtgtgtgtactgagcgggctggcaaggcgcatagnnnnnnnnnnnnnnnnnn

SEQ ID NO: 128011 - DNA, 223 bp, Homo sapiens
  misc_feature: GYAE6OF01A4XRZ.33.33.C11.1.454.CMB.1.raw
  modified_base (217)..(223): a, c, t, g, unknown or other
  misc_feature (217)..(223): n is a, c, g, or t
tcagtacacacactcacgaccggtgctcgatttagagtgagctcgttgggtttgggggaaggaggaagactgacggtcctcccaggagttcaggtgctggcaccttggcacggggaggtgtgtcacaagatttgggctctgggcacagcggccctgggctgcctggtcaaggactacttccagtgtgtgtactgagcgggctggcaaggcgcatagnnnnnnn

SEQ ID NO: 128012 - DNA, 221 bp, Homo sapiens
  misc_feature: GYAE6OF01E12NW.33.33.C11.1.454.CMB.1.raw
  modified_base (219)..(221): a, c, t, g, unknown or other
  misc_feature (219)..(221): n is a, c, g, or t
tcagtacacacactcacgaccggtgctcgatttagagtgagctcgttgggtttgggggaagaggaagactgacggtcctcccaggagttcaggtgctgggcaccttgggcacgggggaggtgtgtcacaagatttgggctctgggcacagcggccctgggctgcctggtcaaggactacttccagtgtgtgtactgagcgggctggcaaggcgcatagnnn

SEQ ID NO: 128013 - DNA, 221 bp, Homo sapiens
  misc_feature: GYAE6OF01DI9V3.33.33.C11.1.454.CMB.1.raw
  modified_base (219)..(221): a, c, t, g, unknown or other
  misc_feature (219)..(221): n is a, c, g, or t
tcagtacacacactcacgaccggtgctcgatttagagtgagctcgttgggtttggggggaagaggaagactgacggtcctcccaggagttcaggtgctgggcaccttgggcacgggggaggtgtgtcacaagatttgggctctgggcacagcggccctgggctgcctggtcaaggctacttccagtgtgtgtactgagcgggctggcaaggcgcatagnnn

SEQ ID NO: 128014 - DNA, 241 bp, Homo sapiens
  misc_feature: GYAE6OF01EE7EZ.33.33.C11.1.454.CMB.1.raw
  modified_base (221)..(241): a, c, t, g, unknown or other
  misc_feature (221)..(241): n is a, c, g, or t
tcagtacacacactcacgaccggtgctcgatttagagtgagctcgttgggtttgggggaagaggaagactgacggtcctcccaggagttcaggtgctgggctaccttgggcacgggggaggtgtgtcacaagatttgggctctgggcacagcggccctgggctgcctggtcaaggtactacttccagtgtgtgtactgagcgggctggcaaggcgcatagnnnnnnnnnnnnnnnnnnnnn

SEQ ID NO: 128015 - DNA, 230 bp, Homo sapiens
  misc_feature: GYAE6OF01DDJRP.33.33.C11.1.454.CMB.1.raw
  modified_base (223)..(230): a, c, t, g, unknown or other
  misc_feature (223)..(230): n is a, c, g, or t
tcagtacacacactcacgaccggtgctcgatttagagtgagctcgttgggtttggggggaagaggaagactgacggtcctcccaggagttcaggtgctgggcaccttgggcgacgggggaggtgtgtcaacaagtatttgggctcgtgggcacagcggccctgggctgcctggtcaaggactacttcagtgtgtgtactgagcgggctggcaaggcgcatagnnnnnnnn

SEQ ID NO: 128016 - DNA, 291 bp, Homo sapiens
  misc_feature: GYAE6OF01DES6S.33.33.C11.1.454.CMB.1.raw
  modified_base (226)..(230): a, c, t, g, unknown or other
  misc_feature (226)..(230): n is a, c, g, or t
  modified_base (232)..(232): a, c, t, g, unknown or other
  misc_feature (232)..(232): n is a, c, g, or t
  modified_base (234)..(291): a, c, t, g, unknown or other
  misc_feature (234)..(291): n is a, c, g, or t
tcagtacacacactcacgaccggtgctcgatttagagtgagctcgttggggtttgggggggaagaggaagactgacggtcctcccaggagttcaggtgctgggcaccgttgggcacgggggaggtgtgtcacaagatttgggctctgggcacagcggccctgggctgcctgggtcaaggctacttccagtgtgtgtactgagcgggctggcaagggcgcagtaggnnnnngngnnnnnnnnnnnnnnnnnnnnnnnnnnnnnnnnnnnnnnnnnnnnnnnnnnnnnnnnnn

SEQ ID NO: 128017 - DNA, 219 bp, Homo sapiens
  misc_feature: GYAE6OF02GI01W.33.33.C11.1.454.CMB.1.raw
  modified_base (217)..(219): a, c, t, g, unknown or other
  misc_feature (217)..(219): n is a, c, g, or t
tcagtacacacactcacgaccggtgctcgatttagagtgagctcgttgggtttggggaagaggaagactgacggtcctcccaggagttcaggtgctgggcaccttgggcacggggaggtgtgtcacaagatttgggctctgggcacagcggccctgggctgcctggtcaaggactacttccagtgtgtgtactgagcgggctggcaaggcgcatagnnn

SEQ ID NO: 128018 - DNA, 219 bp, Homo sapiens
  misc_feature: GYAE6OF02GJ0WC.33.33.C11.1.454.CMB.1.raw
  modified_base (218)..(219): a, c, t, g, unknown or other
  misc_feature (218)..(219): n is a, c, g, or t
tcagtacacacactcacgaccggtgctcgatttagagtgagctcgttgggtttgggggaagaggaagactgacggtcctcccaggagttcaggtgctgggcaccttgggcacggggaggtgtgtcacaagatttgggctctgggcacagcggccctgggctgcctggtcaaggactacttccagtgtgtgtactgagcgggctggcaaggcgcatagnn

SEQ ID NO: 128019 - DNA, 227 bp, Homo sapiens
  misc_feature: GYAE6OF02GR4HP.33.33.C11.1.454.CMB.1.raw
  modified_base (219)..(227): a, c, t, g, unknown or other
  misc_feature (219)..(227): n is a, c, g, or t
tcagtacacacactcacgaccggtgctcgatttagagtgagctcgttgggtttgggggaagaggaagactgacggtcctcccaggagttcaggtgctgggcaccttgggcacgggggaggtgtgtcacaagatttgggctctgggcacagcggccctgggctgcctggtcaaggactacttccagtgtgtgtactgagcgggctggcaaggcgcatagnnnnnnnnn

SEQ ID NO: 128020 - DNA, 221 bp, Homo sapiens; identical to SEQ ID NO: 128012
  misc_feature: GYAE6OF02IVW1Z.33.33.C11.1.454.CMB.1.raw
  modified_base (219)..(221): a, c, t, g, unknown or other
  misc_feature (219)..(221): n is a, c, g, or t

SEQ ID NO: 128021 - DNA, 247 bp, Homo sapiens
  misc_feature: GYAE6OF01DNWOH.2.70.G04.1.454.CMB.1.raw
  modified_base (244)..(247): a, c, t, g, unknown or other
  misc_feature (244)..(247): n is a, c, g, or t
tcagacgctcgacacacgaccggtgctcgatttagtgtagtgtgaagggaaagggccggcgcgggagcgaatgagttctgggccagggaaccctggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnn

SEQ ID NO: 128022 - DNA, 248 bp, Homo sapiens
  misc_feature: GYAE6OF01CDEEJ.2.70.G04.1.454.CMB.1.raw
  modified_base (246)..(248): a, c, t, g, unknown or other
  misc_feature (246)..(248): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnn

SEQ ID NO: 128023 - DNA, 249 bp, Homo sapiens
  misc_feature: GYAE6OF01BKSFG.2.70.G04.1.454.CMB.1.raw
  modified_base (246)..(249): a, c, t, g, unknown or other
  misc_feature (246)..(249): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnn

SEQ ID NO: 128024 - DNA, 250 bp, Homo sapiens
  misc_feature: GYAE6OF01DP71I.2.70.G04.1.454.CMB.1.raw
  modified_base (246)..(250): a, c, t, g, unknown or other
  misc_feature (246)..(250): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnn

SEQ ID NO: 128025 - DNA, 247 bp, Homo sapiens
  misc_feature: GYAE6OF01DHL0Y.2.70.G04.1.454.CMB.1.raw
  modified_base (245)..(247): a, c, t, g, unknown or other
  misc_feature (245)..(247): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgcctgctccaggagcacctccgagagcacagcggccctgggctgcctggtcaaggactacttcctgtcgagcgtctgagcgggctggcaaggcgcatagnnn

SEQ ID NO: 128026 - DNA, 248 bp, Homo sapiens; identical to SEQ ID NO: 128022
  misc_feature: GYAE6OF01B1EBK.2.70.G04.1.454.CMB.1.raw
  modified_base (246)..(248): a, c, t, g, unknown or other
  misc_feature (246)..(248): n is a, c, g, or t

SEQ ID NO: 128027 - DNA, 259 bp, Homo sapiens
  misc_feature: GYAE6OF01ECHT9.2.70.G04.1.454.CMB.1.raw
  modified_base (246)..(259): a, c, t, g, unknown or other
  misc_feature (246)..(259): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnnnnnnnnnnn

SEQ ID NO: 128028 - DNA, 249 bp, Homo sapiens
  misc_feature: GYAE6OF01D20YC.2.70.G04.1.454.CMB.1.raw
  modified_base (245)..(249): a, c, t, g, unknown or other
  misc_feature (245)..(249): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggcctgggctgcctggtcaaggactacttcctgtcgagcgtctgagcgggctggcaaggcgcatagnnnnn

SEQ ID NO: 128029 - DNA, 248 bp, Homo sapiens; identical to SEQ ID NO: 128022
  misc_feature: GYAE6OF01C4IFQ.2.70.G04.1.454.CMB.1.raw
  modified_base (246)..(248): a, c, t, g, unknown or other
  misc_feature (246)..(248): n is a, c, g, or t

SEQ ID NO: 128030 - DNA, 251 bp, Homo sapiens
  misc_feature: GYAE6OF01D5B16.2.70.G04.1.454.CMB.1.raw
  modified_base (245)..(251): a, c, t, g, unknown or other
  misc_feature (245)..(251): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggctacttcctgtcgagcgtctgagcgggctggcaaggcgcatagnnnnnnn

SEQ ID NO: 128031 - DNA, 252 bp, Homo sapiens
  misc_feature: GYAE6OF01DI8HP.2.70.G04.1.454.CMB.1.raw
  modified_base (247)..(252): a, c, t, g, unknown or other
  misc_feature (247)..(252): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnnn

SEQ ID NO: 128032 - DNA, 272 bp, Homo sapiens
  misc_feature: GYAE6OF01B2OBB.2.70.G04.1.454.CMB.1.raw
  modified_base (211)..(211): a, c, t, g, unknown or other
  misc_feature (211)..(211): n is a, c, g, or t
  modified_base (247)..(272): a, c, t, g, unknown or other
  misc_feature (247)..(272): n is a, c, g, or t
tcagacgctcgacacacgaccggtgctcgatttagtgtagtgtgaagggaaaggggccggcgcgggagcgaatgagttctgggccagggaaccctggtcaccgtctcctccagcctccaccaagggcccatcggtcttcccctggcgccctgctccaggagcacctccgagagcacagcggccctgggctgcctggtcaaggctacttccngtcgagcgtctgagcgggctggcaaggcgcagtagnnnnnnnnnnnnnnnnnnnnnnnnnn

SEQ ID NO: 128033 - DNA, 248 bp, Homo sapiens; identical to SEQ ID NO: 128022
  misc_feature: GYAE6OF01BNYDL.2.70.G04.1.454.CMB.1.raw
  modified_base (246)..(248): a, c, t, g, unknown or other
  misc_feature (246)..(248): n is a, c, g, or t

SEQ ID NO: 128034 - DNA, 247 bp, Homo sapiens
  misc_feature: GYAE6OF01DVEQC.2.70.G04.1.454.CMB.1.raw
  modified_base (246)..(247): a, c, t, g, unknown or other
  misc_feature (246)..(247): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnn

SEQ ID NO: 128035 - DNA, 249 bp, Homo sapiens; identical to SEQ ID NO: 128023
  misc_feature: GYAE6OF01B6TUC.2.70.G04.1.454.CMB.1.raw
  modified_base (246)..(249): a, c, t, g, unknown or other
  misc_feature (246)..(249): n is a, c, g, or t

SEQ ID NO: 128036 - DNA, 249 bp, Homo sapiens
  misc_feature: GYAE6OF01BZ07M.2.70.G04.1.454.CMB.1.raw
  modified_base (247)..(249): a, c, t, g, unknown or other
  misc_feature (247)..(249): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnn

SEQ ID NO: 128037 - DNA, 276 bp, Homo sapiens
  misc_feature: GYAE6OF01EADMZ.2.70.G04.1.454.CMB.1.raw
  modified_base (253)..(276): a, c, t, g, unknown or other
  misc_feature (253)..(276): n is a, c, g, or t
tcagacgctcgacacacgaccggtgctcgatttagtgtagtgtgaaggggaaagggccggcgccgggagcgaatgagttctggggtccagggaaccctggtcaccgtctcctcagcctccaccaagggcccatcggtcttcccctggcgccctgctccaggagtcacctccgagagctacagcggccctgggctgcctggtcaaggactacttcctggtcgagcgtctggagcgggctggcaaggcgcatagnnnnnnnnnnnnnnnnnnnnnnnn

SEQ ID NO: 128038 - DNA, 252 bp, Homo sapiens
  misc_feature: GYAE6OF01BQRBI.2.70.G04.1.454.CMB.1.raw
  modified_base (247)..(250): a, c, t, g, unknown or other
  misc_feature (247)..(250): n is a, c, g, or t
  modified_base (252)..(252): a, c, t, g, unknown or other
  misc_feature (252)..(252): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnntn

SEQ ID NO: 128039 - DNA, 249 bp, Homo sapiens; identical to SEQ ID NO: 128023
  misc_feature: GYAE6OF01DDVBJ.2.70.G04.1.454.CMB.1.raw
  modified_base (246)..(249): a, c, t, g, unknown or other
  misc_feature (246)..(249): n is a, c, g, or t

SEQ ID NO: 128040 - DNA, 249 bp, Homo sapiens
  misc_feature: GYAE6OF01BDES1.2.70.G04.1.454.CMB.1.raw
  modified_base (247)..(249): a, c, t, g, unknown or other
  misc_feature (247)..(249): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacgagcggccctgggctgcctggtcaaggactacttcctgtcgagcgtctgagcgggctggcaaggcgcatagnnn

SEQ ID NO: 128041 - DNA, 250 bp, Homo sapiens; identical to SEQ ID NO: 128024
  misc_feature: GYAE6OF01A914L.2.70.G04.1.454.CMB.1.raw
  modified_base (246)..(250): a, c, t, g, unknown or other
  misc_feature (246)..(250): n is a, c, g, or t

SEQ ID NO: 128042 - DNA, 250 bp, Homo sapiens
  misc_feature: GYAE6OF01C11FO.2.70.G04.1.454.CMB.1.raw
  modified_base (247)..(250): a, c, t, g, unknown or other
  misc_feature (247)..(250): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnn

SEQ ID NO: 128043 - DNA, 250 bp, Homo sapiens; identical to SEQ ID NO: 128042
  misc_feature: GYAE6OF01CE4HA.2.70.G04.1.454.CMB.1.raw
  modified_base (247)..(250): a, c, t, g, unknown or other
  misc_feature (247)..(250): n is a, c, g, or t

SEQ ID NO: 128044 - DNA, 249 bp, Homo sapiens; identical to SEQ ID NO: 128023
  misc_feature: GYAE6OF01ENHN8.2.70.G04.1.454.CMB.1.raw
  modified_base (246)..(249): a, c, t, g, unknown or other
  misc_feature (246)..(249): n is a, c, g, or t

SEQ ID NO: 128045 - DNA, 251 bp, Homo sapiens
  misc_feature: GYAE6OF01C0PCV.2.70.G04.1.454.CMB.1.raw
  modified_base (247)..(251): a, c, t, g, unknown or other
  misc_feature (247)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnn

SEQ ID NO: 128046 - DNA, 248 bp, Homo sapiens
  misc_feature: GYAE6OF01A1DLO.2.70.G04.1.454.CMB.1.raw
  modified_base (245)..(248): a, c, t, g, unknown or other
  misc_feature (245)..(248): n is a, c, g, or t
tcagacgctcgacacacgaccggtgctcgatttagtgtagtgtgaagggaaagggccggcgcgggagcgaatgagttctgggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnn

SEQ ID NO: 128047 - DNA, 284 bp, Homo sapiens
  misc_feature: GYAE6OF01ESQ6M.2.70.G04.1.454.CMB.1.raw
  modified_base (146)..(146): a, c, t, g, unknown or other
  misc_feature (146)..(146): n is a, c, g, or t
  modified_base (212)..(212): a, c, t, g, unknown or other
  misc_feature (212)..(212): n is a, c, g, or t
  modified_base (252)..(284): a, c, t, g, unknown or other
  misc_feature (252)..(284): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccaagggcccatcggtcttcccctggcnccctgctccaggtagcactccgagagtcacagcggccttgggctgcctggtcaaggactacttccngtcgagcgtctgaggcgggctgggccaaggcgcgatacgnnnnnnnnnnnnnnnnnnnnnnnnnnnnnnnnn

SEQ ID NO: 128048 - DNA, 248 bp, Homo sapiens; identical to SEQ ID NO: 128022
  misc_feature: GYAE6OF01A0YG4.2.70.G04.1.454.CMB.1.raw
  modified_base (246)..(248): a, c, t, g, unknown or other
  misc_feature (246)..(248): n is a, c, g, or t

SEQ ID NO: 128049 - DNA, 248 bp, Homo sapiens; identical to SEQ ID NO: 128022
  misc_feature: GYAE6OF01CH78U.2.70.G04.1.454.CMB.1.raw
  modified_base (246)..(248): a, c, t, g, unknown or other
  misc_feature (246)..(248): n is a, c, g, or t

SEQ ID NO: 128050 - DNA, 248 bp, Homo sapiens; identical to SEQ ID NO: 128022
  misc_feature: GYAE6OF01A8Q9S.2.70.G04.1.454.CMB.1.raw
  modified_base (246)..(248): a, c, t, g, unknown or other
  misc_feature (246)..(248): n is a, c, g, or t

SEQ ID NO: 128051 - DNA, 253 bp, Homo sapiens
  misc_feature: GYAE6OF01C9RZU.2.70.G04.1.454.CMB.1.raw
  modified_base (248)..(253): a, c, t, g, unknown or other
  misc_feature (248)..(253): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnn

SEQ ID NO: 128052 - DNA, 248 bp, Homo sapiens; identical to SEQ ID NO: 128022
  misc_feature: GYAE6OF01EMSU9.2.70.G04.1.454.CMB.1.raw
  modified_base (246)..(248): a, c, t, g, unknown or other
  misc_feature (246)..(248): n is a, c, g, or t

SEQ ID NO: 128053 - DNA, 247 bp, Homo sapiens; identical to SEQ ID NO: 128034
  misc_feature: GYAE6OF01BANTY.2.70.G04.1.454.CMB.1.raw
  modified_base (246)..(247): a, c, t, g, unknown or other
  misc_feature (246)..(247): n is a, c, g, or t

SEQ ID NO: 128054 - DNA, 247 bp, Homo sapiens; identical to SEQ ID NO: 128034
  misc_feature: GYAE6OF01BGTOJ.2.70.G04.1.454.CMB.1.raw
  modified_base (246)..(247): a, c, t, g, unknown or other
  misc_feature (246)..(247): n is a, c, g, or t

SEQ ID NO: 128055 - DNA, 272 bp, Homo sapiens
  misc_feature: GYAE6OF01BXRXF.2.70.G04.1.454.CMB.1.raw
  modified_base (249)..(272): a, c, t, g, unknown or other
  misc_feature (249)..(272): n is a, c, g, or t
tcagacgctcgacacacgaccggtgctcgatttagtgtagtgtgaagggaaagggccggcgacggggagcgaatgagttctggggccagggaaccctggtcaccgtctccctcagcctccaccaagggcccatcggtcttccccctggcgccctgctccaggagcacctccgagagcacagcggccctgggctgcctggtcaaggctacttcctgtcgagcgtctgagcgggctggcaaggcgcatagnnnnnnnnnnnnnnnnnnnnnnnn

SEQ ID NO: 128056 - DNA, 250 bp, Homo sapiens; identical to SEQ ID NO: 128024
  misc_feature: GYAE6OF01DWYVC.2.70.G04.1.454.CMB.1.raw
  modified_base (246)..(250): a, c, t, g, unknown or other
  misc_feature (246)..(250): n is a, c, g, or t

SEQ ID NO: 128057 - DNA, 254 bp, Homo sapiens
  misc_feature: GYAE6OF01A7KTA.2.70.G04.1.454.CMB.1.raw
  modified_base (248)..(254): a, c, t, g, unknown or other
  misc_feature (248)..(254): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnn

SEQ ID NO: 128058 - DNA, 251 bp, Homo sapiens
  misc_feature: GYAE6OF01A6CZ6.2.70.G04.1.454.CMB.1.raw
  modified_base (247)..(251): a, c, t, g, unknown or other
  misc_feature (247)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaggactacttcctgtcgagcgtctgagcgggctggcaaggcgcatagnnnnn

SEQ ID NO: 128059 - DNA, 511 bp, Homo sapiens
  misc_feature: GYAE6OF01BRAU9.2.70.G04.1.454.CMB.1.raw
  modified_base (499)..(499): a, c, t, g, unknown or other
  misc_feature (499)..(499): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacagcttctcctggtaccagcagaaacctggccacgctcccaggctcctcatctatgctacattcagcagcgccactggcatcccagacaggttcagtggctaggtgggtctgggacagtagttcactctcaccatcagcagactggacgcctgagtatttgcgtagtgtattactgtctatcgagtgtgggtctcgagcgtgcgtagtttcggcgtagggaccaggcgtaggagatacgaacgacgtggtacggntcgcgccgtacg

SEQ ID NO: 128060 - DNA, 502 bp, Homo sapiens
  misc_feature: GYAE6OF01EQHBY.2.70.G04.1.454.CMB.1.raw
  modified_base (246)..(246): a, c, t, g, unknown or other
  misc_feature (246)..(246): n is a, c, g, or t
  modified_base (474)..(474): a, c, t, g, unknown or other
  misc_feature (474)..(474): n is a, c, g, or t
  modified_base (497)..(497): a, c, t, g, unknown or other
  misc_feature (497)..(497): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacagagttcactctcaccatcagcagactggagcctgaggtattttgctagtgtattactgtcatcagtgtgggtctcgagtcgtgcgtagtttggccgaggggaccaggcgtggagngtacgaaacgacgtgtggctgcncgtac

SEQ ID NO: 128061 - DNA, 252 bp, Homo sapiens
  misc_feature: GYAE6OF01DAJVH.2.70.G04.1.454.CMB.1.raw
  modified_base (246)..(252): a, c, t, g, unknown or other
  misc_feature (246)..(252): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnnnn

SEQ ID NO: 128062 - DNA, 514 bp, Homo sapiens
  misc_feature: GYAE6OF01A2YTG.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacagagttcactctcaccatcagcagactggagccgtgaggtatttgctagtgtattactgtcatcagtgtgggtctcgagtcgtgcgtaggtttggccgtagggtaccgaaggtcgtaggaggatacgaaacgaacgtggtaggctgcgaccgtacg

SEQ ID NO: 128063 - DNA, 249 bp, Homo sapiens; identical to SEQ ID NO: 128023
  misc_feature: GYAE6OF01DAOFG.2.70.G04.1.454.CMB.1.raw
  modified_base (246)..(249): a, c, t, g, unknown or other
  misc_feature (246)..(249): n is a, c, g, or t

SEQ ID NO: 128064 - DNA, 249 bp, Homo sapiens; identical to SEQ ID NO: 128023
  misc_feature: GYAE6OF01AJG9I.2.70.G04.1.454.CMB.1.raw
  modified_base (246)..(249): a, c, t, g, unknown or other
  misc_feature (246)..(249): n is a, c, g, or t

SEQ ID NO: 128065 - DNA, 250 bp, Homo sapiens
  misc_feature: GYAE6OF01B8455.2.70.G04.1.454.CMB.1.raw
  modified_base (245)..(250): a, c, t, g, unknown or other
  misc_feature (245)..(250): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgcctgctccaggagcacctccgagagcacagcggccctgggctgcctggtcaaggactacttcctgtcgagcgtctgagcgggctggcaaggcgcatagnnnnnn

SEQ ID NO: 128066 - DNA, 255 bp, Homo sapiens
  misc_feature: GYAE6OF01EULC9.2.70.G04.1.454.CMB.1.raw
  modified_base (246)..(255): a, c, t, g, unknown or other
  misc_feature (246)..(255): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcggctggcaaggcgcatagnnnnnnnnnn

SEQ ID NO: 128067 - DNA, 772 bp, Homo sapiens
  misc_feature: GYAE6OF01B02ZK.2.70.G04.1.454.CMB.1.raw
tcagacgctcgacacacgaccggtgctcgatttagtgtagtgtgaagggaaagggggaaggaggctgctccagttagggacccagagggaacctatggaaaccccagccgccaggctttctcttccgtcctgtctactctcggctcccagactaccaccggagtaaactgttgttcgacgcgagttcgtccgaggcacccttgtcctttcgtctccaaggggtaaagagcccaccctcggtccttgcgagggccagtcaggacctgttcggctaggaaactgtcttcactggtaccaggcagaacctggccaccgctacccaggcctaccggtacgacttcgtaagttcggaccttacaatttacaacgtctaaggcgtccgaacgtggcctacgtaccccaagtaccgtaaggttccgaaggttcggacgtaaggggttccgggtacgttacggggaacctacggtacgtttaccgaacggttaccgtaacccaaccgtacgtaaccgaacgaccgtaacgtacgttacggtacgtaccgtaggtaacgggttacgttttacggaccgtaggttcgttaaacgttaccgtcgtacgtaacgttcgtaacggttggttacggggttaccttaccggtaggtaccggttacgggtacggttacggggttttaccgggaccgggtaacggggtaaccttaaacgggtccgttaacggggtacgtacgtaccgaaacggtaacgtggtacggtcgtacggacgtacccgtaacgg

SEQ ID NO: 128068 - DNA, 499 bp, Homo sapiens
  misc_feature: GYAE6OF01BT6SO.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (471)..(471): a, c, t, g, unknown or other
  misc_feature (471)..(471): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacagagttcactctcaccatcagcagactggagcctgaggtattttgctagtgtattactgtcatcagtgtgggtctcgagcgtgctagtttggccgtagggaccagcgtggagntacgaaacgacgtgtggntgcncgtacg

SEQ ID NO: 128069 - DNA, 250 bp, Homo sapiens; identical to SEQ ID NO: 128042
  misc_feature: GYAE6OF01C5LGX.2.70.G04.1.454.CMB.1.raw
  modified_base (247)..(250): a, c, t, g, unknown or other
  misc_feature (247)..(250): n is a, c, g, or t

SEQ ID NO: 128070 - DNA, 248 bp, Homo sapiens
  misc_feature: GYAE6OF01E47IW.2.70.G04.1.454.CMB.1.raw
  modified_base (246)..(248): a, c, t, g, unknown or other
  misc_feature (246)..(248): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctgatcaaggactacttcctgtcgagcgtctgagcgggctggcaaggcgcatagnnn

SEQ ID NO: 128071 - DNA, 274 bp, Homo sapiens
  misc_feature: GYAE6OF01C5ER6.2.70.G04.1.454.CMB.1.raw
  modified_base (253)..(274): a, c, t, g, unknown or other
  misc_feature (253)..(274): n is a, c, g, or t
tcagacgctcgacacacgaccggtgctcgatttagtgtagtgtgaagggaaaggggccggcgcgggagccgaatgagttctggggccagggaaccctggtcaccgtctcctcagcctccaccaaggcccatcggtctcccctggcgccctgctccaggagcacctccgagagcacagcggcctgggctgcctggtcaaggactacgttcctggtacgagcgtctgagcgggctagggcaagggcgcattaagnnnnnnnnnnnnnnnnnnnnnn

SEQ ID NO: 128072 - DNA, 250 bp, Homo sapiens; identical to SEQ ID NO: 128042
  misc_feature: GYAE6OF01CK4LY.2.70.G04.1.454.CMB.1.raw
  modified_base (247)..(250): a, c, t, g, unknown or other
  misc_feature (247)..(250): n is a, c, g, or t

SEQ ID NO: 128073 - DNA, 250 bp, Homo sapiens; identical to SEQ ID NO: 128024
  misc_feature: GYAE6OF01EL3GO.2.70.G04.1.454.CMB.1.raw
  modified_base (246)..(250): a, c, t, g, unknown or other
  misc_feature (246)..(250): n is a, c, g, or t

SEQ ID NO: 128074 - DNA, 248 bp, Homo sapiens; identical to SEQ ID NO: 128022
  misc_feature: GYAE6OF01AYQGN.2.70.G04.1.454.CMB.1.raw
  modified_base (246)..(248): a, c, t, g, unknown or other
  misc_feature (246)..(248): n is a, c, g, or t

SEQ ID NO: 128075 - DNA, 248 bp, Homo sapiens; identical to SEQ ID NO: 128022
  misc_feature: GYAE6OF01D3T3Y.2.70.G04.1.454.CMB.1.raw
  modified_base (246)..(248): a, c, t, g, unknown or other
  misc_feature (246)..(248): n is a, c, g, or t

SEQ ID NO: 128076 - DNA, 251 bp, Homo sapiens; identical to SEQ ID NO: 128045
  misc_feature: GYAE6OF01C2R33.2.70.G04.1.454.CMB.1.raw
  modified_base (247)..(251): a, c, t, g, unknown or other
  misc_feature (247)..(251): n is a, c, g, or t

SEQ ID NO: 128077 - DNA, 274 bp, Homo sapiens
  misc_feature: GYAE6OF01D09A1.2.70.G04.1.454.CMB.1.raw
  modified_base (253)..(274): a, c, t, g, unknown or other
  misc_feature (253)..(274): n is a, c, g, or t
tcagacgctcgacacacgaccggtgctcgatttagtgtagtgtgaagggaaaggggccgggcgcgggagcgaatgagttctggggccagggaaccctggtcaccgtctcctcagcctccaccaagggcccatcggtcttccccctggcgccctgctccaggagcacctccggagagcacagcggccctgggcctgcctggtcaaggctacttcctgtcgagcggtctgagcgggctgggccaaggcgcatagnnnnnnnnnnnnnnnnnnnnnn

SEQ ID NO: 128078 - DNA, 249 bp, Homo sapiens; identical to SEQ ID NO: 128036
  misc_feature: GYAE6OF01CJJKU.2.70.G04.1.454.CMB.1.raw
  modified_base (247)..(249): a, c, t, g, unknown or other
  misc_feature (247)..(249): n is a, c, g, or t

SEQ ID NO: 128079 - DNA, 249 bp, Homo sapiens
  misc_feature: GYAE6OF01CVA1Y.2.70.G04.1.454.CMB.1.raw
  modified_base (246)..(249): a, c, t, g, unknown or other
  misc_feature (246)..(249): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcaccctcctccaagagcacctctgggggcacagcggccctgggctgactggtcaaggactacttcctgtcgagcgtctgagcgggctggcaaggcgcatagnnnn

SEQ ID NO: 128080 - DNA, 248 bp, Homo sapiens
  misc_feature: GYAE6OF01EA4BF.2.70.G04.1.454.CMB.1.raw
  modified_base (246)..(248): a, c, t, g, unknown or other
  misc_feature (246)..(248): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtgagcgtctgagcgggctggcaaggcgcatagnnn

SEQ ID NO: 128081 - DNA, 252 bp, Homo sapiens; identical to SEQ ID NO: 128031
  misc_feature: GYAE6OF01CZLTS.2.70.G04.1.454.CMB.1.raw
  modified_base (247)..(252): a, c, t, g, unknown or other
  misc_feature (247)..(252): n is a, c, g, or t

SEQ ID NO: 128082 - DNA, 549 bp, Homo sapiens
  misc_feature: GYAE6OF01AYKJW.2.70.G04.1.454.CMB.1.raw
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacagcttctcctggtaccagcagaaacctggccacgctcccaggctcctcatctatgctacattcagcagcgccacgtggcactcccagacaggttcagtcggcaggtgggtctgggacaggtacgttcactctcaccatcagcagacgtggacgccgtgaggtatttgcgtagtgtattactgtacatacgtaggttggtgggtctcgagtcggtgtacgtaggtttcggaccgtaggggaccgaaggtcgtagggacgtacgtacgaaacggtaacgtcggtacggtacgtcgccgaccgtacg

SEQ ID NO: 128083 - DNA, 594 bp, Homo sapiens
  misc_feature: GYAE6OF01BY4Z1.2.70.G04.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaanagccaccctctcttgcagggccagtcagactgttggcagaacngcttcnctgtaccagcagaaacctggaccacgcctccaggcctctcatctatcgctacattcagcagcgcatgcatccagacaggttcagtcgcagtcgggctgggacaggtagttcacgttcacaccatcgagcgtagacgtaggacgtccgtaggaacggttatttggacgtagttacgttaagttacgttgtactagttcgaaggttggttcggggtcttacggtacggtaccggtgtacggttaggttttcgggaccgtaaggggtacccgaaggtaccggttagggaacgtacgtaaccgtaaaacgtacgttaggtacggtactacggtacgtaccgtaacg

SEQ ID NO: 128084 - DNA, 252 bp, Homo sapiens; identical to SEQ ID NO: 128031
  misc_feature: GYAE6OF01AONUZ.2.70.G04.1.454.CMB.1.raw
  modified_base (247)..(252): a, c, t, g, unknown or other
  misc_feature (247)..(252): n is a, c, g, or t

SEQ ID NO: 128085 - DNA, 251 bp, Homo sapiens
  misc_feature: GYAE6OF01EOL5M.2.70.G04.1.454.CMB.1.raw
  modified_base (248)..(251): a, c, t, g, unknown or other
  misc_feature (248)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnn

SEQ ID NO: 128086 - DNA, 503 bp, Homo sapiens
  misc_feature: GYAE6OF01AL4IJ.2.70.G04.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (498)..(498): a, c, t, g, unknown or other
  misc_feature (498)..(498): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacaggagttcactctcaccatcagcagactggagcctgaggtatttgctagtgtattactgtcatctagtgtgggtctcgagcgtgctaggtttggccgaggggaccaggcgtggagctacgaaacgacgtggtggactgcnctacg

SEQ ID NO: 128087 - DNA, 508 bp, Homo sapiens
  misc_feature: GYAE6OF01BZM3G.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (374)..(374): a, c, t, g, unknown or other
  misc_feature (374)..(374): n is a, c, g, or t
  modified_base (480)..(480): a, c, t, g, unknown or other
  misc_feature (480)..(480): n is a, c, g, or t
  modified_base (503)..(503): a, c, t, g, unknown or other
  misc_feature (503)..(503): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaacngcttctcctggtaccagcagaaacctggccacgctcccaggcctcctcatctatgctacattcagcagccgccactggcatccccagaccaggttcagtggcaggtgggtctgggacagagttcactcncaccatcagcagactggagcctgaggtatttgctagtgtattctgtcatcagtgtgggtctgagcgtgtctaggtttcggccgtaggggaccaaggccgtaggagntaccgaaacgactggtggctgcncgtac

SEQ ID NO: 128088 - DNA, 571 bp, Homo sapiens
  misc_feature: GYAE6OF01CGF20.2.70.G04.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgtggcagaaacngcttcnctggtaccagcagaaacctggccacgctccaggctcctcatctatgctacattcagcagcgccactggcactccagacaggttcagtggcaggtcgggtctgggacaggtacgtttcactctacacctatcagcacgacgtaggacgtccgtaggtaggtatttgactagttagtatttacgtgtactagtcgtaggttggtcgggtctacgtacggtcgtggtcgttacggttttcggaccggtacggggtaccgtaaggtcgtagggaaggtacgtaaccgtaaacggtaacgtaggtacggtactacgacgacgtacg

SEQ ID NO: 128089 - DNA, 248 bp, Homo sapiens; identical to SEQ ID NO: 128022
  misc_feature: GYAE6OF01A7XQ8.2.70.G04.1.454.CMB.1.raw
  modified_base (246)..(248): a, c, t, g, unknown or other
  misc_feature (246)..(248): n is a, c, g, or t

SEQ ID NO: 128090 - DNA, 249 bp, Homo sapiens; identical to SEQ ID NO: 128023
  misc_feature: GYAE6OF01EID71.2.70.G04.1.454.CMB.1.raw
  modified_base (246)..(249): a, c, t, g, unknown or other
  misc_feature (246)..(249): n is a, c, g, or t

SEQ ID NO: 128091 - DNA, 665 bp, Homo sapiens
  misc_feature: GYAE6OF01ADA88.2.70.G04.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccacctctcttgcagggccagtcagactgttgcagaacngcttctcctgtaccagcagaacctggccacgctccaggctctcatctatgctacattcagcacgcgccactcggcaactccccgaagacctagggttccaggtcggactaggttcggggtccgtggggaacctaggtacgtttaccacttcctaccgtaacccgtattaccgagaccgtaacggaacgttcgggacgtaccgttaggtaacgggttattttcggaccgttaagttacgtttaactttacgttgttactacgttacgtaggttgggttcggggttaccttacgtacggtcggttggtaccgttagggttttccgggaccggtaacgggggtaaccgaaacggtcggttagggaacggtaccgttaaccgaaaacgtacgttacgggtacggtacgtacggcccgtaacgtacg

SEQ ID NO: 128092 - DNA, 250 bp, Homo sapiens
  misc_feature: GYAE6OF01BYUP3.2.70.G04.1.454.CMB.1.raw
  modified_base (248)..(250): a, c, t, g, unknown or other
  misc_feature (248)..(250): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnn

SEQ ID NO: 128093 - DNA, 250 bp, Homo sapiens
  misc_feature: GYAE6OF01B3ZNV.2.70.G04.1.454.CMB.1.raw
  modified_base (246)..(250): a, c, t, g, unknown or other
  misc_feature (246)..(250): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggcctgggctgcctggtcaaggactacttcctgtcgagcgtctgagcgggctggcaaggcgcatagnnnnn

SEQ ID NO: 128094 - DNA, 537 bp, Homo sapiens
  misc_feature: GYAE6OF01B442B.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctcccaggctcctcatctatgctacattcagcagcgccactggcatcccagacaggttcagtggcaggtgggtctgggacaggtagttcacgtctacaccatcagcagactggacgccgtggaggtatttgctagtgtattactgtctatcgtagtggtgggtctcgagtcgtgtcgtaggtttcggaccgtaggggacctaaggtcgtaggaggtacgtacgaaacgtaacgtcggtacggcgtcgccgtacgtacg

SEQ ID NO: 128095 - DNA, 254 bp, Homo sapiens
  misc_feature: GYAE6OF01D2AQS.2.70.G04.1.454.CMB.1.raw
  modified_base (247)..(254): a, c, t, g, unknown or other
  misc_feature (247)..(254): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnnn

SEQ ID NO: 128096 - DNA, 253 bp, Homo sapiens
  misc_feature: GYAE6OF01DERJ6.2.70.G04.1.454.CMB.1.raw
  modified_base (246)..(253): a, c, t, g, unknown or other
  misc_feature (246)..(253): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgcctgctccaggagcacctccgagagcacagcggccctgggctgcctggtcaaggactacttcctgtcgagcgtctgagcgggctggcaaggcgcatagnnnnnnnn

SEQ ID NO: 128097 - DNA, 527 bp, Homo sapiens
  misc_feature: GYAE6OF01DH6LL.2.70.G04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtcttgctccaggggaaangccaccctntctgcaggccagtcagactgtgcagaaacgcttcncctggtaccagcagaaacctggccacgctcccaggctcctcatctatgctacattcagcagccgccactggcactcccagacaggttcaggtggcgagttgggtctggggacaggtacgttcgactctacaccgatcagcagactagggacgccgtgaaggttatttgcgtagtagtattactgttcatcgtaggtggtgggtctgagcgtgtcgtagtttggccgagggaccaaggtcgtaggagtacgtacgaaacgtacgtggtagcgtagccgactacg

SEQ ID NO: 128098 - DNA, 246 bp, Homo sapiens
  misc_feature: GYAE6OF01EFXMX.2.70.G04.1.454.CMB.1.raw
  modified_base (245)..(246): a, c, t, g, unknown or other
  misc_feature (245)..(246): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgcctgctccaggagcacctccgagagcacagcggccctgggctgcctggtcaaggactacttcctgtcgagcgtctgagcgggctggcaaggcgcatagnn

SEQ ID NO: 128099 - DNA, 250 bp, Homo sapiens; identical to SEQ ID NO: 128042
  misc_feature: GYAE6OF01D3C65.2.70.G04.1.454.CMB.1.raw
  modified_base (247)..(250): a, c, t, g, unknown or other
  misc_feature (247)..(250): n is a, c, g, or t

SEQ ID NO: 128100 - DNA, 673 bp, Homo sapiens
  misc_feature: GYAE6OF01CXGO4.2.70.G04.1.454.CMB.1.raw
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
tcagacgctcgacacacgaccggtgctcgatttagtgtagtgtgaaggggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaaggggaaanacgccaccctctcttgcgagggccagtcagtactgttggacaagaaacngtcttctccgtggtaccagacaacgaacctggaccacgccncccaggcctcctactatctactcgactactattcagcacgccgccacgtcgcactacccgagacgtacggttcaggtcgacgtagggtcgggtacgtagggactaggtacgttccgaaccttccgtaccacctagtaccgaacggaccgaacggtacgtacgggacgtaccgttagggtaaggtttaacgtttcggacgttaggttacgttaacttacgttcgtactacggttcggtaggttcgggttacgggtcttacgggtaggttccgttagggtccggtttagggtttccggaaccgggtaacgggtacgacgggtcgtaaggggactacgtaaacggtaaaccgtacgtcgggactacgacgccgtaagttcg

SEQ ID NO: 128101 - DNA, 249 bp, Homo sapiens
  misc_feature: GYAE6OF01CLE6F.2.70.G04.1.454.CMB.1.raw
  modified_base (246)..(249): a, c, t, g, unknown or other
  misc_feature (246)..(249): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggctacttcctgtcgagcgtctgagcgggctggcaaggcgcatagnnnn

SEQ ID NO: 128102 - DNA, 252 bp, Homo sapiens; identical to SEQ ID NO: 128031
  misc_feature: GYAE6OF01CGR3J.2.70.G04.1.454.CMB.1.raw
  modified_base (247)..(252): a, c, t, g, unknown or other
  misc_feature (247)..(252): n is a, c, g, or t

SEQ ID NO: 128103 - DNA, 314 bp, Homo sapiens
  misc_feature: GYAE6OF01CCTPW.2.70.G04.1.454.CMB.1.raw
  modified_base (147)..(147): a, c, t, g, unknown or other
  misc_feature (147)..(147): n is a, c, g, or t
  modified_base (152)..(152): a, c, t, g, unknown or other
  misc_feature (152)..(152): n is a, c, g, or t
  modified_base (166)..(166): a, c, t, g, unknown or other
  misc_feature (166)..(166): n is a, c, g, or t
  modified_base (232)..(232): a, c, t, g, unknown or other
  misc_feature (232)..(232): n is a, c, g, or t
  modified_base (259)..(261): a, c, t, g, unknown or other
  misc_feature (259)..(261): n is a, c, g, or t
  modified_base (264)..(314): a, c, t, g, unknown or other
  misc_feature (264)..(314): n is a, c, g, or t
tcagacgctcgacacacgaccggtgctcgatttagtgtagtgtgaagggaaagggggccggcggcgggagcgaatgagttctggggccagggaaccctggtcgaccgtctcctcagccctccaccaagggcccatcggtcttccccnggccnccctgctccgaggngcacctccgagagcaacagcggccctggggctgcctggtcaaggactactcctggtcgaagtcgtntgagcgggctggcaaaggcgcaatagnnncannnnnnnnnnnnnnnnnnnnnnnnnnnnnnnnnnnnnnnnnnnnnnnnnnn

SEQ ID NO: 128104 - DNA, 250 bp, Homo sapiens; identical to SEQ ID NO: 128092
  misc_feature: GYAE6OF01D9FSA.2.70.G04.1.454.CMB.1.raw
  modified_base (248)..(250): a, c, t, g, unknown or other
  misc_feature (248)..(250): n is a, c, g, or t

SEQ ID NO: 128105 - DNA, 301 bp, Homo sapiens
  misc_feature: GYAE6OF01BU5NX.2.70.G04.1.454.CMB.1.raw
  modified_base (151)..(151): a, c, t, g, unknown or other
  misc_feature (151)..(151): n is a, c, g, or t
  modified_base (258)..(259): a, c, t, g, unknown or other
  misc_feature (258)..(259): n is a, c, g, or t
  modified_base (261)..(301): a, c, t, g, unknown or other
  misc_feature (261)..(301): n is a, c, g, or t
tcagacgctcgacacacgaccggtgctcgatttagtgtagtgtgaagggaaaggggccggcgcgggagcgaatgagttctggggccagggaaccctgggtcaccgtctcctcagccctccaccaagggcccatccggtcttccccctggcnccctgctccaggagcacctccggagagcacgagcggccctgggctgcctggtcaaggtctacttcctgtcgagtacgtctgagcgggctagggcaaggcgcgatagnngnnnnnnnnnnnnnnnnnnnnnnnnnnnnnnnnnnnnnnnnn

SEQ ID NO: 128106 - DNA, 252 bp, Homo sapiens
  misc_feature: GYAE6OF01DIHQO.2.70.G04.1.454.CMB.1.raw
  modified_base (247)..(252): a, c, t, g, unknown or other
  misc_feature (247)..(252): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcggctggcaaggcgcatagnnnnnn

SEQ ID NO: 128107 - DNA, 280 bp, Homo sapiens
  misc_feature: GYAE6OF01A0QN3.2.70.G04.1.454.CMB.1.raw
  modified_base (257)..(280): a, c, t, g, unknown or other
  misc_feature (257)..(280): n is a, c, g, or t
tcagacgctcgacacacgaccggtgctcgatttagtgtagtgtgaagggaaagggccgggcgcgggagcgaatgagttctggggccagggaaccctggtcaccgtctcctcgagcctccaccaagggccccatccggtccttccccctggccgccctgctccgaggagccacctccgagacgcacagccggccctgggcctgcctggtcaaggctacttcctgtcgagcgtctgagcgggctggcaaggcgcatagnnnnnnnnnnnnnnnnnnnnnnnn

SEQ ID NO: 128108 - DNA, 250 bp, Homo sapiens; identical to SEQ ID NO: 128042
  misc_feature: GYAE6OF01B5HX8.2.70.G04.1.454.CMB.1.raw
  modified_base (247)..(250): a, c, t, g, unknown or other
  misc_feature (247)..(250): n is a, c, g, or t

SEQ ID NO: 128109 - DNA, 525 bp, Homo sapiens
  misc_feature: GYAE6OF01COVZA.2.70.G04.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttggcagaaacngcttcnctggtaccagcagaaacctggccacgctcccaggctcctcatctatgctacattcagcagcgccactggcatcccagacaggttcagtgcagtggtctgggacagagttcactctcaccatcagcagactggacgccgtagaggtattttgctagttgtattacgtgtactagtcgtagttggtggggtctcgagtcgtgtcgtaggtttcggccgaggggacctaaggtcgtagggacgtatacgaaacgacgtggtagactcgcacgtacg

SEQ ID NO: 128110 - DNA, 278 bp, Homo sapiens
  misc_feature: GYAE6OF01B74OQ.2.70.G04.1.454.CMB.1.raw
  modified_base (253)..(278): a, c, t, g, unknown or other
  misc_feature (253)..(278): n is a, c, g, or t
tcagacgctcgacacacgaccggtgctcgatttagtgtagtgtgaagggaaaggggccggcgcgggagcgaactgagttctggggccagggaaccctggtcaccgtctcctcagcctccaccaagggcccatcggtcttcccctggcgccctgctccaggagcaccgttccgagagcactagcggccctgggctgcctggtcaaggattacttcctgtcgaggcgtctgagcgggctgggcaaggcgcatagnnnnnnnnnnnnnnnnnnnnnnnnnn

SEQ ID NO: 128111 - DNA, 553 bp, Homo sapiens
  misc_feature: GYAE6OF01BFKA5.2.70.G04.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (315)..(315): a, c, t, g, unknown or other
  misc_feature (315)..(315): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaangccaccctctcttgcagggccagtcagactgttggcagaaacngcttctcctggtaccagcagaaacctggccacgctcccaggctcctcatctatgctacattcagcagcnccactgcatcccagacaggttcaggtcgcaggtggtctgggacaggtagttcacttctacaccgatcagcagtactggacgccgtgaggtattttggctaggttgtattacgtgtctattctaaggtggttcgggtctcgaggtcgtggcgttacggtttggaccgtacggggaacctaaggtcgtagggagtacgtaacgaaaacggacgttggtacggtacgtcgccgtacgtacg

SEQ ID NO: 128112 - DNA, 518 bp, Homo sapiens
  misc_feature: GYAE6OF01BU97W.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttctcctggtaccagcagaaacctggccacgctcccaggcctcctcatctatgctacattcagcagcgccactggcactcccagacaggttcagtggcaggtgggtctgggacagtacgttcactctcaccatcagcagactgggagccgtggagtatttgctagtgtattctgtctatcgagttggtgggtctcgagtcgtgctaggtttcggaccgtaggggacctaaggcgtaggagtatacgaaacgacgtggtagctgcacgtacg

SEQ ID NO: 128113 - DNA, 718 bp, Homo sapiens
  misc_feature: GYAE6OF01C8V4O.2.70.G04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtcttgtctccaggggaaangccaccctntcttgcagggccagtcagactgtggcagaaacngcttcnctggaccagcagaacctggccacgctccaggcctctcatctatgctacnttcagcagcgaccagtggacactccagacngttcgagtggcaggtggtcngggactaggtacgttcgaccttctacgaccctatacgacgacgaacgtacgtacgggacgtccggtacggtaagggttacgttttacggacgttaacggttacgtttaactttaccggttacgttacgttacgttacgtaagggttcgggtttacgggggttacccgttacggtaacgggttccggtttacgggttaccggtttagggtttttaccggggaacccgggttaaaccgggggtaaacccggtaaacgggtaccgggttaacggggttaaaccgggtaaacgttaaacccgggtaaaaccgggttaaccggttacgggttaaccggggtaccgttacggtaaccccgtaacccgttaacccgg

SEQ ID NO: 128114 - DNA, 250 bp, Homo sapiens; identical to SEQ ID NO: 128042
  misc_feature: GYAE6OF01BWFYL.2.70.G04.1.454.CMB.1.raw
  modified_base (247)..(250): a, c, t, g, unknown or other
  misc_feature (247)..(250): n is a, c, g, or t

SEQ ID NO: 128115 - DNA, 545 bp, Homo sapiens
  misc_feature: GYAE6OF01BDEQ5.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (365)..(365): a, c, t, g, unknown or other
  misc_feature (365)..(365): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttctcctggtaccagcaagaaacctggccacgctcccaggcctcctcatctatgctacattcagcagcgccactggcatcccagacaggttcagtggcaggtgggtctggggacaggngtttcacgtctcaccatcagcagacgtggagccgtgaggtatttgctagttgttattactgttcattcaggttggttgggtctcgtaggtcgtgtctaggttttcggccgtaggggaccgaaggtcgtaggaggtacgtaacgaaaccggtaacgttggtacggacgtggccaccgtacg

SEQ ID NO: 128116 - DNA, 251 bp, Homo sapiens; identical to SEQ ID NO: 128045
  misc_feature: GYAE6OF01C20X6.2.70.G04.1.454.CMB.1.raw
  modified_base (247)..(251): a, c, t, g, unknown or other
  misc_feature (247)..(251): n is a, c, g, or t

SEQ ID NO: 128117 - DNA, 246 bp, Homo sapiens
  misc_feature: GYAE6OF01EGKT4.2.70.G04.1.454.CMB.1.raw
  modified_base (245)..(246): a, c, t, g, unknown or other
  misc_feature (245)..(246): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcggctggcaggcgcaatcgnn

SEQ ID NO: 128118 - DNA, 304 bp, Homo sapiens
  misc_feature: GYAE6OF01B78LP.2.70.G04.1.454.CMB.1.raw
  modified_base (258)..(268): a, c, t, g, unknown or other
  misc_feature (258)..(268): n is a, c, g, or t
  modified_base (270)..(275): a, c, t, g, unknown or other
  misc_feature (270)..(275): n is a, c, g, or t
  modified_base (277)..(304): a, c, t, g, unknown or other
  misc_feature (277)..(304): n is a, c, g, or t
tcagacgctcgacacacgaccggtgctcgatttagtgtagtgtgaagggaaagggggccggcgcgggagcgaatgagttctgggggccagggaaccctggtcaccggtctccgtcagcctccacctaagggccccaatccggtcttcccccctggcgccctgcgtcccagggacgcacctccgacgagcacagccggcctgggctgcctggtcaggactactcctgtcagcgtctgagcggctggcaaggcgcatagnnnnnnnnnnnannnnnncnnnnnnnnnnnnnnnnnnnnnnnnnnnn

SEQ ID NO: 128119 - DNA, 626 bp, Homo sapiens
  misc_feature: GYAE6OF01ASMEF.2.70.G04.1.454.CMB.1.raw
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
  modified_base (606)..(606): a, c, t, g, unknown or other
  misc_feature (606)..(606): n is a, c, g, or t
tcagacgctcgacacacgaccggtgctcgatttagtgtagtgtgaagggaaagggggaggagcgtgacgtcagttaggacccagagggaaccatggaaaccccagcgcagcttctcttcctcctgctactctggctcccagataccaccggagaaactgtgttgacgcagtctccaggcaccctgtctttgtctccgaggggaaangccaccctctcttgcagggccagtcagctgttggcagaaacngcttcnctggtaccagcagaacctggccacgctcccaggcctcctacntctagtcgcttacagttcagccaggcctccacgtggctacacccagacctaggttccaggtcgcgtggttcgggtccgtaggggacctaggtactttcactctaccacatacacgcagacgtacggngaccgtaggacgttatttcgacgtagttagttacttacgtggtctaagttcgtaggttagggttcggggttcctaacggtacggtcggttacggtccgttagggtttttcgggcccggtaaggggtaccccggtaaggtccgttagggacgtacgtaaccgaaaccggttaacgtggtacggngttacgtccgtaacccgttg

SEQ ID NO: 128120 - DNA, 619 bp, Homo sapiens
  misc_feature: GYAE6OF01EP5OL.2.70.G04.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtctttgctcgagggaaangccacctntcttgcaggccagtcagactgttggcaagaaacngtcttctcctggtaccagacaacgaaacctggaccacgcctcccaggcctcctcatctatcgctactattcagcacgccgcctacgtgcactccagactaggttcagtcggcgtaggtcgggtcgtagggacagtacgttcactctacacctatacacgtacagacgtacggacgtccgtagtaggttactttggacgttaggttacgttaacgtttacgtcgtacgtagttacgtagggtcgggttcggggtcttacggtacggttcgtacggtacgttagggtttcgggaccggtaacggggtaaccgtaacgggtcgtaagggagtaacgtaacggtaaacgtacgtacgggtacgtacgtcggacctacgtacg

SEQ ID NO: 128121 - DNA, 671 bp, Homo sapiens
  misc_feature: GYAE6OF01CPHLU.2.70.G04.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtcttgctccgaaggggaangccacctctctgcagggccagtcagactgtggcagaaacngcttcncctggtaccagcagaacctggccacgctcccaggctcctcatctatcgctacnttcagcagccgaccacgtggaccacgtcccaagctaggttcaggtggctaggtcgggtctaggggacctaggtacgtttccaacgttctaccgacctatacgaacggacgaacggtacgtagggtacgtaccgtaggtaacggttagttttcggacgtaaggttcgtttagtttacgttcggtactagttacgtaagggttcggggttgggttaccgttggacggtcggttacggtccgttagggttttaccgggaccgggtacgggggtaaacccgtaacgggtacgggtaggggtaaacgtaacggttaaccgaaaaaccgggttacggtacgggttacgggaccgttaacggacccgtaaccgtaacg

SEQ ID NO: 128122 - DNA, 724 bp, Homo sapiens
  misc_feature: GYAE6OF01C67GZ.2.70.G04.1.454.CMB.1.raw
  modified_base (197)..(197): a, c, t, g, unknown or other
  misc_feature (197)..(197): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtcttgctcgagggaanagccacctctcttgcgagggccagtcagtactgttggcagaacngcttcncctggtaccagcacgaacctggccacgctcccgaggcctcctcatcgtatcgcctacattccgagcacggccnccaagtcggacctacgtcccaaggtacgtacgggtttccaagggtcggacgtaggttcggggtcgtacgggggaactagggttacggtttacccaccttaccgtacctaaccgtacgttccgaacgtaccgtaacggtaacggtacggggacgtaccggttaaggtaagggttacgtttcggacgtaggtttacgttaactttacgttggtactacgttcggtaggttagggtcggggttacctcggtaacggttcggttacgtacggtttacgggtttacgggacccgggtaacgggggtacctaacgggtccggttaaggggaacgttaaccggttaaccgggaaaacggttaccgggttagggttacgggtacccgtaacgggtcccctaaacggttaccg

SEQ ID NO: 128123 - DNA, 270 bp, Homo sapiens
  misc_feature: GYAE6OF01B358M.2.70.G04.1.454.CMB.1.raw
  modified_base (248)..(270): a, c, t, g, unknown or other
  misc_feature (248)..(270): n is a, c, g, or t
tcagacgctcgacacacgaccggtgctcgatttagtgtagtgtgaagggaaaggggccggcggcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctggcaaggcgcatagnnnnnnnnnnnnnnnnnnnnnnn

SEQ ID NO: 128124 - DNA, 542 bp, Homo sapiens
  misc_feature: GYAE6OF01B7QCQ.2.70.G04.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (307)..(307): a, c, t, g, unknown or other
  misc_feature (307)..(307): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccgaggggaaangccaccctctctgcagggccagtcagactgtggcagaaacngcttctcctggtaccagcaagaaacctggccacgctccaggctcctcatctatgctacattcancagccgccatggcactcccagacaggttcaggtcggcaggtgggtctagggacaggtagttcactctacgacatcagcagactggacgccgtaggagtatttgctagtgtattactgtcagtcgagtggtgggtctgacgtcgtgtacgtaggtttcggaccggtacggggaccaaggcgtagggagtacgtacgtaaacggtacgttcggtacggaccgtcgaccgtacgtacg

SEQ ID NO: 128125 - DNA, 250 bp, Homo sapiens
  misc_feature: GYAE6OF01DC2XK.2.70.G04.1.454.CMB.1.raw
  modified_base (244)..(250): a, c, t, g, unknown or other
  misc_feature (244)..(250): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaaggcccatcggtcttcccctggcgcctgctccaggagcacctccgagagcacagcggccctgggctgcctggtcaaggactacttcctgtcgagcgtctgagcgggctggcaaggcgcatagnnnnnnn

SEQ ID NO: 128126 - DNA, 540 bp, Homo sapiens
  misc_feature: GYAE6OF01BJWC4.2.70.G04.1.454.CMB.1.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (446)..(446): a, c, t, g, unknown or other
  misc_feature (446)..(446): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccacctctcttgcagggccagtcagactgtggcagaaacngcttcnctggtaccagcagaaacctggccacgctccaggctctcatctatgctacattcagcagcgccactggcactcccagacaggttcagtggctaggtgggtctgggacaggtagttcactctcacctatcagcacgacgtaggacgtcgtgacggtatttgctagtgtattactgtctatcgtagtggtgggtctcgngtcgtgtcgtaggtttggaccgtacggggacctaacggtcgtagggagtacgtacgaaacggtaacgtaggtcggtacgtcgaccgtacgtacg

SEQ ID NO: 128127 - DNA, 248 bp, Homo sapiens
  misc_feature: GYAE6OF01CCTZP.2.70.G04.1.454.CMB.1.raw
  modified_base (244)..(248): a, c, t, g, unknown or other
  misc_feature (244)..(248): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaaggcccatcggtcttcccctggcgcctgctccaggagcacctccgagagcacagcggccctgggctgcctggtcaaggactacttcctgtcgagcgtctgagcgggctggcaaggcgcatagnnnnn

SEQ ID NO: 128128 - DNA, 253 bp, Homo sapiens
  misc_feature: GYAE6OF01B7XXI.2.70.G04.1.454.CMB.1.raw
  modified_base (247)..(253): a, c, t, g, unknown or other
  misc_feature (247)..(253): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnnnn

SEQ ID NO: 128129 - DNA, 510 bp, Homo sapiens
  misc_feature: GYAE6OF01AWWGA.2.70.G04.1.454.CMB.1.raw
  modified_base (246)..(246): a, c, t, g, unknown or other
  misc_feature (246)..(246): n is a, c, g, or t
  modified_base (438)..(438): a, c, t, g, unknown or other
  misc_feature (438)..(438): n is a, c, g, or t
  modified_base (504)..(504): a, c, t, g, unknown or other
  misc_feature (504)..(504): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacagagttcactctcaccatcagcagactggacgccgtgaggtatttgctaggtgtattactgtcatcagtggtgggtctgngtcgtgctaggtttggccgagggaccaggtcgtgggagtactacgaaacgacgtggtaggctcgcncgtacg

SEQ ID NO: 128130 - DNA, 521 bp, Homo sapiens
  misc_feature: GYAE6OF01D6S8D.2.70.G04.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgtgcagaaacgcttcncctggtaccagcagaaacctggccacgctcccaggctcctcatctatgctacattcagcagcgccactggcactcccagacaggttcagtggcaggtgggtctgggacaggagttcactctcaccatcagcaagcgtggacgcctaggtagtatttgctagttgtattactgtcatcagttggtggggtctcgagtcgtgcgtaggtttcggcgaggggaccaaggtcgtaggagtactacgaaacgaacgtcggacgtctcgcaccgtacg

SEQ ID NO: 128131 - DNA, 680 bp, Homo sapiens
  misc_feature: GYAE6OF01CFEKX.2.70.G04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctntcttgcagggccagtcagactgtggcagaaacngcttcnctggtaccagcagaacctggccacgcctcccaggctcctcatctatgctacnttcagcagcncagtgcactccagactaggttcagtggctaggtcgggtcgtgggactaggtacgttccacgttcctacgacctagtccgaacggtccgaacggtacgtacggggacgtccggtagggtaacgggtttattttacgggacgttaaggtttacggttaacttttaccgttcggttactaacgtttacgttaagggtttcgggttcgggggttaccttacggtaacgggtccggttagggtccggtttaacggggttttcgggacccgggtaaagggggacccttaacgggtacggttacggggaaggttaaccgtaaccggtaaacggtaacggttcggtacgggccttacggaccgtaaccgttacgg

SEQ ID NO: 128132 - DNA, 253 bp, Homo sapiens
  misc_feature: GYAE6OF01EA1NF.2.70.G04.1.454.CMB.1.raw
  modified_base (247)..(253): a, c, t, g, unknown or other
  misc_feature (247)..(253): n is a, c, g, or t
tcagacgctcgacacacgaccggtgctcgatttagtgtagtgtgaagggaaaggggtcggcgcgggagcgaatgagttctggggccagggaaccctggtcaccgtctcctcagcctccaccaaggcccatcggtcttccccctggcgccctgctccaggagcacctccgagagcacagcggccctgggctgcctggtcaaggactacttcctgtcgagcgtctgagcgggctggcaaggcgcatagnnnnnnn

SEQ ID NO: 128133 - DNA, 605 bp, Homo sapiens
  misc_feature: GYAE6OF01CO5F0.2.70.G04.1.454.CMB.1.raw
  modified_base (205)..(205): a, c, t, g, unknown or other
  misc_feature (205)..(205): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaaggggaaagngccaccctctcttgcagggccagtcagactgtggcaagaaacngcttcnctggtaccagcaagaaacctggccacgcctcccgaggcctcctcatctatgctacattcagcagcgccaacgtggcactcccagacaggttcagtggcaggtgggtcgtgggacaggtacgttcaccgtctaccgaacctatacacgacaacggtaccgtagggacgtccgtaggaagggttattttggacgtaagttgttactttacgtcgtactaagttcgtaaggttgggttacggggttctacgaggtcgtggtcgttagggtttcggaccggtaggggaccaaggtcgtagggaagtaacgtaccgaaaacggtacgtaggtacggacgttacgcctaccgttacg

SEQ ID NO: 128134 - DNA, 572 bp, Homo sapiens
  misc_feature: GYAE6OF01BNNVV.2.70.G04.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagcccaccctctcttgcagggccagtcagactgttggcagaaacngcttctcctggtaccagcaagaaacctggccacgcctcccaggctcctcatctatgctacattccagcagcgccactggcatccccagacaggttcagtggcaggtgggtctgggacaggagttcacttctacacctatacagacagactgggagccgtggtaggtagtttgacgtagttgttagttactgtctatcgtaaggttggttcgggtctcgagtcggtgtcgtaggtttcggaccggtaggggaaccgtaaggtacggtaggaaggtaacgtaccgaaaacgtaacgtgggtacggacgtacggtacctaccgtaacg

SEQ ID NO: 128135 - DNA, 250 bp, Homo sapiens; identical to SEQ ID NO: 128024
  misc_feature: GYAE6OF01CANZC.2.70.G04.1.454.CMB.1.raw
  modified_base (246)..(250): a, c, t, g, unknown or other
  misc_feature (246)..(250): n is a, c, g, or t

SEQ ID NO: 128136 - DNA, 699 bp, Homo sapiens
  misc_feature: GYAE6OF01ARTXA.2.70.G04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccaggggaaangccaccctntcttgcagggccagtcagactgtggcagaaacgcttcnctggtaccagcaagaacctggccacgctcccaggcctctcatctatgctacattcagcagccgccactggcactcccaagcgtaggttccagtgggactaggtcggggtctaggggactaggtacgtttccaacgttcctaccgacctagtaccgacggaccgtaacggtaccgttagggaaccggtccgttagggtaacggtttacgttttacggaccgtaaggttacgtttaacgtttacgttcgttactaacgtacgtaacgggttagggttacggggttaccgtacggtacggtcggttacggtaccgtttaacgggttttaccggggaccggtaaacgggggtaacccgtaaacgggtccggtaaggggtaacggtaacgttaaacccggaaaccggttaacggttacgggtacggtaccgttacggtacccgtaacccgttaacg

SEQ ID NO: 128137 - DNA, 249 bp, Homo sapiens; identical to SEQ ID NO: 128036
  misc_feature: GYAE6OF01AN4G5.2.70.G04.1.454.CMB.1.raw
  modified_base (247)..(249): a, c, t, g, unknown or other
  misc_feature (247)..(249): n is a, c, g, or t

SEQ ID NO: 128138 - DNA, 656 bp, Homo sapiens
  misc_feature: GYAE6OF01EQ1KT.2.70.G04.1.454.CMB.1.raw
  modified_base (247)..(247): a, c, t, g, unknown or other
  misc_feature (247)..(247): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccgaggggaaagagccaccctctcttgcgagggccagtcagactgttggcagaaacngcttctccgtggtaccagcaacgaaacctggccacgctcccaggctcctcatcctatgactactattcagcagccgcacgtcggcactccccaggactacggttacaggtggcgtaggtcggggtctaggggaactaggtacgttcgacttccgtacaccgactacgaacgtcgaagtacgtagggactccgtaggacggttaagtttcgacggtagttcggtttaactttacgtcggtactacttacggtaggtttcgggttacggggtccttacgggtacggtcggttggtacggtttaccgggtttagggaacccgggttacgggaaccgtacggtacgtaggggaacctaacgtaaccgtaaaacggtacgttagggttccgaggtccgtaacgtaccgttaccg

SEQ ID NO: 128139 - DNA, 250 bp, Homo sapiens; identical to SEQ ID NO: 128065
  misc_feature: GYAE6OF01CC1TH.2.70.G04.1.454.CMB.1.raw
  modified_base (245)..(250): a, c, t, g, unknown or other
  misc_feature (245)..(250): n is a, c, g, or t

SEQ ID NO: 128140 - DNA, 251 bp, Homo sapiens
  misc_feature: GYAE6OF01C70ZE.2.70.G04.1.454.CMB.1.raw
  modified_base (246)..(251): a, c, t, g, unknown or other
  misc_feature (246)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgtctggtcaaggactacttcctgtcgagcgtctgagcggctggcaaggcgcatagnnnnnn

SEQ ID NO: 128141 - DNA, 264 bp, Homo sapiens
  misc_feature: GYAE6OF01BJ1TY.2.70.G04.1.454.CMB.1.raw
  modified_base (140)..(140): a, c, t, g, unknown or other
  misc_feature (140)..(140): n is a, c, g, or t
  modified_base (144)..(144): a, c, t, g, unknown or other
  misc_feature (144)..(144): n is a, c, g, or t
  modified_base (205)..(205): a, c, t, g, unknown or other
  misc_feature (205)..(205): n is a, c, g, or t
  modified_base (239)..(264): a, c, t, g, unknown or other
  misc_feature (239)..(264): n is a, c, g, or t
tcagacgctcgacacacgaccggtgctcgatttagtgtagtgtgaagggaaaggggccggcggcgggagcgaatgagttctggggccagggaaccctggtcaccgtctcctcagcctccaccaaggccatcgtctccccnggcncctgctccaggagcacctccgagagcacagcgtcctggctgcctggtcaaggctacttccngtcagcgtctgagcgggctggcaaggcgcatagnnnnnnnnnnnnnnnnnnnnnnnnnn

SEQ ID NO: 128142 - DNA, 536 bp, Homo sapiens
  misc_feature: GYAE6OF01A66W0.2.70.G04.1.454.CMB.1.raw
  modified_base (246)..(246): a, c, t, g, unknown or other
  misc_feature (246)..(246): n is a, c, g, or t
  modified_base (352)..(352): a, c, t, g, unknown or other
  misc_feature (352)..(352): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaacctggccacgctcccaggcctcctcatctatgctacattcagcagcgccatgcactcccagacaggttcagtgcaggtggtcngggacaggtacgttcacttcgtacaccgatcagcagtacgtggacgccgtaggaggtatttgacgtagttgttattactgtactagtcgtaggttggtgggtctcgagtcgtgtctaggtttcggccgagggaccagtcgtaggacgtatacgaaacgtacgtcggtagactcgccgaccgtag

SEQ ID NO: 128143 - DNA, 252 bp, Homo sapiens
  misc_feature: GYAE6OF01AQACO.2.70.G04.1.454.CMB.1.raw
  modified_base (248)..(252): a, c, t, g, unknown or other
  misc_feature (248)..(252): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnn

SEQ ID NO: 128144 - DNA, 549 bp, Homo sapiens
  misc_feature: GYAE6OF01EJZGY.2.70.G04.1.454.CMB.1.raw
  modified_base (202)..(202): a, c, t, g, unknown or other
  misc_feature (202)..(202): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgtggcagaaacgcttctctggaccagcagaacctggccacgctccaggctcctcatctatgctacattcagcagcaccatggcactcccagacaggttcagtggacaggtgggtctagggacaggtacgttcactctcactatcgagcagactggacgcgtaggtaggtattttgcgtagttagttacttacgtcgtactattcgaggttggtcgggttctcgtaggtcgtgtcgttaggtttcggaccggtaggggtaccgtaggtcgtaggacgtagtaacgaaacggtacgtcggtaggactacgtcacgtacg

SEQ ID NO: 128145 - DNA, 707 bp, Homo sapiens
  misc_feature: GYAE6OF01C0HKN.2.70.G04.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccaggggaaancgccaccctntcttgcagggccagtcagactgttgcagaaacngcttcnctggtaccagcagaacctggccacgctcccaggcctcctcatctatcgctacattcagcacgcgccacgtcggaccactccccaagacctaggttcagggtcggcgtaggttcgggtctggggaactaggtacgtttcaccttcgtaccacctagtacctaacggaccgtaacggtaccggtacgggacgtacccggttaggtaacggggtttagtttttacgggacgttaacgggttttacggttaacgttttaaccgttggttacctaagttccgttaagggtttcgggttacggggtttccgttacggtacggttcggttacggttccggtttagggttttccgggacccgggtaacgggggtaacccgtaacgggtccggtagggtaacggtaacgttaaaccggtaaaaccggtacgttacgggtacggtacgttaccggacctaccgtacg

SEQ ID NO: 128146 - DNA, 252 bp, Homo sapiens
  misc_feature: GYAE6OF01BLZG2.2.70.G04.1.454.CMB.1.raw
  modified_base (248)..(252): a, c, t, g, unknown or other
  misc_feature (248)..(252): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtccttcccctggccgccctgctccaggagcacctccgagagcacagcggccctgggctgcctggtcaaggactacttcctgtcgagcgtctgagcgggctggcaaggcgcatagnnnnn

SEQ ID NO: 128147 - DNA, 598 bp, Homo sapiens
  misc_feature: GYAE6OF01CBQNL.2.70.G04.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccaggggaaangccaccctctcttgcagggccagtcagactgttggcagaaacngcttcncgtggaccagcaagaacctggcccacgcctcccgaggcctcctcatctatgctactattcagcacgcaccactggctactcccagacctaggttcaggtggacgtaggtcgggtacgtgggacaggtcgttcacttcacaccgtataccagacaggacgtcgggacgtccgtaggtacgttagtttcgacgttagttagttacttacgtgtactagttgaggttggtcgggttctgtacggtcgttaggtacgttaacgggtttcggaccggtacggggaacctaaggtcgtagggaacgtacgtaaccgaaacggtacgtcggtacggtactcggaccgtacgtacg

SEQ ID NO: 128148 - DNA, 250 bp, Homo sapiens; identical to SEQ ID NO: 128042
  misc_feature: GYAE6OF01CQBU7.2.70.G04.1.454.CMB.1.raw
  modified_base (247)..(250): a, c, t, g, unknown or other
  misc_feature (247)..(250): n is a, c, g, or t

SEQ ID NO: 128149 - DNA, 654 bp, Homo sapiens
  misc_feature: GYAE6OF01BFF7C.2.70.G04.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaangcccaccctctcttgcagggccagtcagctgtggcagaaacngcttcncctggtaccagcagaacctggccacgcctcccgaggcctcctcactctatcgactacattccagcacgccgccacgtcggacactccccgaagtaccgtaggttcaggtcggacgtaggtgggtcgtagggacaggtacgttccactccgtaccacgtactcgacgacgagtacgtaggacgtccgtaggtagttacgtttgacgtagttgttacgttacgtgttctacgtcgtaggttcggttacggggttccttacggtacggttcggttacggtacggtttacgggtttcgggacccgggtaacggggtaacccgaacgggtcggtagggtaacggtacgtaaccggtaaaacggtaacggttcgggttacgggtacgttaccggacccgtaccgtaccg

SEQ ID NO: 128150 - DNA, 250 bp, Homo sapiens
  misc_feature: GYAE6OF01C87DE.2.70.G04.1.454.CMB.1.raw
  modified_base (246)..(250): a, c, t, g, unknown or other
  misc_feature (246)..(250): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcggctggcaaggcgcatagnnnnn

SEQ ID NO: 128151 - DNA, 253 bp, Homo sapiens; identical to SEQ ID NO: 128128
  misc_feature: GYAE6OF01DW9SQ.2.70.G04.1.454.CMB.1.raw
  modified_base (247)..(253): a, c, t, g, unknown or other
  misc_feature (247)..(253): n is a, c, g, or t

SEQ ID NO: 128152 - DNA, 534 bp, Homo sapiens
  misc_feature: GYAE6OF01B49CS.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (361)..(361): a, c, t, g, unknown or other
  misc_feature (361)..(361): n is a, c, g, or t
  modified_base (500)..(500): a, c, t, g, unknown or other
  misc_feature (500)..(500): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttctcctggtaccagcagaaacctggccacgcctcccaggctcctcatctatgctacattcagcagcgccactggcatcccagacaggttcagtgcaggtgggtctgggacagngttcactctcaccatcagcagacgtggacgccgtaggaggtattttgcgtagttcgtattacttgtactatcgaggttggttgggtctcgagtcggtgcgtaggtttcggccgacggggtaccaaggtcgtagggacgngtacgaaacgacgtacgtggactgctaccgtacg

SEQ ID NO: 128153 - DNA, 250 bp, Homo sapiens
  misc_feature: GYAE6OF01EHE6K.2.70.G04.1.454.CMB.1.raw
  modified_base (247)..(250): a, c, t, g, unknown or other
  misc_feature (247)..(250): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctggcaaggcgcatagnnnn

SEQ ID NO: 128154 - DNA, 251 bp, Homo sapiens
  misc_feature: GYAE6OF01BK5QT.2.70.G04.1.454.CMB.1.raw
  modified_base (247)..(251): a, c, t, g, unknown or other
  misc_feature (247)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcttggtcaaggactacttcctgtcgagcgtctgagcgggctggcaaggcgcatagnnnnn

SEQ ID NO: 128155 - DNA, 607 bp, Homo sapiens
  misc_feature: GYAE6OF01CCEIJ.2.70.G04.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaangccaccctctcttgcagggccagtcagactgtggcagaacngcttcncctggtaccngcagaacctggccacgcctcccaggcctcctcatctatgctacattcagcacgccnccacgtcggcacgtcccaagacgtaggttcaggtcggcgtaggttcggggtcgtagggacaggtacgtttcacttcctaccacctactacgtacgacgacgacgtggacgtccgtaggtaggttatttcgacgtagttagttattcgtcgtactacgtcgtaggtggttcgggtctcgacgtcgtagtcgttaggtttcggaccggtacgggtaccgtaggtcgtagggaacgtaacgtaaccgtaaacggtaacgtcgggtacggtaccgtacgtaccgtaaccgttacg

SEQ ID NO: 128156 - DNA, 250 bp, Homo sapiens; identical to SEQ ID NO: 128024
  misc_feature: GYAE6OF01DY2K8.2.70.G04.1.454.CMB.1.raw
  modified_base (246)..(250): a, c, t, g, unknown or other
  misc_feature (246)..(250): n is a, c, g, or t

SEQ ID NO: 128157 - DNA, 253 bp, Homo sapiens
  misc_feature: GYAE6OF01EB22D.2.70.G04.1.454.CMB.1.raw
  modified_base (246)..(253): a, c, t, g, unknown or other
  misc_feature (246)..(253): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggctacttcctgtcgagcgtctgagcgggctggcaaggcgcatagnnnnnnnn

SEQ ID NO: 128158 - DNA, 251 bp, Homo sapiens
  misc_feature: GYAE6OF01A5I08.2.70.G04.1.454.CMB.1.raw
  modified_base (248)..(251): a, c, t, g, unknown or other
  misc_feature (248)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctgggcaaggcgcatagnnnn

SEQ ID NO: 128159 - DNA, 251 bp, Homo sapiens
  misc_feature: GYAE6OF01CMFRY.2.70.G04.1.454.CMB.1.raw
  modified_base (245)..(251): a, c, t, g, unknown or other
  misc_feature (245)..(251): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttcccctggcgccctgctccaggagcacctccgagagcacagcggcctgggctgcctggtcaaggactacttcctgtcgagcgtctgagcgggctggcaaggcgcatagnnnnnnn

SEQ ID NO: 128160 - DNA, 551 bp, Homo sapiens
  misc_feature: GYAE6OF01C2L2H.2.70.G04.1.454.CMB.1.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctctgcagggccagtcagactgttggcagaacngcttcnctggtaccagcagaacctggaccacgctcccagcctcctcatctatgctacnttcagcagcgccactggcatcccagacagttcagtgcagtggtcgtggactagcgttcactcncacatcagcagacgtgacgcgtaggagtntttgcgtagtgtacttagtgtctacgtgtagttggtagggttctcgtacgtcggttgtcgttaggtttacggaccgggtacgggtactaagggtacggtaggaacggtaacgaccgtaaaacgtacggtacgggttacgcgtacggcctaccgtacg

SEQ ID NO: 128161 - DNA, 580 bp, Homo sapiens
  misc_feature: GYAE6OF01DE8UT.2.70.G04.1.454.CMB.1.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
  modified_base (372)..(372): a, c, t, g, unknown or other
  misc_feature (372)..(372): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctctgcagggccagtcagactgtgcagaacngcttcnctggtaccagcacgaactggccacgctccagctcctnatctatgctacattcagcacgcnccactgcatcccagcagtcagtgcnggtgtctgggacagtgttcactctcacatcagcagacgnggtacgcgtaggtagtacgttttgacgtaggttagttaacgtttacttgtactagttcgtaggttggttcgggttctcgtacggtcggttcggtacgttagggttttacgggaccggtacggggaccgtaacgggtcgttagggaaggtaacgtaaccgtaaaaccggtaacggttacgggtacggacgttacgtaccgtccgtaacg

SEQ ID NO: 128162 - DNA, 623 bp, Homo sapiens
  misc_feature: GYAE6OF01EK92F.2.70.G04.1.454.CMB.1.raw
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaagagccaccctctcttgcagggccagtcagactgttgcagaaacngcttctcctggtaccagcaagaaacctggacccacgcctcccaggcctcctcactctatgctacattcagcagcgccactggacactccgagacgtaggtcaggtcgcgtaggtcgggtcgtagggactagtacgttccacgtcctacgacctacgtccgagaccgtagacgtacgggacgtcgtaggtacggttagtttcgacgttaggttcttacgtttacgtgttactagttcggtagggtttcgggtcgggtcctaggtacgtccggtggtaccggttgggtttcgggacccggtacgggtaaccgtaggtcggtaggaacgtacgtaaacggtaaacgtcggtacggtaggaccttcggaccctacgttaccg

SEQ ID NO: 128163 - DNA, 721 bp, Homo sapiens
  misc_feature: GYAE6OF01ASSNQ.2.70.G04.1.454.CMB.1.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaactgtgttgacgcagtctccaggcaccctgtctttgtctccgaggggaaagagcccaccctctcgttgcgagggccagtcagactggtggcagaaacngcttcnctggtaccagcagaacctggccacgctcccaggcctcctcatctatgctacnctcagcagccgtaccacgtcggcctactcccgaagaccgtaggttcaggttcggacgtagggttcgggtcgtaggggacctagggtacgtttccacgttcctaccgacctagtccgaacgtccgaacggtaccgtagggaccgtaccgttagggtaaacggtttacgtttttacggaccgttaaggtttacgttaactttaccgttacgttacctagttcgtaacgggtttggggttacccggggttacttacggtacggttccggttacggttaccgtttagggggtttaccggacccgggtaacgggggtaaacccgtaaggggtaccggttagggtaaacgtaaccgtaacccggaaaacggttacggtttacgggacggtaaccggttccggtacccgtaaccgttaccg

SEQ ID NO: 128164 - DNA, 252 bp, Homo sapiens
  misc_feature: GYAE6OF01D6VKU.2.70.G04.1.454.CMB.1.raw
  modified_base (248)..(252): a, c, t, g, unknown or other
  misc_feature (248)..(252): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctgggcaaggcgcatagnnnnn

SEQ ID NO: 128165 - DNA, 261 bp, Homo sapiens
  misc_feature: GYAE6OF01BF4RU.2.70.G04.1.454.CMB.1.raw
  modified_base (210)..(210): a, c, t, g, unknown or other
  misc_feature (210)..(210): n is a, c, g, or t
  modified_base (249)..(261): a, c, t, g, unknown or other
  misc_feature (249)..(261): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctcgagagcacagcggcctgggctgcctggtcaaggctacttccngtcgagcgtctggagcgggctgggccaagggcgcatagnnnnnnnnnnnnn

SEQ ID NO: 128166 - DNA, 670 bp, Homo sapiens
  misc_feature: GYAE6OF01DR69R.2.70.G04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccagcaccctgtcttgtctccagggaangccaccctntctgcgaggccagtcagactgtgcaagaacngtctctcgtgtaccagcagaacctggaccacgctccagtctcctcatctatgactactntcagcagccnccagtcgactactcccgaagtactaggttcaggtcgcgtggttggtccgtaggactaggtactttacacgtcctacacctactacgagactacgacgtcggtacgtaccgtaggtagtttacgtttacgacgttagttacgtttaacgtttaccgtacggttacttaacgttacggttaagggtttcgggttacggggttacccgtacggtacggtcggttacggtacggtttaacgggttttccggggaccggtaaaccggggtaaccgtaacgggtccggttaaggaacggttaacgtaaccggtaaaaccggtacgttacgggtaccggtacgttaccggtaacgtacccgtttaaccgg

SEQ ID NO: 128167 - DNA, 532 bp, Homo sapiens
  misc_feature: GYAE6OF01EI0PX.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (313)..(313): a, c, t, g, unknown or other
  misc_feature (313)..(313): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctccagctcctcatctatgctacattcagcagcnccatggcatcccagaccaggttcagtggcaggtggtcgtgggacagtagtcactctcaccatcagcagacgtggacgccgtgaggtatttgactagttagttagttactgtcagtcgtagtggtagggtctcgtagtcgtgtcgtacggtttggaccgtaggggaccaggtcgtaggagtacgtaacgtaaacggacgtaggtacgatcgacacgtacg

SEQ ID NO: 128168 - DNA, 660 bp, Homo sapiens
  misc_feature: GYAE6OF01BORFE.2.70.G04.1.454.CMB.1.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaangccaccctctcttgcgagggccagtcagactggttggcagaacngtcttctccgtggaccagcaagaaacctggccacgctcccgaggcctccncatctatgactacattcagcacgccgacctacgtggaccacgtacccaggtactaggttcaggtcggcgaggtcgggtcgtgggacgagtagttccaccgtcaccacagtcgaagcaaggtacgtagggacgtccgtaggtaggttacgttttgaccgtaggttagttaacttacgtgttacgtaagttcggtaaggttcgggttggggtccttacggtacggttcggttggtaccgtttacgggttttacggggacccgggtaaacggggtaaccgtaacgggtacggtacgggaacggttaacgttaaaccgaaaccggttacggttacgggtcggtaacgtacgtacccgtaccgtaacg

SEQ ID NO: 128169 - DNA, 252 bp, Homo sapiens
  misc_feature: GYAE6OF01A84RE.2.70.G04.1.454.CMB.1.raw
  modified_base (248)..(252): a, c, t, g, unknown or other
  misc_feature (248)..(252): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnn

SEQ ID NO: 128170 - DNA, 251 bp, Homo sapiens
  misc_feature: GYAE6OF01DBWY2.2.70.G04.1.454.CMB.1.raw
  modified_base (246)..(251): a, c, t, g, unknown or other
  misc_feature (246)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtctcccctggcgccctgctccaggagcacctccgagagcacagcggccctgggctgcctggtcaaggactacttcctgtcgagcgtctgagcgggctggcaaggcgcatagnnnnnn

SEQ ID NO: 128171 - DNA, 240 bp, Homo sapiens
  misc_feature: GYAE6OF01CXW7S.2.70.G04.1.454.CMB.1.raw
  modified_base (211)..(211): a, c, t, g, unknown or other
  misc_feature (211)..(211): n is a, c, g, or t
tcagacgctcgacacacgaccggtgctcgatttagtgtagtgtgaagggaaaggggccggcgcgggagcgaatgagttcgtggggccagggaaccctggtcaccgtctcctcagcctccaccaagggcccatcggtcttccccctggcgcctgctccaggagcacctccgagagcacagcggccctgggctgcctggtcaagctacttccngtacgagcgtctgagcgggctggcaaggc

SEQ ID NO: 128172 - DNA, 253 bp, Homo sapiens
  misc_feature: GYAE6OF01D1U0Z.2.70.G04.1.454.CMB.1.raw
  modified_base (246)..(253): a, c, t, g, unknown or other
  misc_feature (246)..(253): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctggcaaggcgcatagnnnnnnnn

SEQ ID NO: 128173 - DNA, 268 bp, Homo sapiens
  misc_feature: GYAE6OF01C47SY.2.70.G04.1.454.CMB.1.raw
  modified_base (143)..(143): a, c, t, g, unknown or other
  misc_feature (143)..(143): n is a, c, g, or t
  modified_base (206)..(206): a, c, t, g, unknown or other
  misc_feature (206)..(206): n is a, c, g, or t
  modified_base (243)..(268): a, c, t, g, unknown or other
  misc_feature (243)..(268): n is a, c, g, or t
tcagacgctcgacacacgaccggtgctcgatttagtgtagtgtgaagggaaagggccggcgcgggagcgaatgagttctgggccagggaaccctggtcaccgtctcctcagcctcaccaaggcccatcggtcttcccctggcnccctgctccaggagcacctccgagagcacagcggccctgggctgcctggtcaaggctactccngtcgagcgtctgagcgggctggcaacggcgcaatagnnnnnnnnnnnnnnnnnnnnnnnnnn

SEQ ID NO: 128174 - DNA, 572 bp, Homo sapiens
  misc_feature: GYAE6OF01B1JA3.2.70.G04.1.454.CMB.1.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtcttgtctcagggaaangccaccctctcttgcagggccagtcagactgttggcagaaacngcttctcctggtaccagcaagaaacctggccacgcctcccaggcctcctcatctatgctacattcagcagcgccacgtggcactcccagactaggttcaggtggcgtaggtgggtctgggacaggtacgttcacgtctaccacctatcacgacagacgtggacgtccgtgtaggttatttgacgtagttagttactttacgtgttctagtacgtagttggttgggttctcgtaggtcggttgtcgttaggtttcggaccggtacgggtaaccgtaaggtcgtagggaacgtacgtacgaaacgtacgtggtacggactcgccgtacgtacg

SEQ ID NO: 128175 - DNA, 619 bp, Homo sapiens
  misc_feature: GYAE6OF01ECCKM.2.70.G04.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (336)..(336): a, c, t, g, unknown or other
  misc_feature (336)..(336): n is a, c, g, or t
  modified_base (520)..(520): a, c, t, g, unknown or other
  misc_feature (520)..(520): n is a, c, g, or t
  modified_base (601)..(601): a, c, t, g, unknown or other
  misc_feature (601)..(601): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctcaggcaccctgtctttgtctccaggggaaanacgccaccctctcttgcacgggccagtcagactgtggacagaaacngtcttctccgtggtaaccagacaacgaaacctggacccacgcctcccaggctccgtcatccttaagcgacctacattccgagcacgccnccgactcggacactccagactaggttcgagtggcaggtggtcgtagggacagtcgttacaccgtctaccgacctataccaaggccaagcgttagggacgtccgttaaggacggtttatttacgagttagttagtttattacgtgttacagtcgtagtcgggttggttccctagacggttcggtntacggttacggtttcggaccggaagggtacccctagggaccgtagggaacgtacgtaacgaaacggtacgtaggttacggngttacgccgaacttacgg

SEQ ID NO: 128176 - DNA, 258 bp, Homo sapiens
  misc_feature: GYAE6OF01DVO0W.2.70.G04.1.454.CMB.1.raw
  modified_base (163)..(163): a, c, t, g, unknown or other
  misc_feature (163)..(163): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (248)..(258): a, c, t, g, unknown or other
  misc_feature (248)..(258): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtccttccccctggccgccctgctccagganccacctcgagagcacagcggcctgggctgcctggtcaaggactactcctgtcgagcgtcngagcggctggcaaggccganatagnnnnnnnnnnn

SEQ ID NO: 128177 - DNA, 253 bp, Homo sapiens; identical to SEQ ID NO: 128051
  misc_feature: GYAE6OF01BEZIY.2.70.G04.1.454.CMB.1.raw
  modified_base (248)..(253): a, c, t, g, unknown or other
  misc_feature (248)..(253): n is a, c, g, or t

SEQ ID NO: 128178 - DNA, 704 bp, Homo sapiens
  misc_feature: GYAE6OF01DDY5M.2.70.G04.1.454.CMB.1.raw
  modified_base (209)..(209): a, c, t, g, unknown or other
  misc_feature (209)..(209): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
  modified_base (604)..(604): a, c, t, g, unknown or other
  misc_feature (604)..(604): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccgaggccaccctgttctttgtcctccgaaggggaaagncccacccttctcttgcgagggccagtcagctgtgcaagacntcttcnctggtaccagcaacgaaacctggaccacgcctcccgaggcctcctcatctancgacctactattacgacgcgtacgccgtaccgacggtggaccctaccgtaccccgaaggtaaccgtacgggtttaccagggtcggtacgtagggttcgggtaccggtacgggaacgtaagttacgttacccgtaaccgtccgttaccaaaccgttactaaccggacgactaaccgggtcgtacggggaccccttaccggtaggtaaggtttacgtttcgacggttaggttacgtttaacttcgttagtaccgtgttaccgtagggttacgggttcggtcctaggtacggttcggtntaccggtttagggtttacccggacgggtacgggtaaccgtagggtcgtaagggactaacgttaaccgaggttaccgtgggcgtactcgcctacgttaccg

SEQ ID NO: 128179 - DNA, 673 bp, Homo sapiens
  misc_feature: GYAE6OF01CGPAV.2.70.G04.1.454.CMB.1.raw
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
  modified_base (331)..(331): a, c, t, g, unknown or other
  misc_feature (331)..(331): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagactaccaccggagaaactgtgttgacgcagtctccaggccaccctgttcttgtctcgaaggggaaancgccacctctcttgcgagggccagtcagtactggtggacgaagaaacngtcttactccgtaggtaccagtacaacgaaacctcggaccacggcctcccaggcctcctacactctagtcgactaacnttacagcacgtcgaccacgtcgacacctccgaagacgtacggttcaggtgacgtaggtgggtacgtacgggaactaggtacttacgaccttcgtaccacctagtcgaacgcaaggtaccgtaggggactcggttaggtagttacgttttagacgttaggtttacgttacgttacggttctacgtacgtcggttaacgggttcggttacgggttctaccggtagtcggttacgtaggttaccggtttagggaccggtaacgggggtaactaggtacgggtaggaacgttaaacgaaaccggtaaagttacgtagggtaacgcgtaacgtccgttaacgtaccg

SEQ ID NO: 128180 - DNA, 302 bp, Homo sapiens
  misc_feature: GYAE6OF01AU8LR.2.70.G04.1.454.CMB.1.raw
  modified_base (263)..(302): a, c, t, g, unknown or other
  misc_feature (263)..(302): n is a, c, g, or t
tcagacgctcgacacacgaccggtgctcgatttagtgtagtgtgaagggaaaggggtccgggcggcgggagccgaatgagttctggggccagggaaccctggtcaccgtctcctctagcctccaccaagggcccatcggtcgttccccctgggccgccctgcctcccagggacgcacctccggagagcacagcggccctggggctgtctggtcaaggctacttcctgtcgagcgtctgagacgggctggcaaggcgcatacgnnnnnnnnnnnnnnnnnnnnnnnnnnnnnnnnnnnnnnnn

SEQ ID NO: 128181 - DNA, 762 bp, Homo sapiens
  misc_feature: GYAE6OF01A8L6X.2.70.G04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtctttgtctccgaggggaaanagccaccctntcttgcagggccagtcagactgttggacagaaacngtcttctccgtaggtaccagcaacgaaacctggccacgctccgaggccttccnctatctatgtctacatcngcacgccnccacgtggacctactcccgagaacgtggttacgaggtcgggcctaggttcggggtcctaggggaacctaaggtacggtttccaaccgtttcgaccgtaacccgtacgttccgtaacggacgaacggtaaccgtacgggtaacgtccgtacggtaagggttaactttcgggtaccttaagggttacgtttaacggtttaccgttacggttacgtaacgttacgttacgggtttacgggttcggggttaccgttaccggtacggttacggttacggttaccgggttaaacgggtttttccggggaacccggtaaacgggggtaacccgtaaacggggtacgtttaacgggaacgggttaaccggtaaaccggtaaaaccgggttaaccgttacggggtaacggttaccggttaccgaacccggtacccgttaacccgg

SEQ ID NO: 128182 - DNA, 596 bp, Homo sapiens
  misc_feature: GYAE6OF01CBS46.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttcncctggtaccagcagaaacctggccacgctcccaggctcctcatctatgctacattcagcagcgccactggcactcccagacaggttcagtggcaggtgggtctgggacaggacgttcacgtctacaccatcagacacgacgtcgggagccgtagaggtagttttcggactaggttacgttactttacgtgttactagtcgtaaggttgggttacggggttcgttacgaggtcgtggtcttacgggttttcgggaccggtacggggtaaccgaagggtccgttaagggaggtacgtaaccgaaaacggtaacgtacggtacggtcgtacggtacccgtaccgtacg

SEQ ID NO: 128183 - DNA, 587 bp, Homo sapiens
  misc_feature: GYAE6OF01AWAZD.2.70.G04.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgtggcagaacngcttcnctggtatcagtagaacctggccacgctcccaggcctcctcatctatgcctacattcagcagccgccacgtggcactcccagacctaggttcaggtggacaggtgggtctgggacaggtacgttcacttctccacctatacacgcagacgtggacgtccgtaggagtacgtttgacgtagttacgttacttactgtctattcgtagttggtgggtcctacgagtcgtggtacgttagggttttcggaccggtacggggtaaccgtaaggtcgtagggtacggtaacgtaaccgtaaacggtaacgttcgggtacggtacgtacggcccgtaacgtaccg

SEQ ID NO: 128184 - DNA, 643 bp, Homo sapiens
  misc_feature: GYAE6OF01DWMAY.2.70.G04.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtcttgctccaggggaaangccacctntcttgcagggccagtcagactgtgcagaaacngcttcnctggtaccagcagaacctggccacgctcccgaggcctcctcatctatcgctactattcagcagccgccactggcactccccagactaggttcaggtcggcaggttggggtctggggactaggtcgtttacacgttctacgacctatcgacgccaagtacgtagggacgtccgtaggtaggttagttttcgacgtaggttgttactttaacgttgttacgtagttcgtaggttagggttcggggttactcgtacggtcggttcggtacggtttagggttttccgggaccggttaacgggggaacccgtaacgggtccggtaggggtaacggtaacgttaaaccggtaaaacggtaacggttacggttacgggtacgttacggtaccgtacccgttaacg

SEQ ID NO: 128185 - DNA, 813 bp, Homo sapiens
  misc_feature: GYAE6OF01DUDO2.2.70.G04.1.454.CMB.1.raw
  modified_base (272)..(272): a, c, t, g, unknown or other
  misc_feature (272)..(272): n is a, c, g, or t
  modified_base (802)..(802): a, c, t, g, unknown or other
  misc_feature (802)..(802): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagactaccaccggagaaactgtgttgacgcagtcctccgaggccacccttgttctttcgtcctaccggaagggggaaacgacgccctacccttctcgttgcgacgggccagtcagtactggttaggacaagaaacngtccttcctccgtcgggtaaccagaccgaaacggaaaccgtcggacccaccggtccctacccgacggtcccttacccgtactacttacttacgtcgtaccttactacttcgacgcacggtccgaccgtacgtacggacctaaccgtacccgaacggtaaccgttacgggttacgtaacgggttcggggaccggttaaggggttcccgggggttacggtaacgggggtaacgttaaacggggtaccgttttaaccctaaaccccggtttccttaaacccgaacccgttaacgttaccggtaacggaacccggtaacgggtaaccgggttaccggggtaaacgtacccgggttaagggttaacgggtttacgttttacggaccggtttaaggttaccgtttacgtttacgtacgttacgtagttacgtagggttcgggtacggttcctacggtacggtcgtacgtcgttacgggttcggaccggtaacgggacgtaggcggtaggatacgtagaaacgtcgtcggacgtacncggctcgtacg

SEQ ID NO: 128186 - DNA, 253 bp, Homo sapiens
  misc_feature: GYAE6OF01DBGFC.2.70.G04.1.454.CMB.1.raw
  modified_base (210)..(210): a, c, t, g, unknown or other
  misc_feature (210)..(210): n is a, c, g, or t
  modified_base (245)..(253): a, c, t, g, unknown or other
  misc_feature (245)..(253): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgcctgctccaggagcacctccgagagcacagcggccctgggctgcctggtcaaggctacttccngtcgagcgtctgagcgggctggcaaggcgcatagnnnnnnnnn

SEQ ID NO: 128187 - DNA, 569 bp, Homo sapiens
  misc_feature: GYAE6OF01CBDGE.2.70.G04.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccaggggaaangccaccctctcttgcagggccagtcagactgttgcagaaacngcttcncctggtaccagcagaacctggccacgctccaggctcctnatcatcgctacattcagtcagccgccacgtggcactcccgagactaggttcagtggacaggtcgggtctgggaacaggtagtttcactcctacgacccatcacgacgagtacgtgggacgtccgtaggtacggtagtttgacgtagttagttattacgttcgtactacgtcgtaggttcggtgggtctacgacgtcgtcgtcgtacggtttcggacgacgggtaccgaacggtcgtagggactacgtacgaaacgtacgtcgtacggactgaccgcgtacg

SEQ ID NO: 128188 - DNA, 540 bp, Homo sapiens
  misc_feature: GYAE6OF01EFIUO.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcaacgaacctggccacgctcccagctcctcatctatnctacatcagcagcgccactggcactccaagacaggttcagtgcaggtggtactgggacngagttcactctacaccatcagacagacgtggacgccgtaggnggtactttgacgtagtgtattacgtgtactatcgtaggttggttggggttctacgtacgtcgtgtcgtaggttttggcccggtagggacccaggtccgtagggactgtacgaaacgtacgtcgtaggctcgcacctacg

SEQ ID NO: 128189 - DNA, 531 bp, Homo sapiens
  misc_feature: GYAE6OF01A7887.2.70.G04.1.454.CMB.1.raw
  modified_base (202)..(202): a, c, t, g, unknown or other
  misc_feature (202)..(202): n is a, c, g, or t
  modified_base (385)..(385): a, c, t, g, unknown or other
  misc_feature (385)..(385): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacagcttctcctggtaccagcagaaacctggccacgctcccaggcctcctcatctatgctacattcagcagcgccactggcatcccagacaggttcagtgcagtggtctgggacagacgttcactctcaccatcagcagacnggacgctggaggtatttgctagtagttattacgtgtcatctaggtggtcggggtctcgtagtcgtgtcgtaggttttggccggtacgggaccgaaggtcgtagggagtacgtaacgaaacgtaacgtggtaggctcgacgactacg

SEQ ID NO: 128190 - DNA, 768 bp, Homo sapiens
  misc_feature: GYAE6OF01DPQL7.2.70.G04.1.454.CMB.1.raw
  modified_base (213)..(213): a, c, t, g, unknown or other
  misc_feature (213)..(213): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagactaccgaccggagaactgtgttgacgctagtcctcgaggccacccgttgttcttgtcctaccgaaggggaaacncgccctacccttcgtctggcgacggcctagtacgagtacgtggttacggactaaacgaaactcgttccttacgtccgtacggtaaccagaccgaaacgtaaccgtcggaccctaaccgcccgtaccgacggtcctaccgtactagttactacgtcgtacctaactcgtacgacgtaccacgccgtacctacgtacggacctaccgtaccgaacggtacgtaacgggtcgaacggttcgggacgttaacggggtcgggttacggttacgggaaccgttaaggttaccgttaaccgtaccgttacccttaaaccggaccctaacgtccggtaacgtacggaacgtacggtacggtaccgtacgtaggttacggttacgttagacgttagttacgttacgttagcgttacgtagtcgtcgggtaggttcgggtacctacggacggttcggttcgttacgggttcggttaccggaacgggtacggaacgttcggacgggttaagaacgtacggtaaaccgtaaagttcggttacgggctaacgtcgtaccgtcgttacg

SEQ ID NO: 128191 - DNA, 263 bp, Homo sapiens
  misc_feature: GYAE6OF01BXKW7.2.70.G04.1.454.CMB.1.raw
  modified_base (182)..(182): a, c, t, g, unknown or other
  misc_feature (182)..(182): n is a, c, g, or t
  modified_base (254)..(263): a, c, t, g, unknown or other
  misc_feature (254)..(263): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccgaagggcccatccggtccttccccctggccgccctgctccaggacgcacctccgagagcacngcggccctgggctgcctggtcaaggcctacttcctgtcgagtcgtctgaggcggcgtggcaaggcgcagtgnnnnnnnnnn

SEQ ID NO: 128192 - DNA, 807 bp, Homo sapiens
  misc_feature: GYAE6OF01EQFSD.2.70.G04.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaancgccacctctcttgcgaggccagtcagtactgttgacaagaaacncgtcttctccgtcggtaccagacaacgaaccgtggacccacgcctacccgaggccttcctaccatcctatcgtactactacgttcgagccaacggccgacctaacgtcggacctaccgtacccgaaggtaccgtaggtcgaaggttcggacgtacgggtgggtcgtacgggtactaggtacgtcctaacgtctaccgaaccagttccgaagtaccgtaagtacgtacgggaccgtacgttagggtaacggtttacgtttcggacttaaacgggtttcgtttaacgtttaccgttagggttcctaacggttacggttacgggtttcggggttaccgggttccgttaacgggtacggttcgggtttacgggttaccggtttacgggggttttacccgggtaaaccccgggggtaaacggggtaaccccggttaaacgggtaccggggttaacggggtaaaccggttaaccggttaaaccccggtaaaaacgggttaccgggttacggggttaacccggggaccgtttaaccgggtaccccgttaaacccggttttacccggg

SEQ ID NO: 128193 - DNA, 690 bp, Homo sapiens
  misc_feature: GYAE6OF01BHMON.2.70.G04.1.454.CMB.1.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttcgtctccaggggaacacgccaccctntcttgcaggccagtcagactgttgcagaacngtcttctcgtggaccagcaagaaccgtggacccncgtcctccaggcctcctanactcctagtcgcttactatttcgagtcgacgccgtacctacgtcggctacgttcccaagtaccgtaggtttccagtcgggactagggtcggttacgtggggaactaggttacgtccacgttccnccgtaactgtacncgacgtaagtaccggtagtacggtacgttaggaaggtttacgttttgacttaggttacgttaacgttcgtagtcctacgttacggtaggttcgggtgggtactacggttagtccggttaggtacgttacgggtttcggacccgggtaccggggtaacgaacgggttcgggttaacggtaacggtacgttaaacccgggtaaaccgtaacgggttacgggtaccggtacccttaccggacccgttacccggttaccg

SEQ ID NO: 128194 - DNA, 259 bp, Homo sapiens
  misc_feature: GYAE6OF01EV8GT.2.70.G04.1.454.CMB.1.raw
  modified_base (252)..(259): a, c, t, g, unknown or other
  misc_feature (252)..(259): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtccttccccctggccgccctgctccagggagcacctccgagagcacagcggccctgggctgcctggtcaaggctacttcctgtcgagcgtctggagcgggctggcaaggcgacatagnnnnnnnn

SEQ ID NO: 128195 - DNA, 252 bp, Homo sapiens
  misc_feature: GYAE6OF01DSLNV.2.70.G04.1.454.CMB.1.raw
  modified_base (245)..(252): a, c, t, g, unknown or other
  misc_feature (245)..(252): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagtacctcgagagcacagcggccctgggctgcctggtcaaggactacttcctgtcgagcgtctgagcggctggcaaggcgcatagnnnnnnnn

SEQ ID NO: 128196 - DNA, 568 bp, Homo sapiens
  misc_feature: GYAE6OF01A1TO1.2.70.G04.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (555)..(555): a, c, t, g, unknown or other
  misc_feature (555)..(555): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctcaggcacctgtctttgtctccgaggggtaaagngccaccctgtcttgcaggccagtcagactgtggacagaaacngtcttcncgtgtaccagcagaacctggccacgctccagctcncatcatgctantcagcagcncagtgcacgtccagaccngtcaggtgcaggtggactgggactaggtcgttccactcacgaccatcgagcgagtcgtggtacgccggttaggacgttagtttcgagtacggttacgtaagttaccgtgtacgtacgttcgtaaggttcggttcggggtactacggtagttcgtagtcggttaggttcggacccggtagggaacccgtagtccgtaggacgtacgaacgtaacggtacgtcgacggtacncgtcgtactacgg

SEQ ID NO: 128197 - DNA, 751 bp, Homo sapiens
  misc_feature: GYAE6OF01CIMSN.2.70.G04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactcgtggctcccagataccaccggagaaactgtgtgacgcagtctccagcaccgtgtctttgctccgaggggaaacncgccacctntctgcgtaggccagtcagactgtggacaagaaacngtcttcgccgtggtaccagcgaacgtaaaccgtcgacaacgtcctacccgaaggtcctaccttcaatacgtaacgtcgacttaactacttacgacgtaccaggacccgtacctaacggttggaccctacgtaccccctaaaggacgtaccgggtttaccaaggggttacgggtaccgaagggtttccggggtaccgtaacgggggactacggggtacttccgaaacgttcgtaacccaacgtagtaccgaagtaccgaacgtacgtacggacggtaccgtacgtaacgggttagtttacggacgtaacggtcgttaacgttaaccgtgttacgtagttaccggtaagggttaggttaccgggtaccttacgtaggtacgttagtaccgttaggttttacgggaccggtaacgggtaccgtaacgggtaccggttacgggaacggttaacgtaaccgtaaaaggtacggtacggtaacggtacgtacggtaccgtaccgttaaacg

SEQ ID NO: 128198 - DNA, 267 bp, Homo sapiens
  misc_feature: GYAE6OF01BKQ4Q.2.70.G04.1.454.CMB.1.raw
  modified_base (148)..(148): a, c, t, g, unknown or other
  misc_feature (148)..(148): n is a, c, g, or t
  modified_base (238)..(238): a, c, t, g, unknown or other
  misc_feature (238)..(238): n is a, c, g, or t
  modified_base (256)..(267): a, c, t, g, unknown or other
  misc_feature (256)..(267): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccacgaagggcccatcggtccttcccctggcnccctgctccgaggagccacctcgagagcacgagccggcctgggctgccgtggtcaaggtactcttcctgtcgagcgtctgaggccggtcnggcaaggcgtacagtagnnnnnnnnnnnn

SEQ ID NO: 128199 - DNA, 585 bp, Homo sapiens
  misc_feature: GYAE6OF01CVNJO.2.70.G04.1.454.CMB.1.raw
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (371)..(371): a, c, t, g, unknown or other
  misc_feature (371)..(371): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaaggggaaagagcccaccctntcttgcagggccagtcagactgtggcagaaacngcttcnctggtaccancagaaacctggccacgctcccaggctcctcntctatgctacnttcagcagcgccatcggcactcccagacacggttcagtcgggcaggtgggtcgtaggggacaggngttaccgactctccacatccagcagactggacgtctggaggtatttgctacgttgttattacgttgtacctagtcgtaagtcggttacgggtcgtcgtaggtcgttcggtcgttaggttttcggccggtaaacggggtaccgtaagggttacggaaggtacgtaaccgtaaacggtaacgtcgttacggtacggtgaccgtacgtacgttaccg

SEQ ID NO: 128200 - DNA, 762 bp, Homo sapiens
  misc_feature: GYAE6OF01CK8OM.2.70.G04.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaanacgccaccctctcttgcacgggccagtcagactgttggcagaaacncgtcttctccgtggtaccagcaagaacctggaccacgcctcccaggcctcctcatctagtcgtcctactacttcgacgtccgagccgcccacgtcggcctactcccgaagacgtaggttcgagtcgggcgtagggtgggtacgtaggggaacagggtacgttccaccgttccgtacctaacgtacgtaccgaacggtaccgaacggtaaccggtacgggtaaccgtccggttagggtaacgggtttacgttttaccggacgtttaaggtttacggtttacgtttaaccgtttcggtacgttaacgttaccggtacgggtttacgggttcggggtttaccgttacggtaccggttacgggttcggttaccgggtttccgggttttacggggaccccggggttaaacgggggtaacccggtaaagggtcggtaacgggtaaggtaaccggtaaaccgtaaaaccgggtacggttcggggttacgggtacccgtaaccgtaccgtaacccgttaccgg

SEQ ID NO: 128201 - DNA, 808 bp, Homo sapiens
  misc_feature: GYAE6OF01A6XB7.2.70.G04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtctttgtctcgaggggaacngccaccctntcttgcgagggccagtcagactgtggcaagaaacngcttctccgtggtaccagcaagaacctggccacgcctccgaggctcctcatctatcgctactattcgagcagtccgacctacgtcggacctaccgtaccccgaagtaccgtacgggtttcagggtacggcgtaaggggttcgggtcgtacgggggaactaagggttacgtttcccgtaaccgtttacccgtaccaacccgttacgtaccgtaacggtaccgtaacggtaccgttaggggtaaccgtacccgtttaagggtaacggttttaacggttttacggtaacggttaacggtttcggtttaaacgtttaccgttaggttacccgttaaggtttccggttacgggtttaggggttccggggtttacccgttacggttacgggttaccggtttacggttacccgggttttaacgggttttccggggaacccgggtaaacggggggttaaacccgtaaacgggtcccggttaagggtaaccggttaaacgtaaccgggttaaaaccgggtacggttacggggtaccggttaacccgtacgggtacccttaaccggttaccgg

SEQ ID NO: 128202 - DNA, 254 bp, Homo sapiens
  misc_feature: GYAE6OF01EIXF6.2.70.G04.1.454.CMB.1.raw
  modified_base (247)..(254): a, c, t, g, unknown or other
  misc_feature (247)..(254): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnnnnn

SEQ ID NO: 128203 - DNA, 251 bp, Homo sapiens
  misc_feature: GYAE6OF01D2T9W.2.70.G04.1.454.CMB.1.raw
  modified_base (247)..(251): a, c, t, g, unknown or other
  misc_feature (247)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcggctggcaaggcgcatagnnnnn

SEQ ID NO: 128204 - DNA, 728 bp, Homo sapiens
  misc_feature: GYAE6OF01CPG34.2.70.G04.1.454.CMB.1.raw
  modified_base (257)..(257): a, c, t, g, unknown or other
  misc_feature (257)..(257): n is a, c, g, or t
tcagacgctcgacacacgaccggtgctcgatttagtgtagtgtgaagggaaagggggaagagctgctcagttaggacccagagggaaccatggaaccccagcgcagcttctcttcctcctgctactctggctcccagataccaccggagaaactgtgttgacgcagtctccgaggccaccctgtctttgtcctccgaaggggaaacgacgcccaccctctcgttgcgacgggccagtcagactgttgacaagaaacngtcctctccgtaggtaccagccaacggaaacctcggaccgaccgtcctacccgacggcctcctactactcctaactcgaacctactacttcaacgccacgccgacctacgtcggaccactcccgaacgacgtacggttcgaggttcggagtaacgggtgggtaccggtacgggactaaggtacgtaccgtacctactacaccgtacacgaacgtcgaacggtacggcggaacgttccggtaggtaggtttacgttagacgttaggttacgttaacttccgtgttaacgtacgtaggtaacggttggggttcggttacgtcggtaacgttcgggtagtccggtttaggtttcggggaaccggtaaccggggtaaccgtaacggggtccggtaaggggtaactaacccgggttaacccgaaaggttacggttaccggggtacgtacggtaccggacccgttaacgtttaacgg

SEQ ID NO: 128205 - DNA, 698 bp, Homo sapiens
  misc_feature: GYAE6OF01BHWFA.2.70.G04.1.454.CMB.1.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaangccacctctcttgcagggccagtcagactgtgcagaacngcttcnctggtacagcaagaacctgccacgctccaggcctctcatctatgctacattccagcacgcgccacgtcggcactcccaagaccgtaggttcagggtcggcgagggttcgggtacgtacggggacaggtacgtttaccacctctaccacctagtccgaacgccgacgtccgttacggacgtaacggttccgttaaggtaagttttacgtttttacggtaacgtttaacgtttttaacttaccgtttgttacaacggttaactaaggtttaaacttaacgttaaccgggtccggttacccggtttaccgggttacggggtacccggttaccgggtaacccggtaaacggggtaccggtaaacgggttaacgggtaaaaactaaccggtaaaacggtacggttacggtacgggaccgttacggaccctaacgtaacgttcgtttcggttaccc

SEQ ID NO: 128206 - DNA, 556 bp, Homo sapiens
  misc_feature: GYAE6OF01ADB0L.2.70.G04.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagctgtggcagaaacngcttcncctggtaccagcagaacctggccacgctcccaggctcctcatctatgctacattcagcagcgccactggcactcccagacaggttcagtggctaggtcgggtctgggacaggtacgttcactctacacctatcgagacacgacgtggacgcgtggtaggtagtttgacgtagtgtattacgtgtctagtcgtagtggtcgggtctcgacgtcggtgtcgtaggtttcggaccggtacgggaccgtaaggtcgtagggacgtacgtacgtaaaccgtacgtacggtacggtcgtcgtccgtccgtacg

SEQ ID NO: 128207 - DNA, 254 bp, Homo sapiens
  misc_feature: GYAE6OF01CLL6I.2.70.G04.1.454.CMB.1.raw
  modified_base (246)..(254): a, c, t, g, unknown or other
  misc_feature (246)..(254): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtccttcccctggcgccctgctccaggagcacctccgagagcacagcggcctgggctgcctggtcaaggctacttcctgtcgagtcgtctgagcgggctggcaaggcgcatagnnnnnnnnn

SEQ ID NO: 128208 - DNA, 691 bp, Homo sapiens
  misc_feature: GYAE6OF01B82J6.2.70.G04.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctaccgaggggaaancgcccaccctntcttgcagggccagtcagacttgtggacaagaaacngtccttctccgtagtaccagcaaacgaaaccgtggaccaacgtcctacccgaggtcctccctatacttccgtaagtgtactaaccgtagttcaacgccgtaggaccgacccgtagtacggacctaacgtaccccaaggtacgtagggttcaaggtcggacaaggttcgggtactaggggaacagttacggttacaccttaccgacaacccgtatacgacgacgacgtaacgtacggacgtaccgtagtaggttacgtttagacgtaagttagttaacttacgttagtactaagtacgtaggttggtacgggtctacgtagtccgtacgtacgttaggtttacggaccggtacgggtaaccgtaacggacggttaggaaggtaacggtaaccgaaaacggtaacgttacggttacggtacgtacggaacgtaccgtaaccg

SEQ ID NO: 128209 - DNA, 256 bp, Homo sapiens
  misc_feature: GYAE6OF01EF5H8.2.70.G04.1.454.CMB.1.raw
  modified_base (247)..(256): a, c, t, g, unknown or other
  misc_feature (247)..(256): n is a, c, g, or t
tcagacgctcgacacacgaccggtgctcgatttagtgtagtgtgaagggaaaggggccggcgcgggagcgaatgagttctgggccgagggaacccgtggtcaccgtctcctcagcctccaccaaggccatcggtcttcccctggcgccctgctccaggagcacctccgagagcacagcggccctgggctgcctggtacaaggactacttcctgtcgagcgtctgagcgggctggcaaggcgcatagnnnnnnnnnn

SEQ ID NO: 128210 - DNA, 716 bp, Homo sapiens
  misc_feature: GYAE6OF01CXKSG.2.70.G04.1.454.CMB.1.raw
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (512)..(512): a, c, t, g, unknown or other
  misc_feature (512)..(512): n is a, c, g, or t
tcagacgctcgacacacgaccggtgctcgatttagtgtagtgtgaagggaaagggggaagagctgctcagttaggacccagagggaaccatggaaacccagcgcagcttctcttcctcctgctactctggcctcccagactaccaccggagaaactgtgttgacgcagtctccaggcacctgtctttgctccaggggaaancgccacctctcttgcacgggccagtcaagtactgtcgacaacgaacncgtcttcacgtcggacagacaacgtaacgtcgaccgacgtcctaccggacgtcctaccgtactacttactacgtctaaccttatactcgacgtaccgacgtaccgcctacgtcgacctaccgtccgaacgtacggttaccggtgtaacggtcggtaacggtcgggttcgggtacgtacgggacctaacgttcgttaccgacttccgtacccagtaccgtacgacgtacgtaacgtacggtaggccgtacggtaggtaacggttntttaccggagttcgttagttacgttacgtcgtactacgttacgtaggttacgggttcgttacgtcggtacggtcgttacggtcggtttacggttaccgggaaccgggacggtaaccgtaggtaccggtaaggttaacggtaacttaaccggtaaaacccgtggttaaccgggtacgtccgttaacgaccgttaccggttaaccg

SEQ ID NO: 128211 - DNA, 652 bp, Homo sapiens
  misc_feature: GYAE6OF01BDFYI.2.70.G04.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (493)..(493): a, c, t, g, unknown or other
  misc_feature (493)..(493): n is a, c, g, or t
  modified_base (633)..(633): a, c, t, g, unknown or other
  misc_feature (633)..(633): n is a, c, g, or t
tcagacgctcgacacacgaccggtgctcgatttagtgtagtgtgaagggaaagggggaagagctgctcagttaggacccagagggaaccatggaaaccccagcgcagcttctctcctcctgctactctgctcccagataccaccggagaaactgtgttgacgcagtcctccgaggccaccctgttctttcgtctaccgaaggggaaacncgcccacctctctcggcgacgggccagtcacgactggtcgacaagaactcgtcttctccgtggtaaccagcaacgtaaccgtcggaccncgacctcccgacggtcctaccncactctactcgacctactatccgacnccaggtccnccacgtcggccaacctaccgacgtactaacggtgacggtcggtacgtacggtcgggtacgtacgggagtaacgtcgttacctaaccgtcctaaccgacctacgtacgacgacgacgtacgtgacgtcgtagtacggtntttacgagtagtttacgtattctacgtctacgtgtacggtggttcggtcgtcggtagtacgttcgtacggttcggaccggtcgggaaccggtacgaaccgggtcgtaggacgtacgaacggtaacgttacgtcgggtacngtacgtaccgtcgttaccg

SEQ ID NO: 128212 - DNA, 679 bp, Homo sapiens
  misc_feature: GYAE6OF01A3LRM.2.70.G04.1.454.CMB.1.raw
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaagagccacccgtctcttgcgagggccagtcagactgttggcagaacagtcttctctggtacagcgaacaacctggccacgctcccagctcctcatctatcgctacntcancagcnccactcggacactcccgagacgtagttcgaggtcggactagggtgggtcgtcgggaacacggtattaccacgtccaccaccgtataccaggtacacggtacgtacgggagtcccgttaggaacggtttagtttacggacgttaacgttagtttaccgtttactacggttactagttaccggttaacggggttcgggttaccggggtaccgttggaaccggttcggttacggttacgggtttagggtttcccggggacgggtaacccgggtaaacgtacgggtacggtacggtaaacggacggttaaacccgtaaaacggtacggttacgggttcggacctacggaacccgtccgttaaccggg

SEQ ID NO: 128213 - DNA, 648 bp, Homo sapiens
  misc_feature: GYAE6OF01EAW81.2.70.G04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
  modified_base (631)..(631): a, c, t, g, unknown or other
  misc_feature (631)..(631): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctcaggcaccctgtcttgtctccgagggaangccaccctntcttgcaggccagtcagactgtgacagaacngcttctcgtgtaccagcagaacctggaccacgcctccaggcctccgacactctatcgtactacacttcagctagccnccgtactggacactaccgacgtacgacggttcgagttcggactaggttcgggtcgtcgggacagtacgtacacttcgtacgaccgtactacgacgtaccgagtacgtcgggtacgtccgtaggtagtaactttcggaccgtagttcgttagtttacgtacgttacgtagttacgtagggttcggttacgggttccgtacgtacgggtcgttacgtaccggttaggttttaccgggaccgtacggggtaaaccctagggtaccgttagggaacgtacgttaaaccgggaacgttacggttaccggtcggttaccgngtacccgaccttaccgg

SEQ ID NO: 128214 - DNA, 263 bp, Homo sapiens
  misc_feature: GYAE6OF01APSFN.2.70.G04.1.454.CMB.1.raw
  modified_base (245)..(263): a, c, t, g, unknown or other
  misc_feature (245)..(263): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggctactcctgtcgagcgtctgagcgggctggcaaggcgcatagnnnnnnnnnnnnnnnnnnn

SEQ ID NO: 128215 - DNA, 687 bp, Homo sapiens
  misc_feature: GYAE6OF01D6QNM.2.70.G04.1.454.CMB.1.raw
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
  modified_base (678)..(678): a, c, t, g, unknown or other
  misc_feature (678)..(678): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggcctcccagactaccaccggagaaactgtgttgacgcagtctccaggccacccttgtctttgctccgaagggaaancnccaccctctcttgcgagggccagtcagactgttggctagaacngcttctccgtagtaccagacacgaaaccgtcggacccaccgtcctacccacggtcctcctactacttcctagtcgaccttactactcagtccgacgccgtacctacgtcggacacctacccgaagaccgtacggtttcgacggtcggacgttacgggtcgggtcggtacgggaacctaggttaccgtacctacctacccgtacctaacccgtatacgaacgtccgtaacggtccgtacgggtacgtacgtaggtagtttacgtttacgcgtttaagtacgtttacttacggtgtaccgtgtcggtaacggttggggttaccgtacttcggtacggtcgttcggtaccgttcggtttccgggaacggtaccggtaacgtacggtcggtaaggacgtacgtaacgtaacgacggttgtaacgcgtaccncgacttacg

SEQ ID NO: 128216 - DNA, 699 bp, Homo sapiens
  misc_feature: GYAE6OF01DQ8VN.2.70.G04.1.454.CMB.1.raw
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (538)..(538): a, c, t, g, unknown or other
  misc_feature (538)..(538): n is a, c, g, or t
tcagacgctcgacacacgaccggtgctcgatttagtgtagtgtgaagggaaaggggggaagagctgctcagttaggacccagagggaaccatggaaaccccagcgcagcttctcttcctcctgctactctggctcccagataccaccggagaaactgtgttgacgcagtcctccaggccacccttgttctttgtctccgaagggggaaanacgcccaccctctcttgcgagggccagtcagacttggtggacaagaacngtcttctccgtgtaccagacaacgtaaccgtcggaccaccgcctcccgacggtcctccctacattctatgtaccttactattccagccacggccgacctacgtcggctaaccgtaccccgagtaccgtaggttccaggttacgggctagggtcgggtacgtacggggactaggtacgttcgaccgttctaccaaccgtagtaccaacggtccaacgggtacgtacggggacgtccgttagggtaggttagtttcgacgttaagttgtttaacttcggtntaccgtagttacggtggttcgggtcgggttacgtcgtacggttcggtgtacggtttaggttccggggaccggtaacgggaccgtagggtcggtagggtaaccgtaagtaacccggtaaagtaccggttagggtaccggtagtaccgtaccgtaaccttcgg

SEQ ID NO: 128217 - DNA, 593 bp, Homo sapiens
  misc_feature: GYAE6OF01AMAOU.2.70.G04.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (586)..(586): a, c, t, g, unknown or other
  misc_feature (586)..(586): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccgaggggaancgccaccctntcttgcagggccagtcagctgtgcagaacngcttcncctggtaccagcagaacctggccacgctcccgaggtcctcctcatctatcgctactattcagcacgccaccatggcactccgagactggtcaggtcggctaggtcgggtctcgggaactaggtacgttcacgttctacgaccatcagcagtacgtcggacgtccgtaggtacggttagtttcgacgtagttagtacttacgttagtctacttacgtaggttcggtcgggttctacgtacgtcggttacgtcgttacggtttcgggccgtaacggggtaccgtacggtcgtagggacgtacgtaaccgtaaacggtacgtacggtacggacctcggtccncgttacg

SEQ ID NO: 128218 - DNA, 804 bp, Homo sapiens
  misc_feature: GYAE6OF01DEYM0.2.70.G04.1.454.CMB.1.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagactaccaccggagaaactgtgttgacgcagtctccgaggccaccctgttctttgtctccgaggggaaangcccaccctctctgcgacgggccagtcagtactggtgacgaagaaaccngtccgttctccgtaggtacccagtaccgaacgtaaacccgtcggacccaccgcctccccgaggtcctcctactactcttaatcgaccttaactacgtttaccgacgccgaccggcccgtacccaacgtcggaccctaccttacccgacggtacgtacggttcgaggttacggcgtacggggttgggtaccggtagggaactaacggtaccgtttcgaaccttccgtaccgaaccgtagtaccgtaacggcctaaacgggtaccgtacggggtacccgttacggttaacgggtaagggtttaccgttttaggacccgtttaaagggtttacgtttaactttaccggttacggttacgttaacgtttacgggtaaggtttccgggggttacggggttacctacgggtacggttacccggttggttaccggtttcgggtttaccggacccggggtaacgggtaacctaacgggtcggtaagggaacggtaccgttaaacggaaacccgggttacggtagggttacccgacgtcggtaacccacgtttaccg

SEQ ID NO: 128219 - DNA, 691 bp, Homo sapiens
  misc_feature: GYAE6OF01DF3QB.2.70.G04.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (295)..(295): a, c, t, g, unknown or other
  misc_feature (295)..(295): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagcccaccctctctgcagggccagtcagactgtgcagaacngcttcncctggtaccngcagaaacctggccacgctccaggcctcctcatctntcgctacattcacgtcagtccgccacgtcggcactcccgagaccgtggttccaggtcggcaggtgggtctggggacaggtacgttcacgtaccttcaacccgtataccgacgacgaacggtaccgtacggggaacctccgtagggtaagggttacgttttacgggtacgttaacggttacgttaacgttttacgttagttacctaacgggttacccgtaaggggttcgggttacgggggtttccttcggtaaccgggttcgttacgggttaccgttacgggtttttccgggacccgggtaacggggggtaacccgtaagggtccggttagggaaacggtacggtaaaccggaaacgttaacggttcgggtacgttccgtaggtacccacgttaccg

SEQ ID NO: 128220 - DNA, 847 bp, Homo sapiens
  misc_feature: GYAE6OF01D90FG.2.70.G04.1.454.CMB.1.raw
tcagacgctcgacacacgaccggtgctcgatttagtgtagtgtgaaggggaaagggggaagagctgctcagttacggacccaggacgggaaccagtacggaaaccccagcgcagtcttctcttcctcctgtctactcgtcgcctccagactaccgacggataactgtgtacgacgtcgtacgtcctacgacggtcctaccgttgttcgtttcggtccgtaaccgggaaaggggtaaactaccgtaccctacccgttcgttcgtacggaccggacgggtacctaaggtacgtacggtaccggttggttacggaacgtaaacgaaccgtcgttccgttccgtaccggttacggtaaccgacgaaccgtaacgtaaccgtcggacccgaaccggtcctacccggtacgttcctaccgtacttacgtacttcgtacgtacctactacgtacgcgaccgtacgtcccgacgtaacgtcgaacctaccgtacgagtaccggtgtacggtggtacgtcgggtaacggtcgggtacggtacggtaacgtacgttaaccgtcgttaaccgtacctaaccgtacgtacgacgtacggacgtacggtacggtacgtacggtacgttaggtacgtttacgtacggtaaggttacgtacgtttcgttacgtacgttagtacggttaggtacgggttagggtaccggttcggtaacggtttaccggtcgggtttaccgttacgggttacgggtaaccgggaccgggttaaaggtaccgtaacggggtacgtaaggtaaaccgttacggaacccgttaagggttcgttagggaccttacgggaccttaaccgtgttaacccg

SEQ ID NO: 128221 - DNA, 876 bp, Homo sapiens
  misc_feature: GYAE6OF01AG589.2.70.G04.1.454.CMB.1.raw
  modified_base (263)..(263): a, c, t, g, unknown or other
  misc_feature (263)..(263): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccgaggcctaccctgttctttgtcctaccggaaggggtaaagcgccctacccttcttcgttgcgacgggccagtcagtactgtgacaagaacngtctctcgtcgtaccagcaacgaaccgtcgacccacgtcctaccgacggtcctcctactactctacgtcgtaccttactacttacgacgaccgaccgtcccgacccgtaaggtccggtaacctacccgttaccccgtaacggtaaccggtttacggttaacggtacggggttacgtacggggttacggggttccggggtttacgggttacggggtaacgtacgggtttaaccgtttacccgtaaccgttacccttaaccgtaccggtaacgtacccggaaggtaacccgtaacgggtacggggtacccggtaaccggtttaaccgggttaagggttaacgggttttaacgttttccgggaacgtttaacgggttaacgttttaacgtttaaccgttacggtaccttaacgttacgggttcggggtttcggggttaccggttaccgtcggttacgggttacgttaccggttcgggtttaaccgggttaccggggaaccggtaaaccggggtaacccgtaacggggtacggttaacgggtaaactaaccggttaaaaccggaacggttacgggttaccgggtacggtacgttaccggtaacgttaacccggttcg

SEQ ID NO: 128222 - DNA, 800 bp, Homo sapiens
  misc_feature: GYAE6OF01DPR6Q.2.70.G04.1.454.CMB.1.raw
  modified_base (149)..(149): a, c, t, g, unknown or other
  misc_feature (149)..(149): n is a, c, g, or t
  modified_base (251)..(251): a, c, t, g, unknown or other
  misc_feature (251)..(251): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctccagataccaccgganaaactgtgttgacgcagtctccgagcacctgtctttgtctccgaaggggaaagacgcccacccttctcttgcacgggcagtcagtactggtggacaagaacngtcttctccgtaggtaccagacaacgaaaccgtcggaccacccgtcctacccgacggtccctcccctactacttcctaagttcgccttaactattcgacgaccgacgccggcctacgtcggaccacctacccgacgacgtacggttcgagtcgggtacggagggttcgggtcggtacggggacgtaacggtacggtttacctaaccgttccgtacccaaacccgttagtacccgtaacggaccgtaacggttacccgggtaacggggaccggttaccggttaaggggttaaaccgggtttacggttttacggtacggttaaggttacggtttaacgtttaccgtttacggttaccgttaacttacggttaacgggttgggttaccggggttccgttaccggttacgggtcggttacggttacgggttaaccgggtttttaccgggggaaccgggtaaaccgggggtaccgtaaacggtacggtaagggtaacgtaacggtaaaccgtaaacggtaacggtcggtacggtcgacgtaccgtacgttaccg

SEQ ID NO: 128223 - DNA, 786 bp, Homo sapiens
  misc_feature: GYAE6OF01D7T3Z.2.70.G04.1.454.CMB.1.raw
tcagacgctcgacacacgaccggtgctcgatttagtgtagtgtgaagggaaagggggaagagctgctcagttaggacccagagggaaccatggaaaccccagcgcagcttctcttcctcctgctactctggctcccagactaccaccggagaaactgtgttgacgcagtctccgaggccaccgttgttctttcgtcctccggaaggggaaacgacgccctaccctctcttcggcgacgggcctagtcagtacgtggttcggacaagaaacgtacgtcttccgtccgtacgtaaccagaccaacggtaaacccgtcggacccaccgtaccctacccgacggtccctcctacctactcctatcgtacctacttacttacgacgcctacgcccgacctacgtcggacctaccgtacccgacgtacgtacggttacgtacggtcggacggtacgggttacggtccggtaagggtaaccgtaggttaccgttcctaacccttaccgtaaccctaccgtactaccgtaccgtaaccgacggtacgtacgggacgttaccggtaaggttaacggttacgttttacggcctttaaggttcgtttaacgtttcgtacgttccgtaacgtttccggtaaggtttcgggttaccggggtctttacggacgggttcggtacggttaccgttagggtttccgggaacgtaaaccggggtactaacgggtcgtaacggaacgtaaccgtttaaaccgaaaaccgggttgtacgggtacgaccggtactcccgtacttacg

SEQ ID NO: 128224 - DNA, 735 bp, Homo sapiens
  misc_feature: GYAE6OF01A1TJK.2.70.G04.1.454.CMB.1.raw
  modified_base (248)..(248): a, c, t, g, unknown or other
  misc_feature (248)..(248): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccgaggggaagcgccaccctctcgttgcgagggccagtcagactggtggcaagaaacngtcttctccgtggaccagacgaacgaaaccgtcggacctaccggcctacccgacggtcctacctacgacttacctagtcgaccttaactactttaccacggtcacgcccgaccctaacgtcggacctactacccgaagaccgtacggttccaggtcggacgtagggttcgggtaccgtaggggaaccaggtaccgttacgaccttacgtaccgtacacgtcgaacgtccgacggtacgtacgggacgtaccggttaggtacggtttacgtttcggacgttaaggttacgtttaacgttacgttcgttactacgttacgtagggttacggttcgggtaccttacgacggttcggttacgtacggtttacgggtttccgggaccgggttaaccggggtaaccgtaagggtaccgttagggaacgttaaccggtaacgtaaaaccggtacggttacgggtacggttaccgaccgtaccgtaccgttacgg

SEQ ID NO: 128225 - DNA, 279 bp, Homo sapiens
  misc_feature: GYAE6OF01A79U7.2.70.G04.1.454.CMB.1.raw
  modified_base (232)..(232): a, c, t, g, unknown or other
  misc_feature (232)..(232): n is a, c, g, or t
  modified_base (258)..(279): a, c, t, g, unknown or other
  misc_feature (258)..(279): n is a, c, g, or t
tcagacgctcgacacacgaccggtgctcgatttagtgtagtgtgaagggaaaggggccggcgcgggagcgaatgacgttctggggccagggaaccctggtccaccgtctcctcagccctccaccgaagggcccatcggtccttccccgtggccgccctgcctccgaggacgcacctccgagagcacagcgcctggctgctggtcaaggctacttctgtcgagtcgtcgtagngcggctggacaagggccgatagagcnnnnnnnnnnnnnnnnnnnnnn

SEQ ID NO: 128226 - DNA, 251 bp, Homo sapiens
  misc_feature: GYAE6OF01E3DRR.2.70.G04.1.454.CMB.1.raw
  modified_base (241)..(241): a, c, t, g, unknown or other
  misc_feature (241)..(241): n is a, c, g, or t
  modified_base (247)..(251): a, c, t, g, unknown or other
  misc_feature (247)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcncatagnnnnn

SEQ ID NO: 128227 - DNA, 538 bp, Homo sapiens
  misc_feature: GYAE6OF01CLTDH.2.70.G04.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (325)..(325): a, c, t, g, unknown or other
  misc_feature (325)..(325): n is a, c, g, or t
  modified_base (524)..(524): a, c, t, g, unknown or other
  misc_feature (524)..(524): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaangccacctntctgcaggccagtcagactgtgcagaacngcttcnctggtaccagcagaaactggaccacgctccgaggctcctcatctatgctacattcagcagcgcaactggcatccagacngttcagtggcaggtggtctgggacagtacgttcactacctcaaccgaatcaacggcacgtactgggaacgtccgtagggaagttatttagaccgtaagtggttaattacgtgtcaatcgtaagtgtgggtcctgacgtcgtgtctaggtttcggccgtacgggacagtcgtggaacgtataaccgaaagactggtacgnttacgctaacgtac

SEQ ID NO: 128228 - DNA, 262 bp, Homo sapiens
  misc_feature: GYAE6OF01B5MMD.2.70.G04.1.454.CMB.1.raw
  modified_base (142)..(142): a, c, t, g, unknown or other
  misc_feature (142)..(142): n is a, c, g, or t
  modified_base (241)..(241): a, c, t, g, unknown or other
  misc_feature (241)..(241): n is a, c, g, or t
  modified_base (246)..(262): a, c, t, g, unknown or other
  misc_feature (246)..(262): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaaggcccatcggtcttccccnggcgcctgctccaggagcacctccgagagcacagcggccctgggctggcctggtcaaggactacttcctgtcgagcgtctgagcgggctggcaaggcgnatagnnnnnnnnnnnnnnnnn

SEQ ID NO: 128229 - DNA, 661 bp, Homo sapiens
  misc_feature: GYAE6OF01BOK7K.2.70.G04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
tcagacgctcgacacacgaccggtgctcgatttagtgtagtgtgaagggaaagggggagagctgctcagttaggacccagagggaaccatggaaaccccagcgcagcttctcttcctcctgctactctggctcccagataccaccggagaaactgtgttgacgcagtctccaggcaccctgtctttgtctccgaggggaaangccaccctntcttgcagggccagtcagactgttggcagaaacngctcncctggtacngcagaacctgccagctccagctccncatctangctanctcagcagccgcacgtgctacgtccagacgtaggttccaagttcgggacagggttcgggtacgtaggggaactaggtaacgtttccaacgttcctacaaccgtactacgacgtacgtacgtaacgtcgggtaaccgtcccgtagggtaacggttaacgttttacgacgttaacggtttcgtttaacgtttacgttacgttacctaacgtttacgtacggttacgggttacggggttacttacggttaacggtcggttacggtacgtacggtttccggaccggaacgggtaaccgtacggtaccgtagggtacgtacgtaaccgtaaacgtacggttacggtacgtcgtaccggtactaccgtacg

SEQ ID NO: 128230 - DNA, 257 bp, Homo sapiens
  misc_feature: GYAE6OF01C3F0J.2.70.G04.1.454.CMB.1.raw
  modified_base (249)..(257): a, c, t, g, unknown or other
  misc_feature (249)..(257): n is a, c, g, or t
tcagacgctcgacacacgaccggtgctcgatttagtgtagtgtgaagggaaaggggccggcgcgggagcgaatgagttcgtggggccagggaaccctggtcaccgtctcctcagcctccaccaagggcccatcggtcttcccctggcgcctgctccaggacgcacctccgagagcacagccggccctgggctgcctggtcaaggtactacttcctgtcgagcgtctgagcgggtctggcaggcacatgnnnnnnnnn

SEQ ID NO: 128231 - DNA, 261 bp, Homo sapiens
  misc_feature: GYAE6OF01EP790.2.70.G04.1.454.CMB.1.raw
  modified_base (251)..(261): a, c, t, g, unknown or other
  misc_feature (251)..(261): n is a, c, g, or t
tcagacgctcgacacacgaccggtgctcgattttagtgtagtgtgaagggaaaggggccggcgcgggagcgatgagttctgggccagggaaccctggtccaccgtctcctcagcctccaccgaagggcccatcggtcttccccctggcgccctgctccaggacgcacctccgagagcacgagcggccctgggctgccgtggtcaaggactacttcctgtcgagcgtctgagcggctggcgaagcgcatagnnnnnnnnnnn

SEQ ID NO: 128232 - DNA, 664 bp, Homo sapiens
  misc_feature: GYAE6OF01BCMS1.2.70.G04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
  modified_base (353)..(353): a, c, t, g, unknown or other
  misc_feature (353)..(353): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgttctttgctcgaggggaagngccaccctntcttgcagggccagtcagactggttgacagaaacngtcttctcctggtaccagcagaaacctggccacgctcccaggctcctcatctatcgctacattcagtcagcgccntggctacgtcccaagaccgaggttcagtcggnaggtcgggtcgtagggacaggtacgttaccacttccaccgtacctagtacacgacgaacgtacgttgggacgtaccgtagggtacggtttaagttttacgacgttaagggttcgtttacgtttaacgttcgtacgtacgttcgtaagggttggttcgggggtccttacggtacggcggttggtaccgttagggttttacgggacccggtaagggggtaaccccgtaagggtccggttaggggaacgtaccggttaaccgtaaaacggttaccggttagggttacgggttcctacggtccgaaccgttaccg

SEQ ID NO: 128233 - DNA, 275 bp, Homo sapiens
  misc_feature: GYAE6OF01CEV9E.2.70.G04.1.454.CMB.1.raw
  modified_base (146)..(146): a, c, t, g, unknown or other
  misc_feature (146)..(146): n is a, c, g, or t
  modified_base (171)..(171): a, c, t, g, unknown or other
  misc_feature (171)..(171): n is a, c, g, or t
  modified_base (253)..(253): a, c, t, g, unknown or other
  misc_feature (253)..(253): n is a, c, g, or t
  modified_base (258)..(275): a, c, t, g, unknown or other
  misc_feature (258)..(275): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccgaaggcccatcggtcttcccctggcnccctgctccaggagcacctccgagngcacaggcgccctgggctgcctggtcaaggtaccttacttcccgtaggtcgacgtcgtctggaggcgggctaggcaagggcnagtgnnnnnnnnnnnnnnnnnn

SEQ ID NO: 128234 - DNA, 742 bp, Homo sapiens
  misc_feature: GYAE6OF01DHP7J.2.70.G04.1.454.CMB.1.raw
  modified_base (209)..(209): a, c, t, g, unknown or other
  misc_feature (209)..(209): n is a, c, g, or t
  modified_base (266)..(266): a, c, t, g, unknown or other
  misc_feature (266)..(266): n is a, c, g, or t
  modified_base (610)..(610): a, c, t, g, unknown or other
  misc_feature (610)..(610): n is a, c, g, or t
  modified_base (738)..(738): a, c, t, g, unknown or other
  misc_feature (738)..(738): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctccagactaccaccggagaaactgtgtgacgctagtctccgaggccacccttgttctttgtctaccgaaggggaaancgccctaccctcttcgttgacgacgggccagtcaggtacttgttcggacaagaaccngtccttctccgtacggacacgacaacgaaacccgtcggaccaccgtccgtacccgacgcctcctactaactccttaagtctaccttaaccttacttaccgacggaccgacgtcccggtacctaacgttccggacctaaccgtaccccgtaagggtaaccgttcgggttaaccgagggttacggggccgttacggggttacgggggttaccgtacgggggtaactaggttaaccggttcctaacgttaccctacaaccgtagtacccgaaggtcaaacgggtcgtagggtaacccgtgttaacgggtatttaccggtttgacgttaggttattacttttaacggnttacgtactcggtaggtcgggttcggtatccgaggttccgtagtcggttggttaacccggacggtagggtaacctaaggtccggaagtactaagtaaaccgtaggtactgggtaacgtcacgtacctntacg

SEQ ID NO: 128235 - DNA, 700 bp, Homo sapiens
  misc_feature: GYAE6OF01BN9OB.2.70.G04.1.454.CMB.1.raw
  modified_base (169)..(169): a, c, t, g, unknown or other
  misc_feature (169)..(169): n is a, c, g, or t
  modified_base (213)..(213): a, c, t, g, unknown or other
  misc_feature (213)..(213): n is a, c, g, or t
  modified_base (262)..(262): a, c, t, g, unknown or other
  misc_feature (262)..(262): n is a, c, g, or t
  modified_base (319)..(319): a, c, t, g, unknown or other
  misc_feature (319)..(319): n is a, c, g, or t
  modified_base (572)..(572): a, c, t, g, unknown or other
  misc_feature (572)..(572): n is a, c, g, or t
  modified_base (693)..(693): a, c, t, g, unknown or other
  misc_feature (693)..(693): n is a, c, g, or t
tcagacgctcgacacacgaccggtgctcgatttagtgtagtgtgaagggaaagggggaagagctgctcagttaggacccagagggaaccatcggaaaccccagcgcagcttctcttcctcctgctactctggcctcccagactaccgaccggagaaactgtgttgacgnagtctcaggcctacccttgttctttgtcctccgaagggggaaanacgcctacccgttctcttgcgaggcctagtcacgctgtggacaagaacngtcttctcgtcgaccagccaacgaacctcggaccaccgtcctacccaggtccttccnctactccttacgcgtccttactacttcgacggcaccggccgacctaccgtggacctacgtaccccgaaggtaccgttaacggtctacggtcgtacgggtagggttcgggttacggtacgggacgttagggtacctttacacttccgtaacctaaccgagtaccgaacgtcctaacggtaccggtacggacggaccggttggtaaacgttcggttttgaacggtttgttaacgtttagtttaccgttgttaccncggttacgttcggttcgggttcgggtacctaccgggtgttcggttcgtacggtttgggttccggtacggacggtacgtacggtggacgtacgaaccgtagaacgtcgtgtcgaggtctacnccgttag

SEQ ID NO: 128236 - DNA, 651 bp, Homo sapiens
  misc_feature: GYAE6OF01D7XV4.2.70.G04.1.454.CMB.1.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (615)..(615): a, c, t, g, unknown or other
  misc_feature (615)..(615): n is a, c, g, or t
  modified_base (627)..(627): a, c, t, g, unknown or other
  misc_feature (627)..(627): n is a, c, g, or t
  modified_base (632)..(632): a, c, t, g, unknown or other
  misc_feature (632)..(632): n is a, c, g, or t
  modified_base (641)..(641): a, c, t, g, unknown or other
  misc_feature (641)..(641): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggccaccctgtcttgtctccgaggggaagagcccaccctctcttgcagggccagtcagactgtggcagaaacngcttcncgtggtaccagcagaacctggccacgcctccagcctcctcatctagtggtgctactccaacgacgggaccacgtcgtactcccgagccgtaggttcaggtcggcgtagggtgggtcgtggggtatacggtacgtttaccgacttcctccaaccgtactaccgaggccgtacggtcccgtcggaccgtaacgttccgtaagtaaggttacgttttacgaacgttttaattttacgttaccttgtacgtaagtacgtaaggttaactaaacgttaccgttcgggtacccgttcgggttacggtaccggttcggtaaccgaacgggtaaccgaagggtacgaaataccgaaacgtcgtggtacggntaccgacacgtntcgtnttccgttcnccgttccccg

SEQ ID NO: 128237 - DNA, 744 bp, Homo sapiens
  misc_feature: GYAE6OF01C1TSS.2.70.G04.1.454.CMB.1.raw
  modified_base (231)..(231): a, c, t, g, unknown or other
  misc_feature (231)..(231): n is a, c, g, or t
tcagacgctcgacacacgaccggtgctcgatttagtgtagtgtgaagggaaagggggaagagctgctcagttaggacccagagggaaccatcggaaaccccagcgcagtcttctcttcctcctgcctactctggcctccagactaccgaaccggagaaactggtgttgaccgtcacgtcctccgacggcctacccgttgtttctttcgtccgtaccggaagggggaaaacncgcccctacccttcgttcgttcggccgaacgggcctagtccaggtacttggtacggacaagaaactgtccttccgtccgtacggtaccgaagaccaacggtaaaccgtcggacccaccgtcctacccgacggtcctacctactactactagttcgacctacgtacttcagaccgacggtccgcctacgtcgacctacgtccgaagtcgtacggttcaggtacgacggtggttagggtcgtacgggactacggtacgttacaccgttcaccgaacttcgacgacgtacgtaacggacgtacggacgttacggtaggtacggtttacttcggtacgtagttacgttagttaccttcgtacgtagttcgttacgggttcggttacggttctagtcggtacgtcggttcggttacggttacgggacggaacgggtacggtacggtggtaacggtaggtaaccgtaacggttaaacggacggttacgtacgggtacctaccgggtcctaacgtttccg

SEQ ID NO: 128238 - DNA, 289 bp, Homo sapiens
  misc_feature: GYAE6OF01DXB0T.2.70.G04.1.454.CMB.1.raw
  modified_base (145)..(145): a, c, t, g, unknown or other
  misc_feature (145)..(145): n is a, c, g, or t
  modified_base (163)..(163): a, c, t, g, unknown or other
  misc_feature (163)..(163): n is a, c, g, or t
  modified_base (258)..(289): a, c, t, g, unknown or other
  misc_feature (258)..(289): n is a, c, g, or t
tcagacgctcgacacacgaccggtgctcgatttagtgtagtgtgaagggaaagggccggcgcgggagcgaatgagttcgtggggccaggggaaccctggtcgaaccgtctcctcgagcctccacaagggcccatcggtcttcccnggcgcctgctccgaggancacctcgagagcacagccggcctgggcctgcctaggtcaaaggcttacttccgtgtcgagcctgtggagcgggtctagggcaagggctcagtagnnnnnnnnnnnnnnnnnnnnnnnnnnnnnnnn

SEQ ID NO: 128239 - DNA, 799 bp, Homo sapiens
  misc_feature: GYAE6OF01C8HO0.2.70.G04.1.454.CMB.1.raw
  modified_base (153)..(153): a, c, t, g, unknown or other
  misc_feature (153)..(153): n is a, c, g, or t
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (258)..(258): a, c, t, g, unknown or other
  misc_feature (258)..(258): n is a, c, g, or t
tcagacgctcgacacacgaccggtgctcgatttagtgtagtgtgaagggaaagggggaagagctgctcagttaggacccagagggaaccatggaaaaccccagcgcagcttctcttcctcctgctactctggctcccagactaccaccggganaaactgtgttgacgctagtctccgaggcaccctgtctttgtctccgaaggggaancgcccaccctntctgcgacgggccagtcacgtactggttagcaagaaacngtccttctccgtggtaccagacaacgaaccgtcggaccaccgcctacccaggtcctcctcatctatcgtcctaagtattcgagccacggccgcctactcgacactcccgagtaccgtaagttcgagggtcgacggtacgggttgggtaccggtagggaaccgtaaggtccgttaccaccgttccttaacccgaccgtaactccggaacgacgtaacggtacggttacggggtaccctggtaacgggttaacggtttattttacgggacgtttaaagggttcgtttaacgtttaccggttagtacttacggttaacggttcgggttacggggtttaccgggtttcccgtagttaccggggttccgttaccggggttacggttttaaccggggggttccgggtaaccccgggtaaagggggtaccccggtaaagggttaccgttaaagggtaaccggttaaaccgggttaaaaccccggtaaagggttacgtttaccggggaacgggttttcccgaaccggtacccgttacccggttaaacgg

SEQ ID NO: 128240 - DNA, 638 bp, Homo sapiens
  misc_feature: GYAE6OF01ALBAE.2.70.G04.1.454.CMB.1.raw
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggccaccctgtctttgtctccgaggggaaangccacccgtctcttgcgacgggccagtcagactgttgcagaaacngcttctcgtgtacagcaacgaacctggccacgcctcccgagcctcctcactctatcgctactntccgagacgcgccgtaccacgtcggccaacgtcccagacgtacggttacgaggtcgacgagggttcgggtacgtcgggacgtaacggtcgttacctacgttccctaccgaacgtactcgaacgtcgaacggtacgtacgggacgtacggtacgggtagtttacgtttacgtacgtaggttagttacttacgtcgtactactgtcgggttggtcgggtctacggtcgttcggtcgtgttacgggttcggacggtacgggtacgacggtcggtaggacgtaacgtaaccggaacgtacggtacggtacgacgtcggtcctaggttacg

SEQ ID NO: 128241 - DNA, 804 bp, Homo sapiens
  misc_feature: GYAE6OF01CPR7V.2.70.G04.1.454.CMB.1.raw
  modified_base (150)..(150): a, c, t, g, unknown or other
  misc_feature (150)..(150): n is a, c, g, or t
  modified_base (181)..(181): a, c, t, g, unknown or other
  misc_feature (181)..(181): n is a, c, g, or t
  modified_base (205)..(205): a, c, t, g, unknown or other
  misc_feature (205)..(205): n is a, c, g, or t
  modified_base (546)..(546): a, c, t, g, unknown or other
  misc_feature (546)..(546): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctccagactaccaccgganaaactgtgttgacgcagtctccaggcacctntctttcgtcctacgaaggggaacncgccctacctctcgttcgacgacgggacctagtacgaacgtacgttggttcggactaaacggtaaccgtacgttcctttaccgtccggttacggtaaccaaggaccgtaacggtaaaaccggtccggacccgtaaccgtccctacccgaacggtccttcctactacttccgtacttacgacttaacgtcgttacgcgacgacggtccgtacctaggtcgaccacctacccgaacggtaccgttaacggtttcgaaggggttcggacggttacggggttccggggtacgtacggggaactaacgggtcgtttacctaccgtactaccgaactcgacgtacgngacgtacgtggaccgtacgtaggtaagtttagttcgacgttaggttacttacgttagttcgtactacgtacggttaagttccggggtacggttaacgttccgtaagggttccgtacgtttacggttaacccgggttcgggtaaccgggtacgggttaaacctacgggtacggttaacgggaacggttaaaccgaaacgggttaaccgtaacgggtttcgggtaaccggtctaacccggtaacccgtcggtttaacccg

SEQ ID NO: 128242 - DNA, 814 bp, Homo sapiens
  misc_feature: GYAE6OF01CS1IK.2.70.G04.1.454.CMB.1.raw
tcagacgctcgacacacgaccggtgctcgatttagtgtagtgtgaaggggaaaggggggaagagctgctcagttaggacccagagggaaccatcggaaaccccagcgcagcttctcttcctcctgctactctggctcccagactaccaccggagaaactgtgttgacgcagtctccaggccaccctgtctttgctccgaaggggaagacgccaccctctcgttgcgacgggccagtcgagtactgttggacaaggaaacacggtcttccgtccgtcggtaaccagtacgaacggtaaaccgtccggaccacggtccctaccgacggtcctacctactactactacgttcgtccgggtaactactcgtaacgccacggtaccgccctacggtcggtacctaccgtacccgtaacggtcgtaacggttacgtcggtacgggtacggtacggtcggggtacggtcggggtaactaggtacgttaccgtacgtacctccgtaaaccgtacgtcgtaacgaccgtacgggtaaccggtacgggacgttaccgtacgggttaagtttacgttttacgggactttaacgggtacgttaacgttttaccgttaggttaacctagtttacggtcgggtttacggggttccggggtttacgtacgtaccgggttacggttaccggttcgggtttaaggtttccgggaaccgggtaaccggggtaccggtacggtccgggtaacggtaacggtaaaccggttaaccgtaaacggttaccggttacggttaccggacccggtttaccgacgttacccgtacccggg

SEQ ID NO: 128243 - DNA, 664 bp, Homo sapiens
  misc_feature: GYAE6OF01AEZYN.2.70.G04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccaggggaangccacctctcttgcagggccagtcagtacgtgttggcagaacagccttctccgtggtaccagcagaaccgtggccacgctcccgagcctcctcntctatcgctacnttcagcacgccgcctacgtggaccactaccccgagaccgtaggttacaggtcggacgtaggttcgggtcgtaggggacctagggtacgttacctacgtaccgtcccaaccgtacgtaccgtaacgccgaagtaccgtcgggtaccgtaccggtaggtaacggtttacggtttacgtaccgttaggtagttaacgtttaccgtggttactagttacgttaggttcgggttcgggttctacggtacggttcggtacgttcggttacggtttacgggccggtacggggaaccgtacggtcggtagggtaacgtacgtaaccggtaaagtacggtacggtacggactcggtaccgtcgtacg

SEQ ID NO: 128244 - DNA, 693 bp, Homo sapiens
  misc_feature: GYAE6OF01BCMOO.2.70.G04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtcttgtctccgagggaangccaccctntcttgcagggccagtcagactgtggcagaaacngcttctcctgtaccagcagaaacctggccacgcctcccaggctcctcatctatcgctactattcacgcagccgccacgtcggcactcccgagaccgtagggttccaaggtcggcgtaggtgggtacgtagggaacaggtacggttccacgtccttaccaacccagtaccaacgcctaaggtacgtcgggaacgtccgtaggtacggtacgttttgaccgttaaggtttcgtaacgtttaccgtggttacctacgtacggttacggtttcggggtcgggttaccgttacggtacggttccgggtacgtccggtttaacgggttttccgggacccgggtaacggggaacccgtaaacgggtcggtaagggaacggttaaacccggtaaccggtaaaacgtttaaccgggtcgggttacgggtacccgtttcggaacccgttaacccgttaccg

SEQ ID NO: 128245 - DNA, 834 bp, Homo sapiens
  misc_feature: GYAE6OF01EJG06.2.70.G04.1.454.CMB.1.raw
  modified_base (118)..(118): a, c, t, g, unknown or other
  misc_feature (118)..(118): n is a, c, g, or t
  modified_base (202)..(202): a, c, t, g, unknown or other
  misc_feature (202)..(202): n is a, c, g, or t
tcagacgctcgacacacgaccggtgctcgatttagtgtagtgtgaagggaaagggggaagagctgctcagttaggacccagagggaaccatggaaaccccagcgcagcttctcttccncctgctactctggctcccagataccaccggagaaactgtgttgacgcagtctccaggcaccctgtctttgtctccaggggaaanagccacctcgtcttgcagggccagtcacgtactgttagggctaaggaaacctgcctttctcccttgggtaaccaggcaaaggtaaacccctgggacccgaaccgccgttacccgaagggtcctccctcgattacctactcggtactaaccgtagttaccacgtctaaggcccaccacgttcggcaaaccgttcccccgaaaggtaaccctacggggtttaactaacgggttcgggaacccgtaggggtttaacccggggtttcgtttacggggggaaccctaagggggttaacccgtttacgtaaacccggttccttaaacccgacccgttaaaggtttccgtaacggtaccgaacgggtaaccggttacgggaaccgttacccggttaagggtacggtacggtttttacggacttacggttacgtaactttaccgtagtaccgtagttaccgtaggttacggttcggggttacctcggtacgttaacggttccgttacggttacgggtttacgggacccggtacggggtaaacccgaacggttcgtaaacggggactaaacgtaacccggtaaaggttaacccggtacgggttaccgggtaacctttacggaaccgttaacccgtaacggg

SEQ ID NO: 128246 - DNA, 248 bp, Homo sapiens
  misc_feature: GYAE6OF01CTJUB.2.70.G04.1.454.CMB.1.raw
  modified_base (244)..(248): a, c, t, g, unknown or other
  misc_feature (244)..(248): n is a, c, g, or t
tcagacgctcgacacacgaccggtgctcgatttagtgtagtgtgaagggaaaggggccgcgcgggagcgaatgagttctggggccagggaaccctggtcaccgtctcctcagcctccaccaagggcccatcggtcttcccctggcgccctgctccaggagcacctccgagagcacagccggcctgggctgcctggtcaaggactacttcctgtcgagcgtctgagcggctggcaggcgcatagnnnnn

SEQ ID NO: 128247 - DNA, 704 bp, Homo sapiens
  misc_feature: GYAE6OF01BAFHX.2.70.G04.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (388)..(388): a, c, t, g, unknown or other
  misc_feature (388)..(388): n is a, c, g, or t
  modified_base (692)..(692): a, c, t, g, unknown or other
  misc_feature (692)..(692): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagatacccaccgganaaactgtggttgacgcagtctccaggccacctgtctttgtctccgagggaangccacctntctgcgtaggccagtcagctggtggcaagaaactgtcttctcgtacggtaccagccgaagaaaccgtggacccaccgcctcccgaagtccctacctactactcgtactcgtactaacctattaccgacgtcgacggccctccacgtcggaccaacgtaccccgagaccgtcggtacnggtacgcgtagggtcgggtaccgtagggaaccgtggtactttccgacgttacctacctaccgtactcgacgtacgtaagaccgtcgggtacacgggtagttaacgggttactttacggtacgttaaggttcgtttaacgttacgttcgtactaggtttacgtacgggtttcgggttaccgggtcgtaccgggtacggttcgggtaagggttcgtttacggggttccggaccgggtaacggttaaccggagtacggttaggaaccgttaagtaacccggtaaatacggtacgggttcaccggtancccgtataccgg

SEQ ID NO: 128248 - DNA, 748 bp, Homo sapiens
  misc_feature: GYAE6OF01CGNX9.2.70.G04.1.454.CMB.1.raw
  modified_base (152)..(152): a, c, t, g, unknown or other
  misc_feature (152)..(152): n is a, c, g, or t
  modified_base (210)..(210): a, c, t, g, unknown or other
  misc_feature (210)..(210): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggcctcccagactaccaccgganaaactgtgttgacgcagtcctccgagccaccctgttctttgtcctccgaaggggaaancgccaccctctcttgcgaggccagtcagactgtgcaagaacngtctcncgtggtaccngacaagaacctcgaccacgccctccgagtcctcctactactactatcgaccttactattccgagcctacggcccacccgtacgtccggacctaccggtacccaaggaccgttacggttcgacggttcgacgttagggttccgggtacgtacgggaactaggtaccgttacgaaccttcccgaacacccgtagtacgacgtacgacgtacggtcggagtacccgttaggtaacggtttacgtttcggacgttacggttacgttaaccgtttacgttacgttaccgtaacgttacggtttacgggtttaccggggttacggggttacccttagggtaccgttcgggttaccggttacggtttacgggtttaccgggaccgggttaacggggtaacccgacggttcggaagggttaactaaccggtaaaccggtaaacggttacgtacgggttacgtaccgtacggtaccctccggttaaccg

SEQ ID NO: 128249 - DNA, 316 bp, Homo sapiens
  misc_feature: GYAE6OF01DSYXZ.2.70.G04.1.454.CMB.1.raw
  modified_base (150)..(150): a, c, t, g, unknown or other
  misc_feature (150)..(150): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (293)..(316): a, c, t, g, unknown or other
  misc_feature (293)..(316): n is a, c, g, or t
tcagacgctcgacacacgaccggtgctcgatttagtgtagtgtgaagggaaaggggccggcgcgggagcgaatgagttcgtggggccagggaaccctggtcaccgtctcctcacgcctaccaccgaagggccctatcggtccttcccccnggccgccctgcctccgaggacgcctaaccctccggagacgccgaacgacggtccggtcccgtggggcctcgtcccgtaggtacgaacggtacttaccttccgtgtacgagcgtcgnggaggcggntggcaaggccganagtgnnnnnnnnnnnnnnnnnnnnnnnn

SEQ ID NO: 128250 - DNA, 255 bp, Homo sapiens
  misc_feature: GYAE6OF01AQHMQ.2.70.G04.1.454.CMB.1.raw
  modified_base (243)..(243): a, c, t, g, unknown or other
  misc_feature (243)..(243): n is a, c, g, or t
  modified_base (248)..(255): a, c, t, g, unknown or other
  misc_feature (248)..(255): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtccttcccctggccgccctgctccaggagccacctccgagagcacagcggccctgggctgcctggtcaaggactacttcctgtcgagcgtctgaggcggctggcaaggcncatgnnnnnnnn

SEQ ID NO: 128251 - DNA, 618 bp, Homo sapiens
  misc_feature: GYAE6OF01EUBRA.2.70.G04.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (306)..(306): a, c, t, g, unknown or other
  misc_feature (306)..(306): n is a, c, g, or t
tcagacgctcgacacacgaccggtgctcgatttagtgtagtgtgaagggaaagggggaagagctgctcagttaggacccagagggaaccatggaaaccccagcgcagctctcttcctcctgctactctggctcccagataccaccggagaaactgtgttgacgcagtctccaggcaccctgtctttgctcaggggaanagccaccctntcttgcagggccagtcagctgtggacagaaacngcttcnccgtggtaccagcagaacctggccacgctccagctcctcatctatgctactatcaacgngccgcactgcatcccagactaggtcaggtgcgagtgggtactgggactagtagttccacgtctcgaaccagtccagacacggtacgtgggacgacccgtaggaggttacttttggacgttaggttacgttaacgtttacgttcgttactagtacgtaggttggggttcggggtacctcggtaacggtcggttacggtccggttacgggttttcgggaccggtaacggggtacccgtaaaggtcggtacgggaagtaacgtacggtaaaaccgtacgtaggtacgggccgttacgccgtacgtcgttacccgg

SEQ ID NO: 128252 - DNA, 659 bp, Homo sapiens
  misc_feature: GYAE6OF01DW8WO.2.70.G04.1.454.CMB.1.raw
  modified_base (248)..(248): a, c, t, g, unknown or other
  misc_feature (248)..(248): n is a, c, g, or t
  modified_base (366)..(366): a, c, t, g, unknown or other
  misc_feature (366)..(366): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtcttgtctccgaggggaagcgcccaccctctctgcgacgggccagtcagactgttggacagaaacngccttctccgtaggtaccagacaagaaacctggcccaccgcctacccgaggtcctacctcatcttacgtcgtacctactacttcgagccacgccgaccacgtcggacacctacccganaccgtaggttcgaggttcggcgtagggtcgggtacgtacggggactaggtacgttcaccgttcaccaactcgtacacggacgtaacgtacggacggacgtacgtaggtaacgtagttttacgacgttaagttcgtttaacttacgtcgtactagttcgtaaggttgggttacgggttccttcggacgttcggttagtcggtttacgggtttccggaccgggtaacggggaacgtagggtcgtaggaacggtactaacggaacgttacgtgggtacgtacgtcgacctcgtacg

SEQ ID NO: 128253 - DNA, 808 bp, Homo sapiens
  misc_feature: GYAE6OF01BAUCA.2.70.G04.1.454.CMB.1.raw
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctcaggcaccctgttctttgtctaccgaggggaaagcgccctaccctctcttgcgacgggccagtcagtactggttgacaagaacntcttctccgtgtaccagactaacgaaccgtcgacccacgcctacccgaggtcctccnctactctagtcgactactcgttcgacgcgtaccgccgacctacgtcggacctaccgtacccgaggtaaccgtaccgggttactacggggtacgtacggtacgggttcggggtaccggtagggtacgtaacggggtttacgttacccgtaacctcccgttaacccgtaaccgtacgttaaccgacgtaccgtaacgggtacggttaacggggtaccgtacgttaacggggtacgttttacgtttacggtacggtttaagttacgtttaacgttacccgtcgttacgtaacgttcggtaagggtttccggggttaccgggtttcgtaccggttacggggttaccggttcgggttacggtttcggggtttaaccgggggaccgggttaaccggggttaaacccggtaagggttcccgggaaagggttaacgttaaacggtaaacccggtaaacggttacgttacggggtacgtaccggtaccgtacccgtaccggttacg

SEQ ID NO: 128254 - DNA, 283 bp, Homo sapiens
  misc_feature: GYAE6OF01A439Y.2.70.G04.1.454.CMB.1.raw
  modified_base (160)..(160): a, c, t, g, unknown or other
  misc_feature (160)..(160): n is a, c, g, or t
  modified_base (255)..(283): a, c, t, g, unknown or other
  misc_feature (255)..(283): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaaggcccatcggtcttcccctggcgccctgctccaggancacctccgagagcacagccggccctgggctgcctggtcaaggcttacttcctgtcgagcgtctggagcgggctgggccgaaggccgctaagtagnnnnnnnnnnnnnnnnnnnnnnnnnnnnn

SEQ ID NO: 128255 - DNA, 724 bp, Homo sapiens
  misc_feature: GYAE6OF01BRCZR.2.70.G04.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (530)..(530): a, c, t, g, unknown or other
  misc_feature (530)..(530): n is a, c, g, or t
tcagacgctcgacacacgaccggtgctcgatttagtgtagtgtgaagggaaagggggaagagctgctcagttaggacccagagggaaccatcggaaaccccagcgcagcttctcttcctctgctactctggctccagactaccgaccggagaactgtgtgacgctagtctcgaggcctaccttgttctttgtcctacgaagggaancgcctcctctntcgcgacggtcagtctacgacttggtacgacaagaacngtcttccgtccgtagtaccngacgtaacgaaccgtggaccacgtcctaccgagtcctacctctactctaagtcgtacctacgttctacgacgtcaccgtccgtaccgtacgcgaccgtacctaccgaacggtaacgttggtacgacggtgacggtgggtacgtcggtagacgtagtcgtactacgtcctactaccgagttcgagtcgtacgtacgtacggacttccgggtaagtacgtttagtttcgaacgtttaggttacgttacggtttaacncgggtttaacctaggttccggttagggtttaccggggttacgtacggttaccggttcggttacggtcggttacgttacggggttaccgggtaccgggtaaacgggttaccgtagggtaccggtaacggtaacgtaccgggtaaccgtaaacgggtcgttacgggtaccgtgaaccggttaacctcggttaacgg

SEQ ID NO: 128256 - DNA, 669 bp, Homo sapiens
  misc_feature: GYAE6OF01CAV42.2.70.G04.1.454.CMB.1.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
tcagacgctcgacacacgaccggtgctcgatttagtgtagtgtgaaggggaaagggggaagagctgctcagttaggacccagagggaaccatggaaaccccagcgcagcttctcttcctcctgctactctggcctcccagactaccaccggagaaactggtgttgacgcagtctccgaggccaccctgttctttgtcctaccggaaggggaaacgacgcctaccctctcttagcgagggccagtcagactgtgganaagaacngtcttctccgagtaccagacaagaacctggccaaggccctcccaggcctccgctatctacgtnacttaactactacgacncgcgacctccagtcgccagtacccaggacttacggtcgaaggtcggagtacggtcgggtccggagggtctaacgttacgtacgtccctactaccggaccctagtcgaacgacgtaacggtaccgttagggaacgtaccggttaagggacggtttagtttaccggaacggtttcgttaacggttaacttacgttacgtacgtagtacggttaagggttcggttcgggtacttacgacgtcggtacgtacggttggttaccggacggtacggaccgaggtcgtaggagtaccgtaacgaacgtacgtgaacgttcgactcgtactacg

SEQ ID NO: 128257 - DNA, 544 bp, Homo sapiens
  misc_feature: GYAE6OF01A6EQM.2.70.G04.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (392)..(392): a, c, t, g, unknown or other
  misc_feature (392)..(392): n is a, c, g, or t
  modified_base (436)..(436): a, c, t, g, unknown or other
  misc_feature (436)..(436): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttggcagaaacngcttcncctggtaccagcagaaacctggccacgctcccgaggctcctcatctatgctacattcagcagcgcccacgtggccactccccagacgtaggttcagtcggcaggtgggtccgtgggaacaggagttcactctcaccatcngcagacgtggagccgtagaggtatttgctagttgtacttacgtntacatcgtaggttggtgggtctcgaggtcgtagtcgtggtttcggccggtaagggaccaggcgtagggagtacgtaccgaaacgtacgtaggcggtcgcgcgactacg

SEQ ID NO: 128258 - DNA, 870 bp, Homo sapiens
  misc_feature: GYAE6OF01CZ4RR.2.70.G04.1.454.CMB.1.raw
  modified_base (590)..(590): a, c, t, g, unknown or other
  misc_feature (590)..(590): n is a, c, g, or t
tcagacgctcgacacacgaccggtgctcgatttagtgtagtgtgaagggaaagggggaagagctgctcagttaggacccagagggaccatggaaacccagcgcagcttctcttcctcctgctactctggctcccagactaccaccggagaaacttgtgttagaccgcagttcctccgaggcctacccgtgttcctttgtcctacccgaaggggaaacgcgaccccgacccttctacgttcgaccgaacgggcctacggtcaacggtaccgttgggttacggacctaacggaaacctcggttcctttaccgtacccggttcgggtaacccaggaaccgtaaccggtaaaacccggttccggggacccctaaacccggtacccgttacccccggaacggggtccccttaccccggttaccgttaaacgttaccttaacgtaccggtaacctttaacgtaccgtttaccgaacggtaccgacggtaccgaccgtacgtacggtacacccgtacccgtacgacgtacgttcgacggtcgtacggtaggtcggtacgtacgggactacgtcgttaccacgttactaccaccttanacgacgacgaccgtacgtacgggacgttccgtaagtaccggtttagttcgtacgtacggtttacgtactttacgttacgtacccgagttaacgtaacgttaacgttaaacgttaccggttaccggtaccggttacgggtaccggttaacccggttaccgggaaaccggtttaaaccgggaacggttaacgggtaacgttaaaccggtaaccggaacggttaacgttacggaccggtacgtaccgttaacccgacgtttaccgttaccgtttccgtacccg

SEQ ID NO: 128259 - DNA, 725 bp, Homo sapiens
  misc_feature: GYAE6OF01B676M.2.70.G04.1.454.CMB.1.raw
  modified_base (120)..(120): a, c, t, g, unknown or other
  misc_feature (120)..(120): n is a, c, g, or t
tcagacgctcgacacacgaccggtgctcgatttagtgtagtgtgaagggaaagggggaagagctgctcagttaggacccagagggaaccatggaaacccagcgcagcttctcttcctctnctactctggctcccagactaccgaccggagaaactgtgttgacgcacgtctccgaggccaccttgttctttcgtcctccgaagggaaagtcgccctacccgttctcgttgacgacgggccagtcacgtactggttcggacaagaacacgtcttaccgtccgtacgtaaccgcgacaaacggaaaccgtcggacccaccgcctacccgacggcccttacctcacttctacgtcgacttaactacttacaacgcgacgccgtacccgactcggtacctaccgtacccaaggacgttacggttaccaaggtcgggtaccgtagggtttcgggtaccggttacgggaacgtaaggggttacttaccgtcctaccttaacacccttagtacacggacgtaacgtacggtcggtaaccgtcggtacggttaaagtttcgttagtacgttaggttacgttacgtttcttcgtactacgttacgggtgttcgggttacggttcgttacggtaggtccttaggttacggttacggtttacggaccggtacggacgtaaggtcgtaagacggttacaacggtaaacgtcgtcggtacgtcacgtcttaccgtacg

SEQ ID NO: 128260 - DNA, 285 bp, Homo sapiens
  misc_feature: GYAE6OF01EXLHM.2.70.G04.1.454.CMB.1.raw
  modified_base (145)..(145): a, c, t, g, unknown or other
  misc_feature (145)..(145): n is a, c, g, or t
  modified_base (161)..(161): a, c, t, g, unknown or other
  misc_feature (161)..(161): n is a, c, g, or t
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (251)..(285): a, c, t, g, unknown or other
  misc_feature (251)..(285): n is a, c, g, or t
tcagacgctcgacacacgaccggtgctcgattttagtgtagtgtgaagggaaaggggccggcgcgggagcgaatgagttctggggccagggaaccctggtcaccgtctcctcagcctccaccgaagggcccatcggtcttccccnggcgccctgctcaggncacctcgagancacagccggcctgggctgcctggtcaaggctacttccngtcgagcgtctagagcgggctgggacaagggccncagtagnnnnnnnnnnnnnnnnnnnnnnnnnnnnnnnnnnn

SEQ ID NO: 128261 - DNA, 272 bp, Homo sapiens
  misc_feature: GYAE6OF01E0XEX.2.70.G04.1.454.CMB.1.raw
  modified_base (256)..(272): a, c, t, g, unknown or other
  misc_feature (256)..(272): n is a, c, g, or t
tcagacgctcgacacacgaccggtgctcgatttagtgtagtgtgaaggggaaaggggccggcgcgggagcgaatgagttctggggccagggaaccctggtcaccgtctcctcagcctccaccaagggcccatcggtccttccccctggccgccctgcctccgaggagccacctccgagagcacagccggccctgggctgcctggtcaaggctacttcctgtcgagcgtctgaggcgggctgggcaaggcgcatagnnnnnnnnnnnnnnnnn

SEQ ID NO: 128262 - DNA, 769 bp, Homo sapiens
  misc_feature: GYAE6OF01EHWKF.2.70.G04.1.454.CMB.1.raw
  modified_base (224)..(224): a, c, t, g, unknown or other
  misc_feature (224)..(224): n is a, c, g, or t
tcagacgctcgacacacgaccggtgctcgatttagtgtagtgtgaagggaaagggggaagagctgctcagttaggacccagagggaaccatggaaaccccagcgcagcttctcttcctctcgctactcgtgcctccagactaccaccggaagtaaacgtgtgttcgacgctagtcctcgaggcctacccgttggttcttttacgtcctaccggaaggggaaaanccgtccctacccgttacgttcgttacgccggtaacgggtccctaaggtcaagtacggttcgtaggaccgaaagtaaacgtcgttccttacctaccggtacggtaaccgagtaccgaaacgtaaccgtcggacccacgtacgtaccacggtctccgtactagttaccgtagtacgtaacttaaacgtacgacgtacgaccgtaccgtaccgtaccacggtaccacgtacccgaggtaacctaggttaccgaggtcgtacgtacggttacggtacggtacggtactacggtacgtttaccacggtacctaacgaccggttacacgacgtaacgtacgtacgtacgtacgtacgtacgtagtacgtttagacgttacggttacgttagtacgtacgttcgtactacggtacgtgggtacggttacgtacggtcgtcgtacggttacgtacggtttacgggaccggtaaccgggtacgtaacgtacggagtacggtaacgtaaccgtaaggtaccgtaggtacggtacgtacctacgtacgtcgttacg

SEQ ID NO: 128263 - DNA, 338 bp, Homo sapiens
  misc_feature: GYAE6OF01EYATF.2.70.G04.1.454.CMB.1.raw
  modified_base (147)..(147): a, c, t, g, unknown or other
  misc_feature (147)..(147): n is a, c, g, or t
  modified_base (151)..(151): a, c, t, g, unknown or other
  misc_feature (151)..(151): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (242)..(242): a, c, t, g, unknown or other
  misc_feature (242)..(242): n is a, c, g, or t
  modified_base (277)..(338): a, c, t, g, unknown or other
  misc_feature (277)..(338): n is a, c, g, or t
tcagacgctcgacacacgaccggtgctcgatttagtgtagtgtgaagggaaggggccggcgcgggagcgaatgtagttcgtggggccagggaaccctggtccaccgttctcctcagcctccaccaaggccctatcggtccttccccnggcnccctgcctccaggacgccacctcgagancanaggcggccctgggctcggcccgtggtacgaaggtacttacctccgtagtcgtagcggttntcggagcggggtctagggcgaacggctacataagnnnnnnnnnnnnnnnnnnnnnnnnnnnnnnnnnnnnnnnnnnnnnnnnnnnnnnnnnnnnnn

SEQ ID NO: 128264 - DNA, 310 bp, Homo sapiens
  misc_feature: GYAE6OF01AIH3Z.2.70.G04.1.454.CMB.1.raw
  modified_base (247)..(248): a, c, t, g, unknown or other
  misc_feature (247)..(248): n is a, c, g, or t
  modified_base (250)..(251): a, c, t, g, unknown or other
  misc_feature (250)..(251): n is a, c, g, or t
  modified_base (253)..(253): a, c, t, g, unknown or other
  misc_feature (253)..(253): n is a, c, g, or t
  modified_base (256)..(310): a, c, t, g, unknown or other
  misc_feature (256)..(310): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccaagggcccatcggtcttccccctggcgcctgctccaggagcacctccgagagcacagccgccctgggctgcctggtcaggctacttccgtgtcgagcgtctgacgcgggctggacaaggcacatagnntnncngtnnnnnnnnnnnnnnnnnnnnnnnnnnnnnnnnnnnnnnnnnnnnnnnnnnnnnnn

SEQ ID NO: 128265 - DNA, 1046 bp, Homo sapiens
  misc_feature: GYAE6OF01ANOOF.2.70.G04.1.454.CMB.1.raw
tcagacgctcgacacacgaccggtgctcgatttagtgtagtgtgaagggaaagggggaagagctgctcagttaggacccagagggaaccatggaaaccccagcgcagcttcctcttcctcctgccttactctcggcctcccagactaccgaccggaagtaaacgttgtgttcgacgctagttcctaccgaggacctacccgttgttccttttcgtcctaccggaaggggtaaacgaccgtcccctacccgtttccgttacgttcggaccgaccggggtcctaacgttaccgaacggtacctttacgggttacggaaaccgaaacggtaaaaccgtccggtttacccgtttcccgttccccggtaaccgggttaacccgacggtaaccgtaaaacccggtaaacccggttccggggaaaccccccttaacccggaccccgttacccccgggtaaccggggttaccccctttaccccgtaaccgttaaccgtttaacccttacgggtttacccgtaaacccgtttaacccttaaacgttttccccgaaaaccggttcccaacccggggtaccccggtaacccgtaacccgggtttaaccgggaccccttaaaccccggtaccccgtaaacggggttaaacccggtttacggtttaaccggttaaaaccgggtcgggggtaaccggtttaaccgggggtaccgggggttttaaccggttaaccgggggtaacgttaacccgggtaacgttttaaacccgtaccccgtttaaccggtaaccctaaccccgtaacgttacgtaaccggtacggtaacccggtaacggtaccgggtaacccggtaccgttacgggttacgttacgtttaccggacgtttaaggtacgtttacgttacggttacgtacgttacgttaacggtggtttacggttccgttcgtacgtcggtagttcggtacgttaccggttacgggaccgtaccgggaacgtacggtaggtaacgtacgtacgaacgtaaccggtcgtagggactacgtactaccgtcgttaacg

SEQ ID NO: 128266 - DNA, 277 bp, Homo sapiens
  misc_feature: GYAE6OF01BUGPK.2.70.G04.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
  modified_base (253)..(277): a, c, t, g, unknown or other
  misc_feature (253)..(277): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatccggttcttccccctggccgccctgcttccaggagcacctccgagagcacagcggccctgggctgccnggtcaagggactacttctgtcgagcgtctgacgcgggctggcaaggcncactagnnnnnnnnnnnnnnnnnnnnnnnnn

SEQ ID NO: 128267 - DNA, 670 bp, Homo sapiens
  misc_feature: GYAE6OF01C3Q6I.2.70.G04.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagacgctcgacacacgaccggtgctcgatttagtgtagtgtgaagggaaagggggaagagctgctcagttaggacccagagggaaccatggaaacccagcgcagcttctcttcctctgctactctggctccagactaccaccggagaaactgtgttgacgcacgtctcgaggcacctgttcttgtctcgaagggaancgccncctctctcgcacgggcacgtcagacttgtcgacacgaactacgtcttcgtacgtcgtaccacgacgtaacgaaaccgtcggaccacgcctccgacgtcctaccgtctactctacgtcgacttacacttacgacgacgacgtccgacgtacgtcgactactacccgagtacggtacgtcgacgtcggacgtcggtcgggtacgtaggaacgtgtacgttacacgtcgtactacgagtacgacacgtacggtacgtcggacgtacgtcggtaacgttcgtttacacgtacgttagttaacgttcgttacgacgtacgtcggttacggtcggttcgggtactcggtcggttacgtggtacgttacggtttaccgggacgggtaaccggtaacggtacggtaccggtagtaaacgtacgtaaacgtaacgttacggttacgggttacgtgtaccggaccgttacttacgg

SEQ ID NO: 128268 - DNA, 705 bp, Homo sapiens
  misc_feature: GYAE6OF01D8WMX.2.70.G04.1.454.CMB.1.raw
  modified_base (246)..(246): a, c, t, g, unknown or other
  misc_feature (246)..(246): n is a, c, g, or t
  modified_base (686)..(686): a, c, t, g, unknown or other
  misc_feature (686)..(686): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgcctactctgcggggtccagactaccaccggagaaactgtgttgacgcagtcctcaggcacctgtcttcgtctcagagaagcgccacctctctgcgaggccagtcagtactggtcgacaagaacncgtcttcctaccgtacggtaccagaccgaacgtaaccgtcggaccaccgcctacccgaggccttccgtactacttactactcgtccttaacgtacttacgacgacctacgccgtaccgacgtcggacctacctacccgaacggtaccgtacggttcgaggtcggtacggtacgggttcgggtaccggagggacgtagtacgttaccgccttaccgtacctaaccgtacgtacgaacgacgtaacgacggttacggaaccgtcgtaagggtacgtttacgtttcggaacgttacgttagtttaacttacgttcgtactagttcggaggttcgggtcgtactcggtacgtcgtacggtacgttacgggttcggaaacccggagggtaaccgtacggtgggttaacggacgttaaaccgacggtaaaccggttgtacgggtanaccgttcgaaccgtacccg

SEQ ID NO: 128269 - DNA, 287 bp, Homo sapiens
  misc_feature: GYAE6OF01C8KVG.2.70.G04.1.454.CMB.1.raw
  modified_base (162)..(162): a, c, t, g, unknown or other
  misc_feature (162)..(162): n is a, c, g, or t
  modified_base (259)..(287): a, c, t, g, unknown or other
  misc_feature (259)..(287): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccaagggcccatcggtcttcccctggcgccctgctccgaggacncacctccgagagcacagccggcccgtgggctgcctggtcaaaggacttacttcctgtcgagcgtctggacggcgggctgggacgaaggcgcaatagnnnnnnnnnnnnnnnnnnnnnnnnnnnnn

SEQ ID NO: 128270 - DNA, 651 bp, Homo sapiens
  misc_feature: GYAE6OF01A7J1Y.2.70.G04.1.454.CMB.1.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
tcagacgctcgacacacgaccggtgctcgatttagtgtagtgtgaagggaaagggggaaggagctgctcagttacggacccagagggaaccatggaaaccccagcgcagcttctcttcctcctgctactctggctcccagataccaccggagaaactgtgttgacgcagtctccaggcaccctgttctttgctccgaggggaaancgccaccctgtcttgcagggccagtcagactgttcggcaagaaacngtccttctccgtaggtaaccagactaacggaaacctggccacgcctcccgaggtcctacctnactctatcgactacnttcagcacgccgcctactcggactacgcccaagacgtaggttcaggtcggctagggttggtcgtagggactaggtacgttaccacgttccctacgaactatcacgtacgagtaacgtacggtacgacgtacggtacgtttagtttcgtacgtacgtagttacttactacgtactacgtcgtaacggttggttacgggtctacggtacggttcgtcgtacggttacggtttacggaccgggtacggggtacgtaggtcggtaggaacgtacgtaaaccgtaaacggtacgttaggtacggtacgtacgtacccgtcgttaaccg

SEQ ID NO: 128271 - DNA, 953 bp, Homo sapiens
  misc_feature: GYAE6OF01CA4EY.2.70.G04.1.454.CMB.1.raw
  modified_base (122)..(122): a, c, t, g, unknown or other
  misc_feature (122)..(122): n is a, c, g, or t
  modified_base (150)..(150): a, c, t, g, unknown or other
  misc_feature (150)..(150): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctnctactctggctccagactaccaccgganaaactgtgttgacgcagtctccgaggccacccttgttctttgtcctccggaaggggtaaagaccgccctacccttctcgttcgaccgtacgggacctaggtcaacggtaccttgggttacggacctaaacggaaacctacggttccctttacccgtccgttacggaaccctaggacctaaaccggtaaacccgtccggaccccaaccgtcccgtccccgaacggtcccttccctaacgtacttacctacgtaccgtaccttactacgttacgaacggaccgtacggacccggtaccctacggtaccggaccctaacctaccccgaaggtaccgttacgggttacgtaacggggttccgggacggttacggggttacgggttaccgtacgggaaccggttaacgggtcgtttaaccccgtaccttacctaaccccgtactaaccggttaccgtaccgtaaccgggtaaccggttaccgggttacgggtacccgggtaacccgttggggttaaacggtttccggtttttacgggtaaccggtttaagggttttacccgttaaggtttaccgtttaccgttacggttaccgttacgggttcggtttacggggggttacccgggtttacgtaccgggttacgggttcggtttaaccggtccgggttttacggggttaccccgggtacgggtaccggggtaaacccggttacgggtaccggtaagggtaaccggtaacggttaaacccggtaaacgggttcggttacgggtacccgttaccggtccggtaaccgtttcccggttacgg

SEQ ID NO: 128272 - DNA, 612 bp, Homo sapiens
  misc_feature: GYAE6OF01CYAHV.2.70.G04.1.454.CMB.1.raw
  modified_base (411)..(411): a, c, t, g, unknown or other
  misc_feature (411)..(411): n is a, c, g, or t
  modified_base (519)..(519): a, c, t, g, unknown or other
  misc_feature (519)..(519): n is a, c, g, or t
  modified_base (569)..(569): a, c, t, g, unknown or other
  misc_feature (569)..(569): n is a, c, g, or t
  modified_base (601)..(601): a, c, t, g, unknown or other
  misc_feature (601)..(601): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggccacctgtctttgtctccgaaggggaagcgcccacccttctcttgcgacgggccagtcagtctggttggacaagaacagtcttcctcgtcggtaccagacaacgaacctcggaccaccgcctacccgaggtcctccgtactacttctagtcgaccttaacacttcacgcaccggcaccgacgtcgactacctacccgaagaccgtacggtcgaggtcggtcgtaggtcgggtacgngggactagtcttcgactctacgactatcaacgtcaagtcgtaggacgtcgtagtacgtttgttgacgtagttagtacttcgtctacgtgtacgtagttgggtacggtntacgcggttcgtaggtcgttagggttccgacgggacggtaacgtgtacgngtaacgtactaacgtaaagtcgtcggtacgtntacgctcgtcg

SEQ ID NO: 128273 - DNA, 681 bp, Homo sapiens
  misc_feature: GYAE6OF01D205H.2.70.G04.1.454.CMB.1.raw
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactcgtggctcccagataccaccggagaaactgtgttgacgcagtcctccaggccaccctggttctttgtctaccgaaggggaaanacgcccaccctctcttgcgacggccagtcagtctgtgacgagaaacngtcttctcgtcgtaccagacacgaacctcggacccaccgcctccacgtcctcctactactctacgtcgtacctactacttccgagaccgaacgtccgaccgtacgtacggacctaccgtaccccgtaagaacgtacggttaccgaggttacgacgtagggtgtacggtacgggacgtagtacgtacncttacaccacctancaggtcaacgcgtagacgtcgtagtacgttagttgacgttagtagtttacgttacgtgtacctagtacggttgggttaggtcggttacgtgtaggtcgtaccggttacgtttacggtacgggaccgggttaacgggaacccgttaggtaccggtaggaacgtaaccggtaacggttaaccgtaacggttgggttaacgccgttaacaccgtcccgttaaacgg
